United States Patent 10,724,096 (METHODS AND COMPOSITIONS FOR INHIBITING AND TREATING NEUROLOGICAL CONDITIONS) - sequence listing, part 78

SEQ ID NO: 1569 - DNA, 639023 bp, Homo sapiens
agtactgaaattaagcagcatccaacacaggcctactcttacgacatgtgactttactgttttccgtttttgttgaaagagtcattaacagttaggagttgatggcagtttcaataacaggtcattgccgagaaaaggtaagttttaactttatattgtacatgaaatttaaacttgaacatgttcggcagagtttcctacattttggtgtgaacatataaacatttctacaaaatatgacgcttttacctgtgattaaaacattggctggtttcctttgatgtagaaaagaatgttcttttcatatttgcagctgtcaaattccaatgtcttttactaaaatgttataataataagatgatttgctaagattttgtactaaaatgttaaagacagaataagttataaagttttagtttgaagtgcatttaaaaataactactagaaataatgtgagactttgcacctttaaccaactgttttataaaaatatgtattgttcaacatccagataaggaaagagaaaagggtataacaatgagaaatagcttgaatttcagtgtgaaagatactcactttaaagcattgtattaatgttagcactaaaaacccttaaaaaggttactatgtagctaattaaaaagcaaggagcttttaaaatgtaaaggaatactgtctatcatgacacttgaaattttttttctaaatttcatttaagatatagggtgaaatgagtgtaagtttctaattcataagcaaacttttatatttaaaaaagaagtcacagctgatttcattgaaggttactctgagaggagaggcaaattagaggtatacttttgttatttatgtaattatataattttccttctttgaaatattccaaaataataaaccttagaaatgaaaaggatttgttagtcctaaactgacatgtaattttcttttatattgacttcttgcttttacagaatgtctttgtgtgctgtaacatatgtgcagaaaacatcaaaatattgctaatctcagagacaaatacctaaaataaatctgactgtagatttttgaaagaattttaataacagcccaagatatgatccattcttccctaatattatttttattgtgctgctggatgggagaagtgatggcccccacaacacctattttttgtgttattaaaaaatggttacagggttgataagtggcaacaattttcttttcttttattgtcttctattgaaagacacacataaatgttttttgacatggtcaatttagtaggaaattattaggcatagtagtacactccattttaagacctcttcaattgtcaatactgaagctagctacttgttgactattaaaatgatcacagaaaaatagagattaggacttggtgttcaatacattttttattgttagcatgtaagaagaccctggtaatatatatttgctttgatattgtgattagattttcaatttgttgcatttcctcacaatggaaagcattatttaaatctgtcttcaatatcgtggttctgaacctctgcatctatagaagctgtataattctgataattttggttgatatgttattactttctttcattttattataaaagaatatcaaatgaataaacacatgcaatacttacaccttagcaagaatgaatatgcagataaacatctggcattgaggaaaagtccatgaaaattttttaaattgtttaatgcttttaaaaaagaaattcactgtaaaaatgagtgtttcttgcagaaactgttaaattaaaatacacatattttatggaatatgtgtaaaattaagaatgaattgaagagagcttgatatgaatttagaaagatcaatgagtaaagatgataggtaaattaaaataccttcagaattgtttgtaaagagcagtaaggtacaaaccaaattttaagacagttaattgcaaataagttactatagaattctattactttatatgttttaagtggatgagtcagaaacaagttttgatgaaatgaaaataatacggaagattttatttggaaagtcatattaaagctaatttgctcaaagaatgtcgtgcttttccacttagggccagcattcagtaagattcagaaaggagaaactctttccttgatattcctcctgttgctcctttttattattctcttctggagcggcctgctctgctcctaatttagagtcccatagacttggtacctagaaagatagacccttccattcactggctccttccattcaactgaacttttaaaatgtactcatcccattttccagcacttagggaatctaataaaaataatccacgcttataggagaaggctacagagctttgacttcctagccaggcctccctttctccccccagtggaattttaatatgtttcctcagcagacagggcccaaaggattagctaaatgttggatctcaagtgaggagactgatgccatggtaaatggttgggggaagactttagagggagagtgttttgttaaccattggtcctgcctgtggcatttaaacacagaatttctggaagtgtctcatatgaaggatccatcccagtgatgtatccatttctttaagatagtcctgaagaaataaacacctttcttgcagcaggtaaaaaaaaaaaaatattgcactacattttcaggcaattttgatattcccatacacttagaaattatttaacataattagtttttaatagatgtattttaaaagtcattgaacactctgaatttaattctttggatactaaaagcatattttttacactgtacaataaatgctacataattagactttaaaatgcccttgtaagtattctaaatttgagcttagagtgtgcaaaacttctttgttggcaaacgatagaaaatgagttcaaactagcctaggcaaaagagatattcttttatgtgtgaaaagtctaaggatagcaaagtcaggaatggctggatccaggagctcacacaggattatcaggagtaggtctcatttttttcattcctcagctcttcttttcactatgctgtaagcagtctctagtggaagctctcacgaaattgtcaagctcctactgagttgatcctttcagcaaactgtggggaaagaatgcttttccccagtcaccacagcaaagtgtcagatttagatctgatgggactgaattggatcacatgaccatagctgaacaattactgaacttgggtgcagacagcatgcgtgaccatgcctagctcacaggcccactcctgcactgggggcagctacagctgcagcacttgggctctctgctaaaaagaggggtctcctgatgtagaaattaaaatgctttccccagaagaaaggacaaaagcctcaaaattctactacggagtcacgtatggtcacattttaaacagtcattatttcccaacttcttcaaattccataattgtacaaaaatacagttttaattgaaaggcggatctgattgaaacatgagtttgaattaaactaaattttaaaatatttttcaacagctactgtatgtttgacaactcctcacaacatttgccttctaaaagcttataatccagagtgactattattttaataattatgatgcaaatacaatttgtcaagtaccataagaagatacagagaatgctctattagagttcagaaattcatccagcatttttgcattcctgttatttgccgagccataaactagagaattttgtaagtgttgtatcatctgatcacatactttcagggagttctggacagttttggaggaaagttttgtggtagttttcagggaaatctagcactgggaagatgagaaacattgcaagggacaggaaggaaatatgtcaaggcacaaaaacacggcgtgtcagagaattccaaagtagtgtgaattctccagttttgttagacagaagtatagtaataagaggtaggccagaaagatagtgtgagatcataaatagagtagacctggatataagtaacagcagggtttttgagcaggggagatacgtaattggatgtccacacttttacatcttgatgggttgtctgtctagggtcaggatgtatttgtttcttccatttatctcactgtgaagtgacattttctttgcagaagagtttgaagtcagtggagatatttctgtaaggacaggcactgacttacctgttcaggtgcctgaggttcttattcaagttatggttataacaatcttttttttcatttgatgaaggccttttgtttgttttgtttgcttttaatttaagaatagatgatatagtgagatggttcaaaatcaatataaaaccaaaacacaatgtttttagataagctatttcttatatttttatttctatctatcccatttatccccatcttaatccaacgtaaccacttttcatgtttaatatatatatttatacttcacagtttatgtaaaaaccatatatatatgcacatctatgtgtgtatgtatataacataactgcacgcacctctccactttgctttttttcttttagaaatatagattagagatattttataacaaaactaaggaactaattctcttttttacagctgtatactattccactatatggaaatatcatacttaatttaaccagcctcctgtaaaaagagtgatggatgttttcaagtttttctaattcaatgaatgtccatgtaattgtttctatttgaaaatctatctatctatctatctatctatctatctatctatctatctatctacctatctatctatcatctatctatctatcatctatctatctacctatctatctatcacacatttccagaaataacatttatgagacaaaggataaaataattttgatagttgttgccaaactatccttcatgttatttgtaactttttgaacttccaccagcacttaatgagaatgcttgcagaagcttcattgctttttcaagggattgtgttgccaagctttgcaggttttgccagtctctaacaactgcatctcaacacagttttattgatatttctgctattatggttaaaattgatcttctttttaaaagattaaaggtcgatttgctttccttgtaagaaaatgtattctttctcagctgtataactaaagaccaaaacattagtgactttagtgacactcaagccttggagtgagatgtcaaaggaagcaaagaactagagatagcatatatgaaatgctgtattccttttcttttttttttttttttttttgagacggagtctcactctgtcacccaagctggagtgcagtggtgcaatctcggctcactgcaagctcggcctcccgggttcatgccagtctcctgcctcagcctcctgagtagctgggactacaggtgcctgccaccaagcccagctaatttttttttgtatttttagtagagtcggggtttcacggtgttagccaggatggtgtcgatctcctgacctcgtgatctgcccaccttgacctcccaaagtgctgggattacaggcgtgagagcgcgcccagcctaaatgctgtattccttttctaaagcttgaaatagacagtagcttaaaagggggataaaatatgaatgttcaagtgaaggaggagaaaaggaatgaaaataaaggaacccaacaaggtctcagaggagactaagacagatgggtataatcactggctcaagtagatgaattaaccttaaacagaagagagagcactttaatgagcgtgaatgcagatgaattggatataagtaagattcagtgaggagaggaatttgagggaatacatgcttcatagtttctatctttgcctaaatggtgggaaagttcatctgatgaaagcattttctgcatgtcaaaaactagacagaatatcttattttaaaacttatccttgtcagtaacacacaatacaattgtggattttgcaacttattttttatcttttgctggttattagtccaattccattcaactccataaataattttgaactctaagtatactatgttgtcctaaggattgctggagatacaaagaaatagatatgctacttagccaatgaaaactgtttagtaggtaagaggtacacaaagataagtatctaaatatcaattatacatataagtccagtgccatagaaatattatagaatataccattgacagaatcccaaaggtcttcattttgccaaatctaatagccatttatgtatctttatattattcactgtctgagctgcatttgatgctatcgaaccctccttccctcttgaaactctcttttcatttgacttctggaatacttttttcttccagttttcctccaaactacctgaatgctctttctgtatcctttgctaacactttctcatcatctagctctctaaatgttggaatgtcctgagatcagtctttggatttctacttgtcttctaggtttattcctttgcggttttatttagtttcatgaccttaaatgttatctatatactaattatatttcaagaccaaatcttttctcttagcagtaaaactataaatccaattgcccattcatcatctccacttgagtgtctcatagagacatcaaagtgagtatacagtactcaaagcaaatctcctaattactgcccacctgtcccccaacccagcctgcttctttcctttttgcctccaccttagttaatgacaccatattaatctctcttttcaggacaagagtctaagaattatccttgattctactctttccctactacttcctacccaaagtttcatctagtttatcagcaataagtagagcctgtaaaatataaacttacttttcattatactgttcacgtgacttttctcaataatggcccttaaggtgttatatcttttttttttcagtctaatacttcttttattttttatttttttggttgtcaatacaatgacttttctaaaaaaatcttgccaagtgaatacagcacaacatgacacttggatgaacatcaaactttagataaaacacacacaccaatttactctctgctttcaagttagaataacaagaagcatatgaaacaatgttgatttgtacatgtttgaattaattcaagaaggttgaagaggtggcaatgtttacaaccttttagtcagactttttgttgggcccccggctccaggtgactcctgtgctgtaatttgttattaagtatactttgagggcatgaaaaccgttaagtctcccaatccttaaaaatattactgaagaaaaagatatggaaagagaaaatgtaataaataaaaactccttttatattacattttgtttacaatttgtcttctttcaaattgttgctattatgtacttgaatccttttttgaggttctattgatatacttttatacttataagtgatgattggaaatcttaggctcttattgaataactttgtatttcacgggaatgaattagatattaagcaagaggtataggtacatcagaatatcttgaattcaatcacttctttccacttccactgctgttattgcagaattctcctgactctcctccctgcttctatcttccccacaatagtcattgtccaaggagtagacagagtggccattttaagagttcaaccatgcaaactcttttaatataatattccaaatgactattatacttcaaattagattcaatctcctttcatgatttgcaaggacctcgttatctcattactctgcttttgttttccttcatattagtttggctatggaatttattatttatttttcagtgtttagtggctattttcaccttagaatgtgtggtccatgggagtattgacctcgcctgtctttttactgctaaatacctagaacctagaacaaatggtaggtgtatgataatatcaataaatatttgtttagtgaaaggataaatgccataaagattgactttgggctgtagaatcaaggaagacaatctggagatgtgtgaattttcctggtctaaaatatagggtaatttaggagaagagaagctagaaatatatttcaaataaaagacactatatgtactatatatatggtacagttttagtaagttggcagtgatgaaaggttgggtttgaattctgtatccattatatgcttctgaaaaatggaacaaataacccaccagctgaaaacatattgccataaactgatgagaaagagcaactacctctaagtatttaaattttaagcaattttactaaaaccatggtattaaaattgactaattttatgttcactttaaatccatttcctaaaagagtcaaaacagaacatctctttaaaagagctatggaaggtagaatgctcaggaaattggatgctgagtcaagggaaacttccgtttctgttcatttatctttctgctttagttaatttcatgttagaattttaaagactagaaactgagcaatggaacccaaattcagctctctgctaaatgcactggggaaatcaagtaatctgagcttctgtataatatcacctattcatactttgatggttctcctaaagtagaacattaaaggaaaaaatgtatggtgattacctcagtggtgtctcaagcactgtggtaagtactatagttgttaccaaaactagacaatattaacttattctcaagatgtttacagttgcttgagaaattcatcaatataaattattagagtgagattcttaataattatcatcatagctatgacttactctgtgtagattatgggacaagaattttgcatgcataattgcatttggtatccacaaaaatcatgtaaaggaatttgtatccccattttaaagataaggaagctaaggttaagagattaaatatgcaaatttacaaagcttctcggtaggctgggtcatgagttgtacatagatctgggtaatgcaaagtccatgttattttcagtatgccatgcgataattttgaagcctgttaagtgttagcagttaagcaatgctgaactttattcatgaggccctagagtctaaaaggctctaaaagaatcctactttgtttgatgtctaaagcaatgccatctgtaggaaacctgttgtttcttctctgcaaatattgcctatgcagaagtgttgtaaaacttgtgaggaagaaaacgttcttttgccttggtttttgccatactgcaggtgtctttcctctttctctttttctggtctcctctggattctatgtctccccctggctcttaattctcaaaaattccttcttagatccacctatccaatacggtagcaactagcacaagtgactattgagcacttgaagaagggctagtatgaattaagtgtaaaataaacaccagattttgaagacatagtacaaataacgaaaatgtaaaataattaatattttggcatttaatcatgctccattgattatatttcgaagtattgggttaaataaaattattaaaattaatttcacttatctcatttaacttttccaatgtggctacaggaaatttttaaactacatgtgtgtggctcatattatatttctaatggatgccacggctctaaaccatcttctttttggtctctcttttgacgttcttataatttcaatttcattcctcaaatacggtccttaaatttctatctttagccttggtgtctctgtcaaaattgttccttatttctaattgtcacttgatacttcctctatgatatcccatcagcaggttaaactgattatgtcccacattaaatccatggcctctcccaagggttatttttgccttccttccaatttcgattacatctctactcctgaagtcatattattaagggacatgatatcatccatatcatgtattccataccacttattccatacatccaatcaattgccatactcaagcagcatttattcctttctttccgtttgcacgtatcatcatggtcactattggtcatctattgagtcttgtctagattatggcaaaagagtctcaggcttttatattgctatttctcttgcctctttattttgcttcttataaatgtattttaaggctttagggtgatagttgggtttgagttaactaatgcaagtaataatgtctatcatctatttatattctatttagaattttaaaagtcgttttgcatatgttattttacttggtaattctagaaagccagtgacaaagtgggagcttttagtagacttcgtagaaaaaggcagtgaagcatggagaaattgaattgcgggaggacacagaagggctaggacacatttcaggtataaccattaaaacatactttttctcaaattttagtacggaacttttttctttcttacagagatagtagtggtattaaaagcacaagctgggaagtcagaaaaaataaaactcaactctgggccctaccacttgctagatcctgtatgatattttgggcaagttacttaatctttctgagtctgcattggctcatctgtaaaatggtgagtttcctcccaaggaaaaaatataaaatgatgtatgtaaagatgtttaccctgcatgaggcacatagtaaatcactttaaaaaggttaaacgcggtggtaagagtagcagtagtaattgttttatcaggtcttgaatcaaagagtgacttttttttcttcactatgatgtaaaaatcatgctatgataattttggtttatttcaattctaagtattatgataaaattatgaaactcatcaaaagcaatttcttgctattagtttcattttctcaatacagctgtgtgggggagtatagtatagctgtgtgggcaaagggaagaagagataactcttttcttgtttgtttaccaatttttagttgatatggtagttttccttcaagcagctcaagatgtaccctcaccaaaaataccctttaattatgaagaattaatatttatcacataaaacaattcaaaaacaggtaggcagccactgactcttatgcctgaaattaaaatgaagcaaagaaaaacagcaaacacgaggagagaaaagaaagtagaattctcttcatgcacttttattttaaatctaaatttttgcatggagtggtaaggtagtaaggtagatagtccacaagacagatctactagggtcctagaaaaataattctgagaagggaacatataaaaggaaactaggaagtcctgagagtatagattgctaacccagtaaagaagtcttttgtctttttttttcttcctttcttttgtttaattttcctttgaggaaaccaactcaggattctatatatgtaggttgaatgaatatcccaactcagtcctaattttgaaagcaattggtgttagcgcatccacttaatgagaacaaggtgcagcagaggggaacccacgtgctgacaaaatgctgggaagacaaccagctatggtgctgtccacagaaagcttgctgtatcctatggccagctggcattgagctttaggtttgaagtctggcattagcaaaggggattagcaagtgggcagtaggttcagggtgggaaaccagcttgacaaaaaacctggagaccagtcagcatggcagatgtgtagagcatacacaccctggagcagggatgggggaaggtgaaatgcagtgatctgacttctcctgaccatgatgagctgtatggtgcatacatttggcagctttagatgtggagaggtatgcaggaaacacaggaatccaacaacacttgggatttggagtcacagtcattctaatcttggtggcaaacttgaacatgctggaaatgctcatggcctgggggagttcaagacaggggatttcagacagtgctgaatgaatataccaatttcagtactaattctgaaaccagttggtattagggcattgaattaatgagagcaaggcatgggaccaagtgtctataatgtcctaagtacaatacagagcaacaacactgacaaatacagtgtctgactttaaggagcccacagtcaatttgggcagaagagacacacagctcaaatagagaacagaaaccaatataaggcaggatataattatctgccaaaatataatagaaacagtagaggaggcagagaaaagagagggaggaaaaggggaacttgcttagcaagagcaaagagcacagcacaatatcctactcgttgtaactaagatcatgttgagaaaattgtaagaataaatgaagtaatgtgaatgtctgacgatcctctttctaaagcagtagtacaaatgcaaatgcaaatgcagtctcctggttctgctcttcatttgcgatcttaccagcttagatttaaaaataatgaaatactgaaaataatattgacttaataggcagcacaatcaccattcaacccatacatcagaggagcaatgttcctaggggtgattgacactacgagccacagtcgggaatgcctgcaggccagttgggatatctatacaagataagtgggtaggagaggacctgtagacaagagaacgtctatatgatgccttgtctataggatgtagaagctgtccacccgcagctgtctcttaccatacacacctggatcagtttgccacattttatgaattttcaagagaagacatatagacatacttttctgtttttttttaaaagtaacaaccctcatttttcaattggaaattgattcaaaacattccaaaacattgttcaggcccaacaacatatgtctgtgggttgaatttggttggcagtctgccgattttccacctcttcttgaatttatagctgctcctaaaaaagcaggagcagagggtaatgattagagagaactggagtcctccaaataacttctgtatatgcaataaatcccaataaatgtttagagactgactggagcattagattattctgtgaaaaaagcatccatttatgtatagcttcttcatttaggtccttgttgtgtctgtctagcttgcatgactgggctcattttcctaaattgaaagaacaaactttcttctgctgccaaccctccccaaagcatttttttaaaaaaaatcattaaaagatgtctctaaaagtttaacttgactaagtcataacaaatacatttgtctttgcatcaactgttatttttgaatcgcatgatgtaggtagggtatggatcagaatgtgtggaagtactgttgtaagggagatgaaagagaggtttgcataccttgtgttgtgatagtaacagtggcaaccatttaaatacacatacatgtgtgcatgctcacacacacacaaaaacacacacaagaaccccaccagtaagtgcacaagatggggaaatgtagctggggcttggttgcataacccatttcatcacgttttctcctttaatagattagattctctgtctcagacgtagttataacaaaggatataagtaaataaaacaagacagagaagaaaaatgttcaatgatttttaaattaaatggataattctcccaactatttaatactctaaatatttatgcattttttactttaatgtgtccaagcaaaaatcctatatttcactttgtgaagcacctaaatttagacagaaatttggctacactaattcaaattacagtagcactcaattaactggaacctattagttatatcacatatgtaaccatctcctcctctgcctctcaccttgaggggagaagcctgggaactatactttgaggaagaaaaagcaaactaaacttgtttaagtggagtatctagtcccccagatagctcctatattaagattcctgaaaaggcagttgaatcacttcaagagactaaaggcatcaagagaaccttcagttattcatcctagaaagaagaggatacattttaaggtgtacatatacaatatacaattaacatagtatattgtatctcttatcttcaaagaaaaggattgaaaaactcagtaaaaaatttcagtttaagtaatgtgaactggcaaatattttttcactattttgatcatctgggcttcttgaaaggaagcctgaggatacataattttgtggatttttttttctcacaccaaacttcctttggtctttatcaaggagagctattttctttcttttttttttttttgtccctcagacaattacttgaaccacctcagggctaaatcatccaccgctggaacaagaaatagaaaaccatcaagacactgggaccaacttcacagtaataagagtacatgctaagccattctatccagaacctactgcaaaagcaatggaactgaaattggatgggcattcccatacacttttttttttttaactttaagttcagggatatatgtgaagatttgttacctagataaacttgtgtcatgggggtttgttgtacagattatttaatcgcccaggtattaagcctagtacccattagttatttttccttatcctctccctcttcccaccctccaaactccagtaggccccaatatgtattgttctcctctatgtgtccatgacttctcatcatttagctcccacttataagtgagaacatgcagtatttggttttctgttcctgtgttagtttgctaaagataatggcctccagttccatccatgaacctgcaaaggacatgatctcattcttgttatgactgtatagtattccatagtgtatatgtaccacattttcttatccagtctattgttgatgggcatttagattaactctatgtctttgatactgtgaatagttgcctcaatgaatatacacatgcataaagggatgatttatattcctttgggtatatacctagtaatgggattgctgggtcaaatggtatttctgtccttagttctttgagaaatctccatactgtcttttacaatggttaaactaatttgtactcccaccaacagtgtacaagcattccttttatgaactattttttaagtgttgaaattgatgttattttactcacacttaccaagttcatgatataaataagcaaagaaaaagtaaaaagcactcttgcactcaaagttgtgtatagacccagattgcctaggagctctttggggatttcttttatgcaaaagaatttattttccagcaatatttatgactggatgttggtctggttgacaaagtaccatattttaattagtcttaagtagaatatttacagcatcattttcatgcacctatgtgtctatttatctatttacttacctgcttagctacctactcatttatctctcactattttcaactattgcccatacccctacccctcaccagcatattctaaagtgaactttcattcccaggaaaattaattagagcagtaatatgaacaaaatgaagatagcagcaatgggctgtaaaataagaagacaccatagtaacaagtaactatttcacaataatgcgcgtataaaattaaagaataacttacataaacctttataaaaataactttttacaaaagggtgcagctgaatcccttaggggttatgaccaaatatgcaatttctcagcctctccctcattctccttaaatgggaatatctgtggaaggttcagctaagtctgcatatttaataagctccacacattgaccattgagaattactactttatagctctctttctctttactaccagaagcatgtgcacatctggaactggttatttctgacccttactctcaggtgaaacattaacttaatacagacaatctttaattctagtggaatggggttttgtggattcaacaataaattataatgagtgatctcatcttttggtctgggcttgtgatgtacaaatcaagtgcattcccaccttatttacaagtcccagcacttcagtgggtcacctcttcctcactggacatttgctttctccttgaccgcaacttcctttgctggtaacctggtcattcattgcctcactctcttgctagggttgaggttctacctttctattgccaatctcctttgtggataattgagctagacctgaacaaatagccggaattgagaactgtgccacctagcaaaaaacctcctagttgataacaatctgcaaatctgaacttctcagtattccccaccctgtcagattatcaatgactgtttctgctcacttgttgtataactcttcctattcaacttgtatccccagttgccaatatttacctagattgtgaccacagatctatgtaattgcttgacactgtcagcatctttcaaactgaacctttcgtcaccacgtgtggctaggagagctctccagaaactggtcacttcagatgaaaagccagttcccggttctttcaggagagataacaggtccttccaatttatatatgtataggggtgtgtgtgtgtgtgtgtgtgtgtgtgtgtgtgtgtgtgtataatatatatataatatatatgtaactttatttccatatggaatatatatatatctcacaccaaacacaaacattatttccagatgaatcatagttctaaaaataaataaagttgaaacaactcatttagaggaaatcatgggaatagtctttgttgccttgaaattaagcaagggtctcttaagagggcaataaaagcactaatcgtaaaaggatataaataataagttaaacaatattaaaattaaggacctcttcattaaaacatgccattaagagagtgaaaaagcaacccacaagtgggaaatgataactattgcaacatatatattaaaaatagacttgtggttataatacataaataactcctataaatcagtaagaaaaagacaaacaatctgatcttaaaaacaagcaaaagtattgcacaggcacttcacaaaagaatattgcatagcaatcatctttacaaataaaagtttgagtgaaataagcccatcaagaaaaaatagaccctttaggttttcattgatataaagttcagaaataggcaaaacttagaagacagaagaatgattagctttagtggggtgaggtgggtagtgagtggaacagagctgtgcggggattctggagtgctgataatattgtgtttcttggtttggctgtaattacaagaatgtgttcagtttgtgacagttcattgaactttatatgcaaacataggcatgcacacacacacacatacacacaagctatttaaaatgtattttactcataaataattgagcaagagagaactgatttttaaatgcattaaaggagatactctgaaaacttttattttaatgatatagttattgtccttcacaacaatagactatgacattagtgtcccatcattagacatgcccttttggcactgaaattcaatctaataaattcagagtttggagatgagcattagggaaagactaatagatacaacagcaaatttgctaaataaaacaaatgtcaaccatatctgactgttgtcaattactgattactgttaattactgtcaagtactaattatgcaatatgcaacttccacatatttgaaccctgggcaggccaagatagtgatagcctggcataactgcaaccaatgggtgattagatttaatctgcctgataaaaagactttgcgactgggtcaagcactttaagaaggaaagacagtagaacaagaaatcccaggaaactgagacaatcgcaggttaaaatttcctttttgcacttgatactctcccaacaaagattagagaagtagcctgtcccagtgagggtctgagactccatttgtttccccagtgttttctaacgctgtggctgctgagcaacttgttctagagctgatgttttctctttaagtgacatttcatcatcaatgccctaagatagtcaccctgttttcccttaattgatagttgtacgcaagaggcggaaaatcgctcagcatttcttgctagattaggtcaaaactgacagaggaaacagagagaagattgcattacttatgccccttatggctctcatctgtatctaagaagattgccattttataaaatttcttatgctccctaaatgtaattacaatggcgcaggcattttcttcctatttgcttttcaattttttactacctgcctgatcatcagagggaaattcagaagcagttccactaatcttaactttattttccttatgtctctttaattagatgcaattgcaccctaggaaccttttcttcaaatgctttatttagttattccttttaagtctttacctttcttttcatttgattgttgaccagaagcattgaacatgtacctagatgttcagagtgaagtacctaaaattctggaatattttttccgtatcacagggtgcccttttcataagattaatgtttacaaatagatactgtaatatttattctgttttaaagttaattaagaagcatcccacgagcatgttatatatttattttgtggcctcaggggtcaaggattcttacttgtggatttcttttcatcaagtatcttagaaaggggttataccttaaacaaaatcatcaatttccccaggatctataagacaaaatcccaattctttaataaaaataaccaggttctcctaaggcagccttaatcaaccatagctttcccacttagccaccaacactgtatcatcttgtgtggatgttcactcccctttccttaaatcttgtgatctcagcctgcactgctcttgatatcccctctctgcctttcagagtcctgtttatcatacagcatccaggcctcacatcacctccaccctaaaatcatctccagtcccattctccactgcactctaatcagacttcatggtaggcaagcctgcttgtgcttaactccactgcagggtgcttaataactttgcagaacctgtgggatgtggcaaagtctatgtctcagagtagaggctcaataaatatttgaagtgtaaaatgagctgctttgctcccaacaggatggagtttgaaaggttaagagctaagaaagatcatggttgcctaccacacacttattctacttttaaaaaatattttacttgacattttcaccatttaagatggccatgtgcagtgataataactgtattacaatttaccatgctgcagacttgtcagactttgtcagcaaatgcagcaaatactccagattccctgctataagttaaataaatgcaaaaacttattatcacatttcctatatataacacctgcccaaagacaatgttacccaatggggtggctatggtcacattcctttactgtgatcttcctttctcattatatttgacatttttgaaactgagttttattgcactctctcagcttacagagtggtcggggaaattagacttaatagagatgtaaaagccacagggagaaaacaaaaggaaagtgaaatggaaggaaactgaaattaaaatgctattttggtaaatggctgctgtggtggagacaacaaacaattgcaatgcgagttaattactgacctgtcaggaaagtgtgacgcgaaggttgtggcacacattactggagctaccaggaccacaactcatttccacaggggaacagacttgttctaccacagatcaacataagatctttccaggggatagaaatgaatttctcggagaaatactatttatctgtggagttgtcatgagctcttagcagacctggagaaacagctcctctaatacatgtagagcagggaatggggttgtgtcaccagagaaagtttgtgcatgtttaggcagaggggaccttcgctcctcgtggtggaccttcgctcctcgtggtggatgtgctaaatatacagctcccttgccatggagtgaaaactcaggctaacactcatgaaatgggaattccctgggtgtatggccatttcttgcctctgagattttactcacaaaactctcagtggcaacctatgtcttccagaagcatccttcttttagggaaaaatatcaagtacctatccaaatctgaaactcaaggaagactattctcaaagcaaaaatccctgaaaattctaagattgtgataaatttgatctttttttaatgagaagaagatacagggcttttgggaaatagaaatatgatatttttaaccctaaaatattatatgaatctccaagcatactttaatattagcctcagaacacagaagaaacattgttttctttctgcctctaacttataataaaatatccatagtttatttactctaagaaatattagcaaaggtgagttacacatttttaaagtaagaaaattggtcaaagacattttcttctttgccaggctacatacactggcataaactaggttccatatttgtttttcatttatacattcaacaaacatttaagtctctattgttttgtcaggaagcagaggaacatttataaatgattaaacagaaagacttgcatgatacatacctaacgtggctacactatgatcattttatctgccagattttctttacatttcttgttaccttttctttccatacacaatgtccacttgatttgtgggtctatggcgaaatcaaggatgctggggggtgtgggccctgagtgccatcctagagttattctgaacagaatgtgacaccaggggatggtgttcagtatacccaagcctacattttctctactcagcagcataaagattatatcatagtgcctatccagtttttcccagctcaaaaattacttaatatatttttacttttaatgctgttgatgtgaaagagatgtcaaaaatacacattctaactcaaaagggcaggctgctgagctttagtgtagttaacagaatgcaacaaataattgggagagcagctatgaaatttatgattagatgaaatatcatgttcactcctatttgcagtatgagtaggaaaatcaagcccagaagcccaggacaccatcgaaccacgtagtttgagcagagccaaagttcgtgttgctcttatgaagtgcattctcattactgcttcctgtttttaaacaggattgaaaggagaactagtgcaatatcacaaggtattcttgctcttctgttggtacacgtaaaatcaggaagtctagagaatagtgaagccagtcttaagtgatttacatttcaatttctaactcagggatatttatttggagagtttagtaaaatcaatggatatctcaaacacatgcaaaatgagccagttcttcaatattttcattagtcattcaccagtgctctgtatgcctcctgtaagaacataaaaacacaaggcatcaaagttttctctaacaaaatttaatagtaacaataatgatgatgacatgagtgggtaacgtgttctaggaagaacaaggggaatactgaagaggcacatagatcaagcaaaacctaaacttaatatgatttgaagttaataagcctgatattactaaattacatagaaataagcataagcaaatattattgattttacaatctaccaaatctagaaaattgaaggtcagtgaggaatgaaaacatgggtggaacaacagaatataatttaagattcctgtgaatatttttggaataataatgcagaaagactcacaaaactggagttcctcgttctctttgagagaacaccctgaaattaatacagatattcctggaagaacaaccactcctaggttctggaagccaagtcaagttggactctggggtatgagggtttcttttgagtcgatgttgagcaggctttgcaatggagtttcttccctagaaccttatttcataaaggctaaaaaataagaccaccatggaagggatattgcatcatacagctctaggaggcaccattttccagaatgcaatgttaatgtcccatccccagtcacaaatcctaccacctctgaatttatgtaagggcataaatagagtggactgatcaatgctcttctactctaagatagttctttcatgtagccagaagagtttccagtttgagattcagttaaatgcttccttgagagttaagggaaagtctgactgatataacattgtgttagctagtctaatcatacccctcccatatacatctaagtgattcagaggtaagaaagaatggatgatggaaatttttataaattttgacactgtagttagattaagcctaagtgaatgctgcagtgggtgctctggcagctgaaatatgaaaaggattatagggtgtctactagagaaaaaactgttgggatgtaggcagggggaaactggggagttgaaagggaataaagaaagggctctaagtgggaccccaaaacaacttgcaaaatatggcctagaaacagccctgtctaattggaatgagaggttcctaacgggatgaatcagaggaaatcgtctctgaacccacaggtacagcagtcacaggtcccacagccactggcacagctgtcatcatcctgttagatttccatcctcaactgtcctccttctgtccggcagcagggctctgcttccctctcaattcatctccattctcaattcatccacaaaaaaacattgtgtgttatgtacatccaggacaacacacattctcttcctcagagtgtctagaataccagcccctctggtactggttgggttagaagggatgggactctcagtcaatcattcagccagatgaaagataagcgagatgatcagatatccccacagagaggtcaaatgctaccttctctatgaaatccattgtttctttctttcttcgaacttccctggtactttatgtcccttcatgacatatgtcaatacctaccttataatatcccaggtatctgcacacctttgcattgccaaatcctttgccagaaatgtccaacctgcactgacttagctctgatgtaatctgatcttctcttgcagacttcctctctctccacctcccacttccacctgagtttaatgccattgctcctctccccacctgggcactgccctattctcagttaattattgattgtttctctattgccctcaccaaactctggggcacttgataaagattatctctagtctctaaaatggtgcctgccacttaggagaatctcagtaaaggtcgaaggggtatatgtatgttttctgttgatagaaatctttaagacgaggttttgtgtcatttttctctatcttcccagagcaatatagtggtctgcaaaattagaaatccccaaatatttaacaatagaagaacaattatgaaatagcatcaagtcaatgaccttgcagagcaaagtacgtgggaagcagaataaagagaacaaacttagtggagggggtgtcaacaaaatgtaacaacagggtgagatggaaaaggaagtgagggctggaggagagacagtgagcaaattgagagaaataacattaacattgtggtagagagagagatccgcctgatggaaagatctaagaaagcaaaatcttgaaagtattttctgcagcttgtccccatgaaaacagaggtggggaagccagataaaaggctttgtaatgaatccagccttttgacagtagcatatcactaggcaaattatggtttgattgtgaaatcaatataggaatgcaaattttgatttgacactgaaatttgtccagcttctgaggaagcaacatgtcctataaatggtgtacggttgggctatgtaaacaccgtggctagatgctcttggccagaagagagtggcttcagcctgagtgatttcatccaccaatattacaaacacactgtccttagagtttgaatctattgaataatgtgggaaatcaacccttgaaggcactcagaggagaaaatatttttctagaaaaatatatgattttcttcttaatacatacttcaaatttttatttcatacttattgaaaaaaactcttgcattctcaattagataattttgaataatacattactcatgtaagcatataaaaaggaaaataagagcaaaataaattggctaagcaattgctaaaacaacttttctataaacatcttcgtgatttattactgaagaatcataaagtgcaagtgtttaaagtatacaatttgttcatttttaacatgtgtaaatgcctatgaaaccaacaccacaatcaaggtaacagacatacccatcattgccaaaactttgctcaatgtgatccatacttgcctctatcctttccctaaggaattactgatcagctttctgttagcataccttagttggcatttttgagaatattatataaatgaaattatataataaatcttcttcttcttcttcttcttcttcttcttcttcttcttcttcttcttcttcttcttcttcttcttcctcctcctcctcctcctcctcctcctcttcctcctcctcctcctcctcctcctcctattcctcttctttttttttcggtttctttcactcagcggaatagatttgcaattcatctatgtggttttatgcatcaatagtctgttcctttttatggtttattgttttcattgcataaattaaaatgtgtctatctgttcacctgttgatagacatatgggtcttcttttgggaataaaatacctgctcctccacctctttctgcctgcctgttttactggaaaaattatgagtctctctgatcctcatttttttcttataaaaatatgggtttaatggctattttataggagttttttgagaatcaaccattgagcacattgcttagcacatagtagatactaagtattagcttcttttctaatttgtcatttaattgccttactggtatttattgtaaagtaacaattttcctcctatcaaaatatttccttttctgttcgtcttagtgtctgcctgcttggccattagaatgaatgattctagcctcattgtccaacaaacattggggtggctatacacttgcctccttaaaacatgattcttcttttggattatattcgctcccataactgactagtcacagttttgttcactgtacacagtgctcggagcccgctataggatgtctattaggttagacttggagacaagaatcagacaagaagagggctgtttccagaaaatgagaagatgtgtttgtattgcaaccattctgtttgtaatgaggtgctgtgttcacttgaggaacttttggggagggacatttgaagaggattatggatgaggggctcagctaaagctctaccagtccaccctctggtgctgccacagtttagttctctttgttttcttcctccaaattctattttttctcattgctgctcctttaaagtgtgtccatactaaattttcttgcctaaatcagactccttctattaaaataaatggtgctgatttttttcttcatattctttataaatacgatgtccaactaagctagcaaatctagttcagttggcagatggcagtggatgaaggaattttaatttccccctgtgagtattgtgagtgggggtaggggctctggggtctgttttgctctgacaccaattttactcacttaaatttgtctttattcatagagatttttgttcaccaagaatgggtgctgatggtagcatgtaggggtaaagtgggtaatagaccagtgaagttgtggattaaaaagcatatatcctcaagacagttggtgggcaacaccatttctatataaggaaaactgtatctcattactgttaggagtttgttaatggaattaagaaacacagtctatcgttgtgctacctataaacttctgaagtcctctgttatgtatagtgctatccacatgtaaaggtcccaactgacaaaataacttacaaaggaactacttttttcttcactagtcagagaggtgaagactcttgtttatcaacttttaatatcctaatgattactagggacactccatcaagagttttcatggaaaattgtatgtttagaataacataatacattttatattttatcaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctgtaagtcaaataccccaaatatcccaagttccttgtcatacagaattttgtaaaaggaaaaaaaaaagctaattagtcttgttttatttgttttcctaatgtgcatgagaaaactgtttttgtaatgcattttatcttgcatacttacagtcatgataatatccccagttgcaagagaagagctgggcttaatccagagtgataaagtggatttggagctagactgaagagcacctttgactcattttaagggcctctactatcatgcttcagtgtcataaaaataatgaggttatgctagcatgtggtgtttgtacttccaaatacagtacatcactttgaaaagccagaggctaaaattagctaagaatgaattgagaaaaaaaaaaatctcaaaaaaaaaaatgtgaaaatctcttccttaaaatctcccaataatatacgatactggaaattatgatttgatttggagtgggcttaaaggattgaaatgctgtggctatttaaggtttggagaggaagccattttgtctcgataatgtgtcattaggaagatttgaaataaaatagttagagatgaactctactgccaattgtgtcgctggccctgcacgcatcctgagccactaaacccactgattgcgatgagtctcctctggttaattttcttccataatggtggtaacttgcagctgaggccataggatgttacaaaattatttatgcaatgttagccactcttttggaccccagatctattttgtttctcacagtgagagcaagagggaggagaaataggttagctggggacaggctgagttccagtcaccctgcagaaacatgtgagctattaattgagtgttctgttaatatcataggggcctatgaaatattcagcttcctaactgagttattaaatgagataaacttgctgagtagcatgttaccaattgtatttattccccatttttcactcaaaaaattaacccacagcaatctcaggaacatgagaaatatgtgattttaatcattctttcctcaggtgttgtagacaaatttagcatgaggaagccagtgattatatttggagagtgagaactacatccttagataaagtaactaatgagatatgcatttttctttatttactttctcatttaaaagtattgtctcctgggaggtacaacactgccagcctgactttgcttttaaaccagctaaaatgttcatcaactatgaacttgagacagtggttagagtaaattattggaatctctataatgtattatcagtaagaactgtacctttgaaaaagtttaaaagttaagtatatttaatgatgcctaacatattttattggctgtgtttaacaaaaggcactatgccgcagttgtttttgacaagcatgaaaacatcacagcatgagactgcaaaaggaattatggagagaaattacaagtgatccatctctcaatgaattatccacctcaatagcctgcagaactcagctaccaattaacacctactttattacatgttgggatgtacttaataactttcatgtgtttatgcactattaccttgactgatgcctcttgtacaattaggcataattggcatatcaatatgcaaaagttaaaaggattaaccctcttaaaactaatgagcatttctgtatccagctgctaaatgagacaaaattagcatttttcacttttgggcaggattttatcatgcagtttctcattgttgatattaccttgttacataactttagtttggggggttgtatgctggactgctagagaataagagttttccaaagttaaattagctataattatcccagcttttgtttccgcattcttagcctgggcaatatgtattcctcgataaggaacaaaaataaaagttacttttggttatgtgtgctcagtgcataattatataaaaggggtattttagtgaggatgtgtcatttcaccgagaaaacttggctcagagatactgtattgaaagcttgccatggcactaattttctttctgtctcagttcttttcatctcttttttccatgcacaattttctgactagatactgacagaatgtaaagtattttggcatatttattcaaacaagcctgttaaagttatctgctcaagctaaactaagaacttgatttttcagaagttgggtggtggggtgaggtcaagggggagattttgaatttagaggtgggaagagatgggtactaaaaatgtgggcacatattcaaatgcagtagggtttgttgtaacagaggcacatacatgtagtctgtacagaaaaaaatcaaaagtatttagagatcatacatatgtcatgcatcctacttaatatatatggcatatgcatactacttgttcactagtataacaattatgcaaatccagtatgacttactggactatataataacacaaggatctgatattacattcatcatgacttaattcattacaaaaatgataaaatattctagagtcaaaccaattctgtaattttctcacaaattcataaattcctctcgtaaattttgttcaattaaaatgtttttaatatgactcttaacttagaacacaatacaaaattctcctgtatatgtcgtaaaagctttgattcttagttatcttaaatgaggaatgctatgaaatgccaatataaacatttatccaaccctcagctatgcaaacgtaggtgaatttacttgctaagttagaaattttgataacctaaatgttgcaggaaagcatctcagtaaaacagatatgaatcctccattagtattttattggtgatgtgcatcgttttctttagacatcaaataatcattctaaaatttggttaataaaatcaatgccttttcaaaattcaaagaagttactttttgacgtgggaaatgttggagaggtgggcagtttcgagagggggaagtggtttgcaagaaaatcgcccatctgtaagagagatctggagagctccctttggtggggaaagaacagtctttggtctcagtgatttgttgtcccgtcctgagcaccagagtgagacctcttaaaggtagacagcttatttaccagaatgtgctaaacagaaaatcagacagctgagggccaatagatgggggcaagtgaactgtgcctgtttaagggctaaaaagaccaatgtgcattgcagcaaatagctattgcaaaaggtttaatgtggctttgatgttatttataagagagatgctcctgcctaatacacagtttagaatagatattaatgaggagtttaaatagcccgaatcaggaaactgcagacatatgatttgcaggcaagagtagtttcggcatttaatgctggtgtcttaagcaacaacgtgtatgaatattcaccgtttccatcttgtaaacgccacagaacggcattacttcattcatggccatcatgaacaggaaaatattttttattggtgttcagataaagacttaggtggagccatttttaaacattaacatacaagattccttttacttccattaacagattgtttgttcagtttttaaatatattatcagaaaaaagaggaaacaattttcttttgtttcttacttctgtgattataggatacttgccaaagttgtggctagccaaaaaggcagacataaaaattgctactaaaaatataaaccttctgtttagtagagtttttaagaaatattatgagattgtagggcttgtccatgtttacttcaaatcaagcttatagttaggtttgaggctttgtttgtataaattgtcctgaagtggatcctgatatttaattaaaatgacactaaatcacattgaattgataagacttggcatctcaaacaaaggtaattgcccgtattggttttgtgcaaaaatagcgctgcttggaaaatgtgcagccaacacagactgtcaactccatttatagatcaatatgtgaaaaccattgatcaggcaggcatgtgtaacagtaacactttgcatttatttgttgtttttataccacattaaggcttacaggattataggattcctaaatattttgacttcctcataaatatatgatctgttgcatgttaattaaatgagagtctgcagccatttctaaaattgtttttagtttgatgatttccttttattgctgtggatcgtatgatctgaaaatggattagtttccttctgcataaagattattaaagcttattttaatgtgtcctatttagtgtaagatgtgtctgtatttttgctttgaaaaacatagatacagacaattattttctcgtagcgagtggctgatcttttttcattaactgggcattctcagcgctcagggtagaattatttcctgacatattttgcacaccctgtagataacgggtcttcttgacttccctgatagaatttgttttctttcttttccttttatctagctctgtagtacaggcatctgaccaaacattatgtagaaaataaactgatcatctcaattaaattctagacacacacaaatataatttaaattctatttttctgattcaagaacaagccttatgaactgttcttatacactgcattcttcagttaaatctctcttatctcatcaatgtaaggacagtgttttgttcctaatctttattggactattgtggatgacatttgtaagccattttggtttataaggaaaagctggaggacagtggagtgagactctccaaagatccaggcctctgatatgactacacaataatgtgtcttccactgcaattttctttaccactgggagggcaattttgttgagattttttaatattttctatatacattaggagtgctgctttcaagacagtgctttctatacaatattaaaataataaaagaaacaagattttaaaaacagcaacaaacaaataagcatgaaattcgaaggtttcctaaggtattttgcagacatgctgtagaacagatgaaaaagtttgttagctagaattttgacttttacacaatatgcccctgggagaagaagattcaaaaaccactggagatttctttccttgtccatgccaccctttgccatctcatgctgtgaaaatctttaactctatttaccaagcacaaattggacttgccaaaaggttcagaaagtttatgacgacagtgaagagtccatacttcaaagaaagagctagggctctcacaaccacatatgtggctgcaccgtttccatcttaacctgagcatagctaaatttgtttataatctcctactgatagaacatggtgctgaatgtacatgagatacatttttttaaaagttagtcctctgattactaatttgaatccaaaactctaaccttgttagcatctggacttatttccataataacaaccccttcagaacctacaaagtaatgaataattgacaacaaatgaaatgttttgatagttgtcggcacaaagcatgtttaatgttttgtgttgcttcctagctaattatgtagatgacacatttgtcagaccttgactgccattagaaacgtgtttccagaggggagaaaaacaggctattcatagagtaattagctagaatgctcaatgacctgtgagagattcaaatcgctgccagttcagacattgttttgttacagagcagaggggtaattaaaattccaaattacagtcctatgatggagcatttgtttgttgacagtatactcttactctagtttgttaatttttttttaaattgcttctaatccattttatagctttaggagttccgtctttgaatttgctgacaactaatattatggtaaattgtacttcagctgagtactgcgtgcctcacaatttcaagggaccacaaggttggtgggataaaatagctccttctcaagactgacagatcaggtgctgtcagcgagaatgcctctaacatggaacatcttgtcaaatactgcttccaattctatatgagggggaaatgaactagtggaaaatacaaaggtagagaggaaagcaacaatgaacaactagaacggagcaagaagctgttctcccaataagaaatgattgattaagtgttctgttaccgagtaggagagaagagtgagagctgaggatgatttgggaaatggtgttgagattgtggtgctgagttcaaggcagaagatgcggccgtctgtaggagggctcacctagatcacccaaaggatggcatgtttcacagtaacacctttcatctcaggtcaataacaaaccatggaatgacagatatcattcatgagatgtttcaaggaaatattgggatagtttacaaatctagagggctaaaatagtctaaaaaattcagttccagtggaacatgtatttaggttgctgaaagtgagaatatagttttattaaaaagatctgacagaagtcacacggtgtttgatgcaggcgaactgacagaggcatccagtgagcgctgattatcccgaagtcactgtcagctaggattgattttcactttctccgtttatgtaacggttcctgtaatacagctgaccccgaatcacgttaccttgtcatttctctgcatggatcaagaagagatgagctgaaaatagctagacactgaccttgaacttaccagaaaagtgagaagtgacagtggggtttttctgtagttcatgtacagagacgaaggcacactgttcctctgtcgagttcactgcagcagcacaagggggcagagcagtactagagattacaggtaacacagcttctgcaacagcatggaaagactctgaaatacggagttagagccagaggtctcatttttacatcttagtttagacataaaggagaattactgatgaatcaaaatctcaggtcccctgatgttcataatcagtaatctaaaagtgtaccttctaattaaaaaaggttacctaatacgctgtgtgccagcaactatgcttttccactaaatttttgcagcatctcttatttaattcttataatactcttcactcttaaaataactttggaaccatagtcaatattattaagagaggtttaatttatggcaaactcccaaggtgatatgtgtcactttacatacaattgtatcagcagatgggaatattctttacatatttaccagatgttaacacccaaaaattaaaactggagagtgtttaatggcagtgtgcactcacgaacaggtaaaaggcaagctagaaaatggtgtttaccatttaatttacatttatttatgcctgtatgtcttcccattttaatatctgcctcaattttcaaaaatgtattttaatagatcatcattataaccttgattaacctaaaacacagtatgtcaaatattatcctttgcttgctagcacttagttaagctaaatcattgctgtactgatgctgaatgtttctgataaatggcactttaaaatcttggcaagtgaagcagagaactgaagcaggttgagaaacagaacagcaaacactgactcaattatcccccaggttgtaagtgccttatgtaatggcacggtagcatctttgcttgtgtgatggcacaataacatttttgcaggcctccataataactagactcttccttgtatacagtagattctatgtatgtgtacaggtagtatatgtatatatacacacacatttctttatttatatagatatatagaatatatacatatctatatacagatatatagaaatatatggagagatgtatttgtatataatttatatttggacctatttttatgttccaggagaaaataataacatatatatttacaagctgaaatatcaagattgcctcaaggttcttcttctgtaaatataactcaggacaagctgacaataagatcagagaaacaagtagacttccaatatgtttcaaggacagaataaataagagatcattctattgccaagaatgtggcagaaaatattcagaatatctgtgtcatcacagaaatctatagtacctagtttttgccctttggcagaagaaaagcacaagtcctctgacttagaaagatttgctatttggaggaggcgatataagtgggggcggcggtgtgtttatagctataaaatttgtgtgtctaaaaatgacaccttcgaaggcaagcctgaggaacagatgcattccttgagaatcacacaattactttgcctttctgctcctcagagagtgcaggagacctcttgcatggcctctcctaggtggaaggaaacccatccctaaacggttgattagcctctgcttcggaggtcaaggcagacataaaggtgttgtctgctaatacacttccccagagttttattttttgtttcattctttttctttccactgccttcagtgtgcaaggcttttaataagggacttcagtccctgatgtgttcagattcggtttattgttaccatctgtttaattatcctctcaggtttgtgttaggaagcattaaagtattttatccagcctttgaatccccatgttcctaaagagatgtgggtaaagtacgtgtcagttttcaaagagcatattaaaaactgataagcagaaccatctccaaacaataacatgtaaggcaaatacattttttttacattaatgcatgttacaactaattagcaaatgtacagcaatgtggcaatctcacggaaatgatgccatcttctctatatgaaatctcatatgcttctcctttgaggtgatggatttttatgattcctattcacttccaatgcactgacaataggtttattgggggaagagatatggaatttgatttgcaataggacatatagttgtcatatgtcaagcagatttatggatgtgctgaagttaaagataaatcacatacccagagaaaaaggacagaatgtttggggaaaaatgaaaaaacccaggggaaattcagttacttgatttttttctcctcttcctcttgaatttcctcctcattattattattagatttcatgtcatcattattattactacattgcatgcttttttttttctggagaaaaagcagcatgttgcttccagtaagcactatagtcactgttatatctggtgcagttttccatgtgcaaaaaccattgataacaaaaattacatgggctgacacagacgtgttatcagtttatgtccaaattattttatatatcactattttagtgaaatttttggaaattataaaacaaaattaagtataaatgtgtaagtatcaaaatgttttagatgtcagaaaccctgaaaatcaaacggaaataaatcatgcttttacttcctaaatcaaggaagccaaatgattaatcattattcttttttatgtatcccttacgaggtgatttcaataaactttttttctgagattccaagatgttattagatttaaaatgtatttgaaagtgttgagaaatggtagttttgttttgtgtaagtacctttccacagtaccataaacataaatgaccaaagtactgatctctttttattcctttgtgaagaaaccagtgctgttcttgccttatgctcttacattatctctgtgaaggaagaatagtgatgacaccaactttcctccactacttttggacactaaacctgctttctttcccacagggtaaaataaagctgctgtcttcatatttccaatgagaagggacatgtgtctccttgcattgaattgtcttagatcatatcatgtagcacaaagtgacccaatataggaagacaggaaaacaaagtgacagttttgtttgctctaatgtaaacgccaacatcaaaacatggggcaaatcctagaggcccactgccagaacacacaaattaaatagcaagagctgatattctgtacttaaaaaaatgtattcaagggatattctgtaatcagcagtgaaaggttaatgaacaaataagcttagctcaggttagacaaactgagtgtaactaccactgtttttaaagccatgagaaagtgaatctggctgatacttgataatacatcacacactgtggtcttacctattgattacaggctgacaatgggtaacctttcatggcaacttcctcttttaccatgaattattgacagtattaatgccaataacacatcatcaaataggaaagaaatttacattcctggatgtactatccttaacctccatgcctttaacgtcaagaaagaaaagaaaagaagaaagaaagaaagagagaaagaaagaaagaaagaaagaaagaaagaaagaaagaaagaaggaaggaaggaaaaaaagaaagaaaacaaaggaagaaaaagaaagaaagaaagaaagaaaaaaaatatcttctttcttgtcttgaaaatgctaatgaattacctttgacttttagacaggttattcatgtgacatcccgattattctcatccacaacacaatctgggtaacacagccctacatttaagggaatcttgctgttgttattttcaccctagtgtcctctaatagtttatagatcctaggaaattttactctagtggtgtgtcctaaggtctctgcattaataattcctgctcgttgagtggtcaccatctcaatcctgcccctgtgtgtgtccctctaagagtccccaaagtgggaaataggagaacacgtttcatctattcatttcatctatttatttatttatttgtacatttttattggcactaacagtatgtcagagactcctttgaaggctggggacataaaccaaaaagtttctctgtcctctaggaggttacattcaagtgaggtagaatctttacctggaatagcccagactctgctgttagctacctagacatcctcattgccactgccaccaccacctcttcaaactagtattagtgtcaagtacgttgcattttaccacaaatactttacactatgcttaaaaatggcctgtaaaaaagagacgttcacctcctgtaggatgaatttctgtgtgttgtatatctcaaatgacaagctttgattttttaaaacttcaaattataagaattccacctgattttaacctactttaaactcccttgcgcactttgacctatttcctatgtcttgtgtttggtgtacccaagctattgaagtactttctttggtaacaagtcaagctgctagtattcttatctggttagatttataatgcctcttttattcatcattctttctttttccttcttccttagtcttttttgaatttatgataaacttttcactgatgttgaaataataatttttatgaatacgaatgaaagtgttaatatatttgatgtctataactatttttgtttcaacacgaaaactgaacacagacataatttaaacttctacagagcattcaaaattttcaagttcttgacttaaaaattttactttgatctttgctactagggtctgactgagcattgtccttcaagtagccataatttatggggttgattgtggtttgtacatgatctaattataacttgccaaagcagtttttatcattagtgttattcttatctattctttattcttatcatgccattgtagcctttaaagtacttgctggccattttactaacgtgcaccccatcaaagcaaaggtaattacattaaccaggagacaaaataggctctactgagacctcacaattccttatttttcttacatatggataatgggacagcagtcttgctatgagaatggcccaggaaacccagattggattcagtatgcatttaagaccatggtttctcactttttgactgttaacctgagcttgccaccactcatgctgccctttctaactctgagccccctatctcccatctgactgctttgatgaaaccttgttccccaaggtcaccaacatgtacctagaaccctggttgctttttttcacctatgcttcagaggcctgtttcagacttttcctcatcaaaaacaatgacaacttcatgtttagtattcacactctagggtgaaaatgatgggtctaaacaggggttaccatcaagtggtggctccacccaggcaatatgaccagaggtactttttatttggttggaatggtgtttttaatagtttgaatttgaaagcctttcattagagttgtggtgttttcctgcaggttgcattacctgcttggccctaaggacatttgacttggtattcttaaagctgttctattgactggctgttcacagatgaggacataatgtggtaagtcagaaaataacaactgttggtcataaatttgaaaacttagaagttgacagccataaagcataaacttagaagtgtagtctttatcacatttcactggtagtgaaagtagcttatattacatagctaaacaggaattttgttattcagattttctcatttggacttaatttcaattatttatgtatttattattttagagacaggttctggctgtgttgcttgggctggagggtagtggtgcagtggcatgtttgtagctcactgcagccttgaactcctgggtgcaagtgcaagcaatcctcctgtttcagcctccccagtagctaggactacaggtgcacaccatcaatcctggctgtttttcaagtttttttgtagaaacggggtcttgctgtgttgctcagggtagtctagaactcccagcctcaagcaatcctcccaccttggccttccaaagtgctgggattacaggcctcagccaccatgactggtcctaatttcaattttagtctcttaaattattataaattaagaaacatcttgctgcctttcaagtaacactaaaaagtaaccatggttttctgtggaaaaggtgttctcttgtcatcaagttttaaatactctgtttattctgggttatctaagatttaactttaatcattctgaaaacttgaagagacgctactttgtatttaagtgaagccgtgcacttgtaaatcttatcataaagaatcacacaaggcccttacaatattatacaaaatttaaatcaacttcgatttaactagtcatctaattatcatcatttactttacattctcactaattaatttggagacttttaaactttgttagaatttttatttccttttccattgacatgtaacatccattaagaaatgaaacaacataaaatgaactctacaaacagtctccactcacttcttcatagccaaaatgtcttttttgggagcatctctgctttaccaaatagaagccttaatggatagagaagcaggttcacatgaggaagataatgctacatggccaagggcctctttagaatttctcgacttgcaactggcatgttgaattccacctaaagatgtattttattttgcctagacagtgctttctcctctttgctttctaattgagctgacatattgacattctgagatttcacatgaaaatttgtatttgtgacatgtctcaaaaaatcagaaattctggcatctggggctggttccccaagaagcaggcaataactagctgaagctaagtatctcttgcctcctctagatggggcaaattctccctagttcaaaacagtccagccaggcccccttcatggggtgtttttacctatctggcatttgagttggtgatgctggctttagcatatctattccaactttatttgtatgtcccctgaggaccataagaaactgagttgtcatgcagataactgcaaaactcctgtctcctttcagtataacttttccgagttgcctcctaggtaggaagaagcttttgaaataggagaaaatagttatttcatgtattcaggtggttatttgcataaatgaaactttggaacacattatcctttgctgattcccaaagacactaatgcccctgggacacacccagggcactgatttgaattgccaatgacaaatcaaagtgtcagtcatgggtagatatggaaagcatttgtgggccctccaggttcaatcagaactgtcagtggccctccaggttcaatcagaactgaagtgggccctccaggttcaatcagaactatcagtggccagtgtcgtagaggtagtaatgcttttgtttgttagttatgagcatgatacaggttcaataatctgaccagtaacattgcactctagccaggattagaaatatttttaggaagtcaaagccagatgtaaattatcccctcaagtaaatcttcatgatgcagattctataaaaattgtagaaaattgctattatcattatgccacctgtttgtataaagtccttttgtcaggcctggctctgtaccttcgagctgctctgtgtgcctcactctgccatttgaccatcacttttcagcaaatgagcttccaacacccacctacattctgaaccattatattttaaaccaccctgaactcttattcaacctgttcttgattgattgcagcttctgattcttagggaaaatcacctctgcgttttattattcttcctgtaacaatgtctgctgacttccatcctcagctacaattcacagtgagctcttacattacaataatacaaatgtttaccatgtggggacatctatatgtactcggcattatgctaagtgctataacttgatgagagactactttgtatttaagtgaagcagtgcacctgtaaagaagatttggttaatcccacaccactgccaccaacaaatacatgattggactgagatgtgactttaaagatacctgataccaaccaaaactcaagctttcgacatgctggggcacactctgtgttactgaccctaagccctgaaactctccctactgcatgcatttgtggatacattctgccatgttcaatgtggctaagagaatgagtgggaatcagatgtgtattctccgttatgcctattaaaattctattcaacttcagagagccaactaaaactcaaccccctgcctagttttctctgactgacctttctctcatctgaactcctataataattattcctttgattgattctgtaattgttcaccttgcacaactttagtgcatttctttctgctttattttaaaaacttatttatcctcattattattagtcagcattttatgtgttcatattatagatcccctgttacaatgaagactccgtgaagtcagacactttctctaacctcaacagaaccttgatgaaaataagcatttaatttttttcaacctaaggtactttaaaaggtttagaatattaggtggctagtaacatctaataatattctaatttctggagaaaacattcctgaagacacagagagggcaaaaacacaagaatagcaacaacaaaaaaatagaatttagagatacctcatagtcataaagctaaaggagctgaattaaagaagaaaaataatagttcagctatgcttcacctcatgaacatggagtgacctcaggatatcactattgtattcattgaggctgaaattggcagcttatcttttctactgcctgccttgtggttcagagtttatgatgtgcaaacccaccaaatactaggcaagcatccctgtgctacacaggtgttgttttctaaaatagccagaattctgttgctcttcgtctttgctcctctttctatatccatttagagactggaagtcacaggaaacaacacggcaggaagagtgggggactggcagtaaaataaggcatcctggagagtatagtaaccacaattatattgctaaagatggagctggagttacagaaagcaccagtagaaaggcaggctggggatttaattttttatgtatactaactacacccttacatcgacaaccaggctgggaaagttggagatgattccacctgtgtctagcaaaactatgctagtagtcttgttgatgaaaaatttgataaagaataatgcttatcaaactgcctcaagctgtacctaaccctaagaaaggaatccgtccacccctatgaataatgaattcagtccaggaatggtcacatgaccttctgtaaccattaaaggttccatttggctctatgtagcagaaaagtggacatagtgatttaaataaataaatctgtagtgggtttttttctctttttctttttaaatgtttgtataacaataattcagagcagttgctgtgcttggctaaacacattatcaaagacacaggtttatcatttttctccactcaccatctttagaatgtagttttttttttcctattgcctctcttctcatggccagcagatggctgctttatccttagcatttcagctacattccaggcaggaaagaagacaagcattaagggaagaaggcatgtgcaagatgaacctgctctcttttaaatagcttccatggaaagcccattcagcaatctctacttacatctcgttgttcaaaagggtatcaaatgttcacgtttagcttcaaggaagactgggagatgtgatttttaatcaggacacttcgctgctgcaaacaaaataacactggatagagattaaggctaatataagatcagagtgaattaagagtgaggtgagagtagggacactcctcagatcacacagggctttgcagtcgactacaaggagtttagattttattatttgatgcacaatcagaggccacgaaaggattttaagcacataagtctctctgttgggtaaagcataggttaggagaggaagagagaaaatggggacactattaaggagcctgtccatcctattctctattcaataaatcgtggtggcttgtgctagattggttgagtgggtatagatggaacaaaacaattaaaggacattgtcaatatagaactgaaaagagttgcagaggggttcgatgtaggtagaaagaaagtaggagtcttctgagagtcaagatggagaaactgggtggatgatagtgccaatcactgagacaggaagaaccaaatatcacagggatctggtgaggtgagatgtcaagtgggtcatattcggttgtgagaagcttgagatttcagtgcacaccgaagtgaaagtgtcatagggacaatcaattacgtgagtttggagctcagagaatagatatgccttggagatataattttgatgtcaacaaccaacagatggtatttaatgctacagaaatagccaagatcccattgagacaaagcgtagaaatataagagggctcgaacctttaaggagcctacaaagaagttaaaagactgattggaaaagggggagtgaaccagacgatgtcagttgacatccatgaatttcaataaagaaggggtgcccaagaagactcaaataaaaaatatatatacatacacacaaacacttaggtaactatggattcagtttctttgaagacaaaaatacttcaaaggaattgaaaatgagtcaaaactagtagatgtaaatattggtatatatgacctaaaaatattttaaaaaacccgagatgtttgtttcatgtacaagtattttggatataatttataatcatatacaaatatgcacagttatacaagtagtatttataattatatatttaaatgtatgttttgataaaaactaagcaattttagagattgttatatattgtaaatgttttttcgtctcctataaaagaaaaactgaaaatttattttgtacttttaactttcccataaacatatcaatcctggttcaagggagggaatatctcattgcaacatcagaaaggataggaaaatgtctggaaaatgataactggcttcaacatgcaaaataaatgttcaaagatagaatcaaagggcaaacatcaaggtaaatataaagaagctacacacagataataaagataatccacaaaacttaaaaaaaacctctaattttatctggagtaaattgagtggatattttgaactttatttttcatttacagtttgccccaggataaaatgataagctctattaatcagaaaaggttaatggcatattatatctttggtagattgataacagtctctggaccaagttgtttgtaacttctgttcaagagtacaatagtacctcagcagcaaatcacatgaaaatgtcaaccgtatgttagattttacccacttaaagaaaaaaatcccacaagaaacgttataggataatggaatgtgcaaaattaatcgcttttcaaggggtcgttccgagttttattctccttggttgaattccctccccaatttgcccctcagatatgcattctcttattgaacgatgtgattgtggcgactgtactggtgcccactttgagtcaacgtcgcatttatcaaacagttccctctcacccaaatattcccagtgtagtcactgctagcaatcctcctttatttgtactctccgtttgtacctggtggattatatattatattaattcataataccagctctgccaggctccctacagttacaattattaaagctgtaactgaaacgttatctctcatattgatcttcaaccagaagttcttgtcccgaagcttttgtttcacattaagacactaatgatcaccttcaccaaatgagcagcttaatagtcacaaaaagctaaatgaaaagactttgatcaccacctttgagagcactgtgttccaacatctctcccatccataattggcaaacactaactgagcttttaattttttttaaaaaaagaaacatacaaaatactctaaagaaacttattttttcagaaaaattttctccttttttgttgtgtttgccaagtatgcttagccctacctattctatttgttttccaggtcatataaagcatctgtgtgcctataggttatttctttatatgtgatttttaacaatttattcattttcttttcataagaactgagatgagttatgaattcagttgaagtgatagaaattatgcagcacttttgagtgcctatttgatttacttgttaaaagaattggtacagattaatcagtatggtctcccccatatctggagggacaatggagctactcaatggttctttcatattcacatttcctcctggaaaaagtagaataatgactctataatgaagtctttatacaaacacaatgtatcccgaaaaaatattaacaatatttttgtaattgatcaaatgggaagaaaattctctttgggtattaattagacatatcaacgttattcactccactgctaaaaaagtaacaacactacagagactttttatatccaagttttaaatcaactttatattgtagactattaattttcccaatgaacctgcagatgcataatctgaaagtggacactctgtagtggtggactatgcatacatagaaagaaaaccacagagggttaaaaaatagcaagcctgagtttttatgggtcattagctctttaatgcacctcaagggctcctaaaccaatgaactgagagtcttgggaagactctagcctgacccgagtgaaagaaatgaggaagagcacaagtattagcagtgctcgatgctattaaaatattaaccaaagactaatttgaaaatgtattaaccacatagtaagttaaggcccatcacagatcaaatgctaagttttgggacaggaagaaattggcgtaagtaactggcaaatattcagggtggaaagattggaagggagaaaagctatcatggaaaatgacctgatagccttttgaggccttgtggttgtcagagatccctgtgataatgatctgcatccattggtgcttcttccctgaggaggcaaatgcctgaaaaacagaagctccaatatttctatgggtgtggagcaggtatccgcatagcacagtgaagaaaagtagtggggatactcaccactctcattctcagccacagatcttggggtgactaacgctctctgaagtcatcttcagaagccactataactcttttaaagttgcttccttgaacttagaaatgggtgcaatattttgggggaggcctctctaactgctgcaaaccaccaatatctctaaggctattaatgatgatcatcttgaaaacccaacctagtagcagatgtggtttcaatggaaaaagaaagagtcaaatccatgtcagagaatcagaagagacagtggatgttgtctatttgagtaatataaaaaataaagtgatataattgaatagtataatatacataatacttgaaagaaattagtatgttatacattgaaaataaaatacgtatgtctgtctagagactatttttttaaagacggacagatttcaagggaatcattccacggttatgcttgaacacaaatgagttactatatcttcaaagattccttcagatcaacaattggtcatgtgaggaagagagatgacttaattcccttaagcaaaatacttcaggaggcttttgtcacatggttctaaggatttacaaaaattatttaatattgatggaaaatattaaatgagcaattatataagaaaacttttatattattcacctatatcaatgaaacattttactcagttttagttgcagttttcaaaaacaattgagaaaagtatttaataagaaaataaatctaactactttgttaatttaggttatttgcatcatgttattaaaaaagtggaattgatattcatatgcagaagacatgctatgaataaattaataattatatatcctaaataagcttgagttttgggcagctagttaaattattacatgatagcagaggatgtatcttctttcttttgtcttctctgtcatttaatattaagtagtaaaaaaaaactagtaaataagactaagaataatcatgtactgctcaggtcttttttggttgtaaacgtagaaaccccatttgaactagtttagaaaagaaaaaagagtatttgcttttataacacatattcatgatctactgataaaccatccccaactgtgtatttaacttacaaatctgcagtttgggcaggattcacaaggcaaggctcatctcattggctggggcagctccacttaggcctgaaagatttactttgaagacagttctctcacatgattgaaagctaatgctattgtttcctgaaagctcagctggggccgagggttgcagattggagggggctctctttccttccacatgggcctttccatggcctccttcagcttccttatggcatagggactacgttccaggagccagtgttccaagaggaccagaaagaagttgtataaccctttatgtacaagttttggaagtcttaaggagtcactttcttggcagttacagccctgccatatctaagggaaaggaacatagattctcacagtgaggagtattgtgaatgacttggaaaataaaatatgcgacataactgaaatttagatatgctcttttctctatctgtgcacctttgcctctcttttatatgctgtcttctttttcctctgttaagacagtctttctccattaagtgggtaagatgagagccggctgttcacatgcttagagtactctgtcgtagaattaaaaggaattcttctccatcagcttgagggggaataagggcttaaaaggcaaagttagaatttggacagtactcgtcagaaacataattaggaaaaatagtccccactctcaccaagtatgggttacattcaggtcagacaacataaagaacatccactaaaagttttgacaacagaaaagggtcttttgcattttgctgcctacctttcactttcgattgcatactcatttgtttattcactcaagtatctgtacttacactctctgacagggagtgttctacatcagtgattctcaaagggtgatctagggatcccttggggttcctcatcctttcagggggtccaagaggtcaaatctattttcataataattctaacatatgatttgcttttttcactctgatttttataagggtgtacagtgaagccttccagagcctacatgacatgtatcacaatagtgaagagatttcctgctgtcttctcttaagccagacattaaagacatttgcaaaaacacaaaccattgcctctcttgtcactgaatttttctttattttagaaaatagttattttattaaaaatatgctatttgtgttaataagcaatgcatttatttactgtatctacttaatatgtgttattaaaattactcaaatttagtttctaacaagctaaatgttgatagttgtaacccacattaacaaggtctttaaggaattaaaaaaatttttaagaatataatgtcctgtgaaaaatgtttgagaacctgtgtgtaacttgaaatgtgatatccaacaaagcaaacgaagcctctgctttctgagtacagaagagatgccagcctacttcaaggaggattacaagatttattatgccgcaccataattatctatcaatggtcaaggtcctccacaaaactctaagtttctagagggcagagactatatattattttcagaaaaaacttcaaaaattatagttattttttcaatgagaaatacaaaagtattcaattttaggcattcatgaactccattgaaggatgaaatttttcttattaatttacttctaaggtggcaataaaaattgagaagttatcagttttaaagaactcattaaaatctaaggcttatcagaaattgatattggctaaatagtatctaaagtgacatataaatgttcatgatgtctgtattgaagaattcacgctaaataaaatggtattatgttaagtgcattttactgatttggggttgttataaacctacaaacaaaatgttggctatttttcttcttttaatttttaaattttttattactattattttttgtagagatgtgtctcgctgtgttgccctggctggtctcaaacacctggcctcaagcaatcctcccgcctcagcctcccatagcactgggattataggcataagccactgcgtcaggcccatttttctgatcttgtgttaattttcctgctactgagcatacatagtacatgcttcatacattttgagtttgattgttttagattagatgcagattgtaatatagaaatgcaatatagaattgcttgagcaccgcttttcatcgccagtctggaatcaccaatttattttctttggctatgattttggagtctttagaaagcaacactaaaatcctagaggtaaagccttaggctcatttagaatgagaaatgctcatttgctgccatgctaaggtgcatgcaattatccagggtacctggcaattaacacccttctctagtgcagtgattacctaatttggctaagaatcattagagggctttttaaaaatacagattcctgcacctaacctagaccttacaaatcagaatccagcttctactatttactgagtgtcaaatgtttgatatctcaaagctaaacaaacaaacaaaatctaggaagagtccctatatttgcctgtctctgttttgaaactcagcctatgaaacaaagagcactatatcatagaagtcatcttgcattcaaaagctacaaatatccaccttatatcctgcctataagtctccaacttcctcttatgtcttaagaaaagtctagacatagctcaactgtgtctaagcaaatctgtgcaagcaaacttcagatatattgcaggtttggttccagactaccaaaataaacaaatattgcaataaagcaagtcatacaaaaattttgatttcacagagcaaataaaagttatgtttatactattctatagtctattaagagagcaatatcattttgtataaaaaacaatatgagccaagcgtgatggctcatgtctgtaatcccaacactttgggagactgaagcaggaggatcacttgagccttgggattcaagaccaaccttgcccatgcagtgagaccctgtctctacaaaaaattaaaaacaaaattaatcgggcgtgcttttccatgcctgtagtcccacctacttgggaggctgaggtgggaagattgcttgagccctgaaggtggaggttgcagtaagccatgattgcaccactgcgctccagcctgggagataaagtgagacattgtctcaaaaaaaaaaaatgcataccttaatttaaagaaatattattgctaaaaaatgctaacaatcatctgagccttcaaagagtcatatcctttttgctggtggaaggtcttgccttgatgttgatggctgctgactgatcagggtggtgatttctgaagggcaaagtggctgtggcaatgttttgaaataagtccacagtgaagtttaccacattggttgcctctttcttttgtgaaagatttctctgtagcatgtgttgctgtttgacagcattttacctacagtagaatttctttcaaaattggaggcaatcctttcaaactctgctgctgttttataaactgagtttatggaatattccaaattttgtcgttccagcgacattcacggcctcttcactggggtacattccatctcaagtacattctttgctcatctgtaagaagcaccttctcattaaaattttatcatgagattgcagcaatttagttacatcctcaggctccacttcttattctagttgtcctgttatttttaccacatctacagttacattctgcattgaagtcctgaacccctcaaagtcattcataaggattggaatacacttctttcaaactcacattaatgttgatattttgaccttctctcatgaatcatgaatgttcttagtgacatctagaatggtaaatcctttttagaaggttttcaaattacttcgtccagatccatcagcggaatcactgcctatgcagctatagtcttattaaatatatttcttttttttattatttttttgagacggagtctcactctgttgcccaggctggatggagtacagtggcgtgatctcggctaactgcaagctctgcctcccgggttcactgcattgtcctgcctcagcctcccgagtagctgggactacaggcgcccaccaacacgccaggctaattttttgtatttttagtagagacggggtttcaccgtgttagccagaatggtctcgatctcctgacctcgtgatccgtcgcctcggcctcccaaagtgctgggattacaggtgtgagccactgtacccggccttaaatatatttcttaaataacaaaactctaaagccaaatttactacttgatccatgagctgcagaatggatgttagcaagcatgagaacaacattattgtccttgtacatctccatcagagctcttgagtgactagctgcattgtcaatgaatagtaatattttgaaaggaatctttttttttgagcagtaggtctcaacaatgggcttaaaatattcagttaagtcatgctgtaaactgatgtgctgtcatccaggctttgttgttccatttataaaatacaggcaaagtatatttagtatcatttttaagggccctaatatttttggaagggcaaatgagcactggcttcaacttaaagacactgataactagagaatcagcctgtcctttgaagctttgaaaccaggcattgacttttcctcttgagctatggaaatcctagatgacatatttcatataaaggtatttcatctacattgaaaatgtgttgtttagtgtagctagcttcatcaataattttagctggatcttctagataacttgctgcagcttctacaacagcactttcagcttcaccttgtacttttatgttatggagatgacatctgtccttaaacctcatgaactaacctctgctgccttcagacttttcttctgcagtttttccacctctctcagccttcaaggaattgaagagggttagggccttgccctcaattaggtgttagctcttaagggaaagttgtggctgctttgatcttctatccagaccactcaaactttcttcatagcaacaagaagtttgttttactttcttatcattcctgtgttcactgtaggggcacttttaatttccttcaataacttttcctttgcattcacaacttgactggcacataaagcctagatttcagcttaacttggtttttgacatgctttcctcactaaacttaataatttctagcttttgattttttttttttttgagacagaatctccctctgttgccctggctgggtgcagtggtgtgatcttggctcactgaaacccctgcctcccgggttcaagtgattctccagcctcagtctcctgtctcagatactcccagatacagagtatctgggattacaggtactcagcaccatgcccacctaatttttgtattttagtagcaatggggttttgccatgttggccaggctggtctcaaactcctgaccttgggtgatctgcccacctcggtctcccaaattgctggaattaagtgagagatatgcaactcttcttttcacttaagcacttacaggccattgtagggttattcattggcctaattttaatactgtggtatctcagagaatagggaggcagaggagagggaaagagacaggggaactgccagttggtggggcagtcagaacacacacaatgaagcttaataaggtgaagcacaataaaatgaagtatgtctgtacttatattttccttctccacaaaacatttccctaaggggtgtgcatgtgtgaaagatgggtggtggggaggaaaagaggagagagaatattgagttattgcaggatcaactttgctccatgaactttgtaggggcttttacttacttacccttgctgccgttcaccagcaaatctcagtttctagaaggttgagaattaatacagttttgaggactggccctagtaaggcaaatgtttgagggtgaaagaaactcagagacatttgaggcaatcacgtgcaacagctggactaggtgcctggcagtagaaagctcacaaggacttaggtgagatggcgttatgtaataagagatctgactgtatgtaacagggcacctactaagtagcagggatactaacaacataacctaccaggaaagagaatgagcaggacctcaggggagaaagcccttcaagcagcagagtggttcagggtaaatattcctcatcactggaaggatcaggagaccaaaggccagctgccaggaatagaagattaaacttaacagattaagccagtactagaagcaggtaaaggagagagggaagggctacaagaatgcttacattagacctagcacttcggcctaactggcagcaaagattcaaagtgggatactcactgactttgagacttgagaggctcactgaatatgtattctctcaagatagtagaagagaagggcctgactgtattctggcttctgttaactggttctgtagctaaactaagcctgttagaagagctggtcttcagataagcaacagtaggagaaagtcagcttggctgtgaggtgttgtcaggtattgtaatttattcataacaaatacactgatttttcatgaccaatgactaattagcatcagcctaaagaggtctgtattgttgaaattatagagacttaaggtgtctttcagatgtaagccatgttttttctgggtagtgggaacaacaatcaatcaggaaagtgaaaacagcatcagtgggcaccatcagaggctacaattttttttgtactgattcaaacatatcttttaaaaatgattaagtatataaaagtatctaaaaaggataagataagaaatacgagctcacaaagggggaataaaagtgtagaacagccgaaagggtccctcagtttcaggccgagtgtgagaataggacactctaaaacactttaaaaatctctaaatacccagagatttctttgttttggattgtatttttcttttcttttttttttttttaaagctaaagatgaaatgctgtcatattacaattttgtttactggaagcaaaattgaccaaaagaaactgtccttaaactgaagtttaaagttggaacctcatgaaaagacagtctttataaatgatcaagttggcatgtcagggtaaaagacaggaatgtaagattaggcaaaccagaattttctctgctgtgattgcccttgctcttgagagctcgttctttctctttgactattagcccatggcagttgactcaactagggaggtcagcttctcagccgcccaagtcccaggaagaaaagacagaaacacgtaacctgaaatgacacagccgctgatgcagcttgttgctctgcttgcttatattttgaagtatatcatgtaagctgaattgcaaagaatagcattcgacagggtgaagggttgcatacactgaagaaaaggcaagattcttggtgaggcaaaagtctgaaggacaagtgcctttagcatcaactgaaagtcttactgtataatatgacctcaacaaaattggacagtgctgcatagtcaagaaagggatagcaaactgaaagaactgatttagtggtattgccatctagctagcttacttaggaattatttctgatgactttaatttcaataaggcaggactaattcctttatccacatttccatctatatctttgttggatgtttggggatggaagagtccaatagtaaaagggaagtagattcttatgtggcctcaaggaaacattgtgtattagtatgggactggataactagttatctaatatctagttactttatatatttgagcataaatttaacaattaatgatactgatttaagagactgattttgtcaatcaaatgacattttggaggtaggtaaaaaaaaaaactaaaaataatcccgcctagctaatacagtccttttcttgctgttgttgttgttttaagacaagttcttattctgttgcccagactggagtacagtggcgtgtttatagctcaccacagccttgaactcctgggctcaaacactcctcttgccttgaggtaggcaggactacaggtacaccacgatgcccagcttttttttcttttttctttttttttttgtagagacaaagtctcactatgtggctcagactggtctcacacatctgacctcaatcaatcttccctcgttggtttcccaaagtgttgggaatacaggctcagccaacacagtatttaacacagtattttgcctacagaaattactcaagaaatactcgtttaaactgtagctcaatttcctcattttccaaatgaatgtaataatttcctctatataatatagtgctctgctttcacaaaatgagtttaatatatgtaaaacaattttgaaaaatgaaatgaaacatttttattaatacgttccgattgagtttaatatttatcccatgcctgctatgtaccaagtgctctgctcatctgtttactagaatggtgtggatatggtctctacttaaaagaaaaataatctttttctctttaatttacttcgtccctattgaagttttcattgtcccattgatttaaactattgacacatagattgaagcttgtatactttgaacttatcttgtatttttctttgcttcaaacttttggttctctgattggtttttaatctctgattgtgctgggaccaggtcataatcacatggaagtttccttcaaactgcagtctcctctaagattctgcaatatcccctaggagtgctaccccaatcctataattactgcaatatgagtggctgtcatttccagatgtgtttccttcaggtgtgtttgagggtggtcaaaataatagagatcctcattcccgatagatccttgtttcatggttagaatgcacttcaccttcatcatgtactatggtatcaatcattaactgctatcataggaaatctatttattctttgccagcaccattagaaagacttcataaaccaggtaaaagtgctttctcttaagcagaaattttaaatgatgttttgtagcataaagtgacaatatatatatttaaaaattttctaacccccaaattcattagtttcaccaagtgcttccagcctccatcttagtccttttcttctttaactttagaccccaaattaacttctccagagctccctacaacgtatcttgtttcttgagggggaaaaataaacccccaccaaattcctgtaaaggatacttaataaatagtcattacattccttcaataactttaccattaagcttctgttgagtttgtggctaacatttcaaaaataatctcaactttttcttcttattgctgctgagttgggtgtgtctttcattgtggctagatgagggacataaaattagtggtaaagccacaaataaccagagaaatttgataatatgaaataggaatacaatcatattttctttgtttatgaataaaatttaggaatctctatttaaataatctcgacttatgaagagcaaaaatgtttgccttttgcactatgaaaattttactttaaaggttattctgttaaagttttctgttttaaagtttagctatacagtttttgttttaagagtttataattcttgttcttggggggaaaagagttagtattacaaaattcgtttatattaaacatgtcctttttgcatgtgaccaaaatcattggttcctaggtatgttttgcacctgttcatgtcctgtgattttagttctccattcctcatctttgaattgccactgatttcaaatccctgtctccaaaacaatataatgaccattctctgttagtctatcttcaaaacattcccacttggtcctatattttatcagccttcacatttccctgaaaatatcccctaaatgaaccacagaggattctgtgctaaatgcccaggaccacaatttgggaatcattactctatgtgactgatttctcccgaaacaaacactttgatcatttaaaaatgatggctcttgctgagagtactaatgagcaaattcgtgctttgtggtttatacacaatggaggattaaaaatgggttcagaattggactccctctttagtcttccaaggggaacattagtgagagagttatttttaaaaaattaatcctattttggcagcttcccttgatttgaatatgaaatggtgttaagtaggtgaccagtgaaatgactttctcttttctttgtagatgtctgtaaacagtggaaatacgaaaatgtttctgtggactttctagatccaaggatctagtggcccctcacccgctaataacagccaagagattattttgcagctcctttcacttagtgtctagaaagataaacatagagttagataatagcatgaatttttttttctgatatggtgcgaaagcaaatgtaagcatttcactagttgactatttcttggggaagactcatttgtctgtgtaaaatgccttcaaagaccaagaggaagccaaggccacagggaattagagaagggctagagtccccacattcctttgccttctcctttaaccccgactatgtttacagcccttagaaagtgcattagggagtgagtcttcaatctgaagccttaagagcagaagggtatggcctctactttaaaaaggtattgtttggataaagaatgcaggggttccttcgatgataatactagctaacatcattgagcacttatttcacactgcccttgaagtcacttcagaagtattaatccatttgatcactccacaactctaggaaataggagctattattgcctccatcttgtagatgaggagactgagacacagagacgttaaacgaattgccctaagccacaaagatgagaggtgcatgcagtctttgaatctactagttgctaccattgtaattttgcgaaaattattctctgctgaatcatacttataattctttttgtattccacttatattgaaggatctgataaggaagtgggacttttcatgatgtaaattgatgggtgagagctctcatttatccaattaggtgggagaatagcctggtccctttctctttctttcaaccttttgaagaaaaagtttctttttaaaatgatacattacattgtaatcaatatttatgtttattaaagttatacatgaagttaagactttagtctagaaaacttttgattcaacatagcatttctctgacttctctacctgtctattcatcagttccccttcctagaggcaactgccttcaacagctttgtttttttgttgtttcttttttgtattaaccttcttttctttttaaatattacgcatatactgttttccctgatttatctgttctaggcattatgcactttccgttactatagtttaatatctcatttacacctcacagcttcttcccttccctctattgtttcatcatagtttttcacaatttttagttcaattactaattgacattattattttctaaatttttccaactatgtcaataattatataaacataaatttctttgtattcaattttcttggatggagtaaatgattgcctaaattttaattttacttatattttatcataactatagctatttttccaaaaatatcaacaaaattgccaaatatctatcttttggccaaacactgaattattaaataatgtagtgcctccttttaaaaaatttcctcccattgttctccatctgcttgcttaacacatcttgaactaaaggctctattggcctaacacgcagtgcagaacatgtaacttcttgttgccatgttcctatgttcctgtgttcctgtgccttattattttgtcattattattattattattattattattattattattattatttgtctcccaagctagagtgcaatggtatgatctcagctcactgcaacctctgcctcccaggttcaagctattctcttgcctcagcctcctgagtagctgggattacaggtgtgtgccaccatgcccggctaattatttttttgtatctttagtagagatggggtttcatcatattggccagactggtctcgaacccctgaccttgtgatccacctgcctcggcctcccaaagtgctgggattacaggcatgagccaccgtgccggcccctatgccttatttctaacgatttttttttttcccttggtcaaatccttcattttgcctaaacacttcccctagttgcttccaaacaagaatatagtggaaataaacacatttagtccttccatatcaggaaatgtctttacttaatgctatcatttgattgataatttaacagattatttaattataggtggacaatattttctcctcaaattttgaaagcattcttctagcctccagtcagttttagaagagtccagtacgattctgattaccaactttttgttgtaagtgattgttcccccttcctctctcttccacatacactatttttggaagattttacaatcttttcttagccccagtgttctgtaactatatggtccttcttgttcatttattgtacagggcacttggtaagctctttcagtcagaggctcatatcgtaaaatttggagacattctcttgtacttcatgttaaattctttttccagctattaaaaaaaaattgttcttttggatttttctattaggtagatgttgaacttcctactttattctctgatcttttctttctttcttttttttttttttgggagacagtctcattcctcattgcaacctcccctctcaggttcaagcgactctcatgcctcagcctcccaaatagctgggattacaggcatgggccaacacacctggctaatttttgtatttttagttaggatggggtttcaccatgttggccaggctggtatcgaactcctgacctcaagtgatccacccacctcagcctcccaaagtgctgggattacaggcgtgagccaccgcacccggacttgatcttttctttctactcgtgtgttcgcttttcctgatatttttgggttagctattttttcctccagaaatttacttgatttaaaaaatatatttatatttttactttcctaatgccactctcatttattatttctgtttttatgaatcttatatattttcttattttaattacagtgctaatagtttttgttcgcttgtttccatctgtttcttgtattatttctgcttactttgggtttctttctgtttgcttattttgatattcttatttcatttcacaattttttctaaagattgtaagcttcatgagaacagagagtgttttatttagcacttgaaacagtatattgcacatattattcaatgttattattcatacaataaatatttccttaattattagttgtaagttagtaagtagttaatttatagtaactcatatctgcctattcacatttttaaaagaggcatttaaaatgctgattaaaatttccttgtgtttggagcaggggcactggacttcttgactgacagtcttctctaaatcaatcacattatgaagctgacttttcattgcggatatccaaattttagtgtctgcaggacctgggagccattcacttctgctagagaagactcctccaattttctggatgaagggatatatttttgcctctgacatatctgggaggttgactgaggatggggactaaaagtcttgttgctaatgaggtagattttaatcccctagtttgcagtctcacactcacctcttccctctgcaatgccaagtgaccttgagtctagactctagaagcttccttgtttaattttgtctcatgaaggtctgggagccgtcagctgactatttgcaatgggtgagtaagcctgggagtctagcctttctgaatgatggctgttgcaggcagtcttgaccatatcttcatggtaccaggcactaccaagtgatcagcctcttggatattctgtagcgaaaggcaaatttgttaacttctttgtaattaataccttcatccccacaactgcaccccgggagtgcaggggtgcaatctcggctcactgcaacctccgcctcccgggttcaagcgattctcctgcctcagcctcctgagtagctgagactacaggcgtgcgtcaccatgcccagctgatttttgtatttttagcagagacagggtttcaccatgttggccaggatggtctccatcttttgacctcatgatccgcccgcctgggcctcccaaagtgctgggattacaggcgtgagccaccgcacccggcccacctatctatattattatttcttctccaagaaacatttccaatcaaaaggtcaggtttttttctttagaaaaggaacataaaccccaagtattatatatgctacgcaggtcgaggaactagtatccaaagtatgatcagttatttcaattaaagactcattgtcgggggtcattttgaaaattctatcttatttcagtaagagtagatgtcaaagctcctaagagaaattatggaagtccacctggaaaaggcttgcaactgacttggttcgtattttaaaaagaatgatgtatatgtttctaacaaggtatcttagggtaaagctattgaagtttgtggtgaattcaaataaataataggtcacatgtataaagaggtacaatataaaggttgaaaggccaattccaatatagtgttatacactatgctaagtattgcagatttaaagatgaataaaacatgccccttgccctcaagagtcccttgataggacatctgcttttcttcattttcaagaaattagttgtatgtgattcttactgttataatcttgggatgtgacaagttgtgagagaaatgatttatcagggaactttgatagctaaatcataccacagcaatcagattaatgagttttggatcaatctagtcattcttttttctattttcaccagaaactcctaactcccaatttagcttcaaataatattttttcaactataccgatttacctcttctttgactagttctcttttagaatacatctaagtaagtggtactaacctggaggtaaatgaaggacccatcttttataaaaatgtgctgccttgaagaatttttttgacagaaaaaaatggcagactttctcttataaaccgtatgttcttacatttctgatatctggaatcaacagcttgccagaaacatttccaatcaaaagccagactaacccataaaggtgtccaaagaagtctgttctgattactgaagatgttgaactagtcttgacttcaaacagtagatatttctacactttagtggtatatgacagctctattcattccacaatgtcaaattctttggttttggccattgggtatttatgcacttctggctagggaagcagagaagcctaatttgattctggagccaaaagtttttaggccctgttcctttggaacttggactggagaatgttggcactgtataaagactaggacagatcaagtagtcacacataactaactgactcaacagagcatattcagagagaaagatcatgcctacacatggataaccattctccaaggcagactaacaacaccctgaattcaatcacccctaaataaacacacaaggaaagcacagctttaacataccttccggcacagctctccaatgctgcctgattggttttagtgccataggccaggctgcagatgcagccattactgttgttcttacttatgtctgtctgctgtctgctaacaagcattcatatgctttggatcattaaagtcacaacctcctatgccaatctattcctctccacgggtttgctgtagatttgaaagagagatgctatttctgtttctttttctttccattaagacctccagtcagggttatttctgaggtctgaatatcctagcttgtacccttgccctcattgaacatataaattgtgttccattaagtttgttctttttgcctgatttatttcccttgctgttgtatgtgcctttttaatgcaaggcaaatgatttgtgctggaactgcaacagacaaaagtgctgtaacttaagctgcttcctgatgccactgctatctatgagaggtctgctgtacttacacccatggtaaatatcttctgacagactccaggtggtcaggattttcacaatccaacccatttcagtgttagcacttgtcatgtggggctctgtgaattcttccctttcatcttactgttggtggcaggttggatacatttggacatacctgtacaaggccacatgtgtccacagttataatcgaaggtggagaaacacaagtttctctttcagggaagcacagaggacagatattgtacaaagaaaaaaagaaaaaaaattgtcacttgtagtattatgcaggctgcccatctaaacccatcattgcctggcacctacacactaagggcaagaatccagccaacttgtgagtgggcaccatgccatttgagcagatgggcatggaagtcggcagccagtagaccatgtatgtgcatcaacggtgggtgttgagggcacgattcccagaggagaatgtcctaacagctgtctggcctgagccaacatacttacgaccaaggaaaagtgccatccttcaatcctgctgagttggattaaccttcagaactaaatctgctttttcggcagcagaaggtgagtttagggtctctgaaaatctcaaagaataagtgaagaaaggaaactgggaggatacaattattctctattgactaaagatactgaggacattcaatatgcttattttaaatctttgactgagaacctgttaattcttgaaagaatgttataattgttcaaagcttggcttcccacaaagctgttaaaagtgacctttaaacataggcagaccattttcagtgagttaacacttttccacctttgcattaagaaatagtgatatatgaagaaaggtgtcagtagactactgacagctgactgtgggtagatatctttgtcaaacttgacatatcatggattaaattagatctatcatggatcagagctttcacaaaagagaatttcttcttcagtgatggaacatacacttgaagaagtaagaagtaaacttcctatttcaacgaaagcctttctgggcaatgaaagaaacatttttatttgagactgaaaataaagcctgattctaatttgttaagaatttccagacagttaaacatcattaaattagatagaaattgtttctgccaaacatagccaaatggtgatttgacaatgatttgttttacttggttaggaataggtagataattttaacattcagatccttaattattttctatgttgctttcttatgaggtatttgtgtggtagttcttgctattgttttctgttgtcttaaatctttttattttaaatataacatatgactttagttgtggataaaatatcagtttggttcaagattatccacctacgttttcttaatctactccctaaactatttcattttgtttatatcaagagagtaagtgcttatattattgggagtgaaagagattaataagttattttatctgctaatggtaggaactatagctttggctttgatgaattatataatgtcttagatctaataccattagtaacattatgagtagaataaaatgtttatatgtctattttggccctgagtttctcattatatcaatttagaaattcatggctaaaaaatacgtgattctacagagaaaaaccaagaaaattatattacttaggcatctctgagtttcttggctctggtggttcttatcttaaaagccgatttgaaggctaaaaattgtggtatgtccaggttccatgtgaatgacccctctctgtctgagaaaacagagagaaacgatctagcgaaaatatacaaaaaacataggggaaagctaaagggaatggtattcagcaataagcaagaaaatgtgtgtattatctataactaatttttatttaaatagtaaggtcatgacgcagtttgattttctttgtggaacacatgtgtttgggactaaataaagcagagaaagaatattaaggagttagaatcattttagcaaacgcttccctttggctatctgggatataggaaaatgtggttgaagctgagttaaagtcagctagacttgtgccaggagcgagaggctggtgggcactgcaggtgatgcagatgtttataaaaaaaaatccacacttttttaaaaatctgataaacttttatttgtcctcaagaaggtttttgaatcatttcctttcattttgtgccagggataaaaaagaaaataagagtgtcagatttctgactgacaataataaacaatcaaaagaggcttagggaagagcccccctcccaaaaaaaaaagagagaatatttgcttctgaatgtccactatggcaattgaatgatattgtgggcagatggaggaaagtggaattgtgaaacaatttacttatcatacactaataaggaacaaaacagaaaaattgcatctttctttcgtttatgacattggctcccactaggattatgaaaagatgcatttaggtagtgttagaataattgtgggacatggataaattttacatgtgtccacaaatagttaaaattagaagattaactgtaaagaaaaaaaaagcttcactaactttccttaattcctgattgtaatagctttaagaaatagaatttggcaaaacaaatgaagatttgaatgtaagaattgggatacaccaaaaaaacttttaagagactgtagagataaaaactaaacttaaccacagatttattgctgcttttcatccaagtatccagggacgttgctaatgggaggtacgcctcagaaacgtacatgtctgtgaaaatgttggaacaaactaatgcttttcttcaagtgattttatttcaattctaagccacaagatataaactttcatcaaaaatgggaatctatttaaaagcagagctatgaggaatgtttcatgtttatgtataactttcatagtagaccctcctacacacggaaaataatatgcccaaattctgttatttttacagtatgtaatatatcacatactaatcccacccatcagtttcatatcctttaaatagataaaaatgaaaaagggatggaagaaaaaatgaagacactttgaaaaactgactttttaattcctctttttggagaaaaagatatctgaaaaacttaattatgatccatatcctaataagaacaaagaggaatttgaaggaaaatacgcattatatattcagaatactatcttttttcatttcgctttgcacaattagaaagctaagtacctggggaggggaagaacagaagtagaaagggagagagtggtgggtggtgataaataaggaaaaacacagattttcagtaatactaggttcaaaataatccaagtcagaagaattttatatttcaagttttttcaatggtagttacaaatcattcctatttgcaggacgtgataattcaataggaaatagtgccattgaaaacaagattgcccacacgcagtaaaaagataaggttggactctttttttctccccaaaagaagggttaccatcagttcaaatatttatcaggaaaactcagttgcttaatatgcagaatattgtaataaaaataatttaagacataattatgccaccttgaatgaaactcttaataaacagatcagagaaacagaattgtcagggccccttttctttttctaaaatattgcaagtaaattaagagtaggaattcacaaaatttttcaagtgggaattttagcatgatattgaaaccaacattccatcatttataaatataagaactagcaaaataaatgaggctgtgaacatttaattatgcaatagacatatatacatgttctattctgtttagaggggggacctatatactatataaaaacatttggaaacaaaataaaagagacatgcataaacataatacattaaagcttctcagaagctttacagaaatgcttctgtttttaagagaaaataatttattgaaataaagttgtatcaagctactgctaatattattcttctattcaagttttcaaaattcaataattaatgaacaattctagcaaaagcaaaaaggattgaagatcaaatgttggaaccctcctttgtcagcattctgaaacttaatctaagcaacttgaagaataaaatgtagggtttttatatcagatacattttaaaagttctgagattgttgaggaagaatttaaactactgtttaaaatgaaattctctctgcaatactggtagtagagattttataacacaaacaaacaagtatattttgatcacttactattagaaattactgacatatggatgtactaaatgtgaaatgttttctgggtataaataaatggttcataaggacatctaatgttttaagctggaatatttgtcaagagcatgtcccataataatttgtaaaattgtcagataataataataagctattaatcgatatctatataagtactataacattttctgttatttatactatggcttaggagagacttttttcccttcaaacttacttgataagattttggttgacccaagttttctttataattattatttcaattaagtatattatgtaaaaacaacctgaaatattctaatttttgctgatatccatgcaaaacaattaagccattttggatccagaatttcctaagtcataagtctcagtcaacataatctgatttggagtgatcacatatttctttgtctaatgctttactgagaacaacattaaagcaaaagacaggtgatgaaagctctcttttttcaacatcttcataacctggttgaaaatgatagattggctagtttattgatttaggaatgatcagcaatattacttcccctaaaggagtattaagatgattcacaacaaatttgaacctgatttctagcatcctgtataaatgtgtacaaattcataagtctgactctaaattctaccttagaaatatctttttatgcacgtggaggctctcaactttgtagttccccaagaatgtagtgactgcctacacacacacacacacacacacacacatacacttatattgctggagaaacaataaagtgtcatagttgagcttattcctagatctaggttaaaatactacctatgcctttcattagctatggattttcaaagttacttaaactgtgtttacacttcgatacttataaaaatggttaatattattaaccttttaaggtttgggtgagaattaaacatgctaataaatgaaaaacatagagaaccatgcctggcagataataagtactcaatatatgttagcatacaatattatctttgtataaatttctcaatttgcattcttatttgtaccatggactcaatgggcccctttaagggtgaaataagtatgtgcccagtttctattttgagtcttcttatttagatttgtttcccaaacttcaatcattcacttgctatgtttgtgagttttttccatatttcataccataaattacttatttaattatattatttaaacttaaatagctttattttaaaataaaatatattcataccactagtaaatggttttggtgtgatacatttttctatgaaaccttaggattttataaatcattacaatgaaaacactcatcagctaaaataatctcttatgctcctaataatatgtacaccacacatttccaaacactgctttaaataaaagctttctataggtgattggaaaggaatattaagaggcaagtgggtctgtatgcccataagaatttagtagtggtcagatgaaagagggcatggagctagccatagaagaaatggtgcaactgacatagttaaaggccaagtgcccactcatcaatattgtggagacatttacttgctacttctctaacacttaagacttgagtttctttactttccaggagaattacttttgtcctaagaatgggaatctagttgggttttaaggaaatagaacaggaaaactccttccatcttggaactcttccactcttgaaagttaaatataagacgtatgtatgaaattttcagtggagagtataaatcttagtataatgagtagtaattaagagtagtacattctaaatgtatagcaagataaaataaatttctgtttttaaagaggtttagataccaaatgcatatattctttcactcctgagaagaagctgaagtatcagtggataattaataagtgtgaattttgggtttctacgatcactcccattaactaagtattctgccctcagtttcctcatgcatagacctttcatttagacgttaattgagcatcaactatgggtaacatatttaaggtaatgctagcagctgtaaaatcctctaaaatagatgatggttccaaaaaatagaagcttatttctcacttatgtaacagttagatggaagttttcttcaggaactccctctgcaacttttctcttaagtataaaattattccacaataaaaatttagcaaagaaaacaaagtgagctttactggcctatgtatggtttccccacatggtgattcagcgcccaaactccttccatcttgcaacttcatccctccgtagggccttgttcattgttttcccagccagggtgtaaggaaagagaggacatggaggggaaacactccctggttaatagccttagccagggagtggctggcattgtttctgctcacatcccttgatctgaactagtcacatggccactcctaactgcaaggtaggctgagaaatgtagcatctagaaaagaggatacaattttggtgaacggccatacccttcaccatatagccgtttacaccatccatccacctccccaatggacacagcctaaagttccatccagttacagcatcaagctcaaatttcagaatctctggtgataaacagctctctccataaagctcaggttttacgggaggggtggggagacagcccaggtaagtgatttagagcttgagatataagctctgtcccactttccctaccacgtccaatggacaacaatggagcaagaacttggtacctgggaaaaacaaacaaaaacctttctcatttgtcaaaggaaaaataggtaaacagccaacagtcactggaccaaaacaataattgaatcctgctggccagtctctgtgagacaacttccctcaaagtcaagacagtccccggctctcctttctgaaattccccatggccactgttctccagggtttctggccctgctttctggagtctgttccttctcaattatcttccataggacacctgtgaagcgaacattggggaaaattatctccttggatttttactttcttcataacccagttttcctagagcaaatgtggggttccaggttgtatagagtcgtggaattttttaggccaggattctgattttttttttttttggtagaacaattctctcaaaatcttcacagacattgatctaattccttcagtcagttgtatgtgccagtaaccagaaccaaaaacaataaagtcctttcctagacatagtactcaggtctgctttatttctttaatttcttacacttatctctctttctctctctttctctctctctctcatcctcctcatgccccttcttccctccttctttctctccaagtaaatatgaaacaatattaatgggagtttctgtttaaattacaaaacagtgtaagattttattataaattctctttctctttatgttttattgtagaatctgtctattatgcttcttcaggaaaaagaacattaagatttattttaatttgttctaaaagtacataagaaagtgtgatttttgagtatttaagcacatctggttactaatagaagacaagagacttaatagaatgttgatcctgtaaaagctgagctcacatcatcaacaaaaaaaaatttcaatatgaaatattttgtcctagtaacaaatcaccttgaaacatagaggtgtgaaacaatgtttttgtcatgcttagagtatgtccaaaaatttagatgaagcacaacaggaatagcttgtttctaccccacgatatatttgagttctcttctgggacgtttgaagtttaggggaaactcaatggccaaaaggcaatcatcgggagttctttttttttaatttttatttttttttagagtggggtctcactctgttgcccaggctggagtgcagttgtgtgatcatagcttactgcagcctcaaaatcctggctcaagtgattctcccacttgagcctctggggtagctggggactgactgactataggtgtgtgccaccatgcctagctaattaaaaaaaaattttttttgtagagttggagtctcactatgttgcccaggctagggctctttttaaatttaatgttccatttttaattattaggggtacataatgggcatatatatgtacggggtagtgtgatgttttaacacacgtctacaatgtataataatcaaatcagggtaattggggtattcactaacccgagcatttatcatttcttatttcacgtgttctcactcatttgggggcgctgtaaaacaattgatctcatagagatagggaatagaatgatgattaccagagcctgggaaggatagaggacttctttatactcacaagcttggtggttgatgctggctgtctgctggaacctcagcctttctatcaatcggaaacctataaggctttccttgtgcttactctgtgggtgtgatttgggtttcctccaacatattttccaagagtgaaggttctcagaggacacaggagaatgtatgacatttttgtgttccaatctttgaagtcatagagtggaacttctgctgtacttttttattgaagcaggcataaggtctgcccaggttcacatgagagaacacagacttcaacatttgaagaaaggggtgtcaaggttacatggtaagaagagaattgggtttgagatatgcttgcagccagccatctttgagtacgtattttatttaaattagtcaatgtccaaaacatttacttctcattttatatctacttaattcacatgcttgaataacactgaattggttattttatgtgtattcttactaaactctatcaagaaaaattatgtaataatatccaatgtcaatatatttgcagatatccagacacagaaggaatcattcacagcatatcttgaaagatgtcattcctccattggaacaactggtgagtgtttaagtcattatattcttcatctactgatacaaaataaattgccacaaaactcagcaacttagaacagcttaagttattatctcatttttctgtgggtcaggaatcagggcaccacttagtagagggatctagcttggagtctctcaaaacgttgcaacaaaagcatcagccagaattgggatctcatttgaaggcttgactggggaaggtctgctttcaagctcacttatgtggttgttggctgggttcagttcttccaggaatgttggccaaaggctgcccttatttccttgccacaaagatttctccaaaataacagcttgctttttcaaagcatccaagatgagaaggcaagagggagagtttgctagcaagatggaagtcaaaaatctcttgtaacctaattgtaaaagcaatacgccatcagctttgccacattcttttggttaaaattaagtcattaagtctagttcacacaaggggagaggattacataaggatgtgaataataggaaccagagactacagagggcttattgtaaatgttgatagttttttttgttattgttgttgttgtcttcaaaaaaaaattaatcgactcaacatccgtaagaatggcacttttttccatgtttttgtgtattgttatatcctagtgacaaaaagagtacctgaaatattgtaaataacatgaatgaataaagtattatatatatcttaaaaacacgtaagaccaacctttctgatatgttctgatacttctttcttttaatgacctcttttttgataaatacaatgtgcttttcctctatgctcattcaacttgtctttcctgctatatttcatattggtcaatatgcttccagtcttattggcttacaggatattgcactatgattactgcattcctgtctatctctagctatttcatccctgttatctttgggatgtcccatccttagcaccaacaataatttctttttttgcttcagtgttcctgttttctattgcttttcatgttccagatcccacatccccactccagctatttctccttactctgctttactttaggataagaatttctccaaataattgtctacctttgctgtttccaatttctgccctccctttgtctcttgaactaactctgtttaggcttttatctcaatcattcacctcttatccaggtcactgattgcctccatgttgttaaatccatcagtaacttctcagttgtctcttcagtaggtctatctgagcatttaacccaattgatagctctcttcttgaatcaattgcctagtgggtacaatgctcactgtttgggtagtgggtacactagaagcccaacaaccaccagtatgcagtatatccatgtaacaaataagcacatatatcccctgaatctaaattttttattaaaaagaaacattttcctcacatgactaccagtaaccactttctcatggctctccaattagctggagagccacctcttttcaaccccctttactggtccctcttcattttggagctcagtttttattttttattttttctgtctgtaggaatttcctagggcatctcattcagtgttgtagctttagaccatgtaacactagccagttctaaatttctatttccagcatggaccacagctttgaacttcagtactataaattctggcatttttacacacagttctaatatacatcctaaacttagcatatctgaaactgatcccgatttttgcccaaacccgttctccatttcacaagtcttctccatttcacaagatggagaagcacctccaggtgcttcagtcaaaacactaaaagtcatcttcccttgtttcagtcgtaacataaatgaacaccaaagaacccagtttgctctgtcttcaaaatatacccagaatcagttcatttctcaccaccattactatcatctgtcacccagtttattgaaatagtctccctgtttacccactttcgctttctactgtttattttcaacacaacagtgggagtgatcctgttaaaatgtaaattagattttgtttcttatcttagtcagtctgttactacaacagataccacaaacaaggcggcttttaaacaacagaaatttatttctcataggtctagaggctggaagtccaagatcagcattccattctggtcaggatctggtgagggccctcttctgggttgcaaacagctgacttctccttgtatcctcacacggcaaaaagagggcaagagaactggggtcccttttaaaaaggcattaatcctattcatgagagctccacctttatgacctaattacctcctagtaacattacattggagtttaggatttcaacatatgagttttaaggggaaacaaacattcggtccatctcacatcactccttgactcaaaatcctccctggcttttagtctaccccaggtaaatgctaagaaacatccaatggttcactaggccctagaagactcatcgacttccccagtctcacctctccctttcttctcctgtctccttctgctccaatgaagctgatacctcttcctctgcccggccatcccacctgcttttgcctctatctcttacaaaataatatatttggtgcccagaaatttggatatctcatatgttcctctgctttacatctctgctctaatatcacctttttaaataggtcttccctaatctctcttaaaaaaaaaatgaaacaaaaacaaacaaacaaaacccatagtggccaggtgtggtggctcatgcctgtaatctcagcactttgggaggctgaggagggggctcactttaggttgggagttcaagaccagcctggccaacatggtaaaaccccatctttactaaaaattagtaaatttttaaaattttaaaattacaaaattagccacgtgtggtggcactcatctgtagtcccagctacttgttaggctgaggcaggagaatcacttgaacatttggggtggaggttgcagtgagccaagattgtgcagagagagataaaaaaaaaaaaaaaaagaaacagaaaggaacctacaaatgaacaaacaagaaaccacaccatttccatgtacacttctgttaccttaatttactctatagaccttaccaccagatggcatactacagcatttatttttgttaagtttgtcactccattagaattttagttctatgagggcaaggacactgtctcctgtgttcattacttcattcccatgactacaataattgctggaacatgttagggactcagtaaatatttgttgaatgaaggcataatgaaaatttaatggcttttgttttcacttccaagcttgtgatacacaggtctatgcttgtaacctttctctcctgtgaattagtcatttgttctaggatgtcatctctatcatcacagaaatgaaatccctcaagttgaacccttcatcagtgccttctcaaactgattccctctttccattgagcccatctctattagtagcaaacatatatctaggatgagaacacattttctttatattctttattttctccctggccctttggataagtcatcattttctgatgaaacgtctcaatggttgtggtgcccatatgcttctccttgtgcacccccaaaccctcacccaagccttgaaatgcttctgaccttatcataccctatcatcccccccactgatcctaggcagcaattccagaacagccttctttcaatagtactttcattatttcattttcaaattttctacagcatcatggtccccaatttacgttatttattatcctctctcaaacacataccctcaagccaggagtagtaacatgattaagacatggctcttaccctgaaggagcttggatttcctgtagcaattacagtcctttcatcccagcacatgttcatgtgttgttttgtgttgctcactcttatttcataggtaatagacttgttccatggctggattgtaaatgtcttgaagttagaggccatgacttgtattttctttattatatcgtacttctacttagattgcttttggcactagtacttgttcaggaaagacatgcttgtgaattgatgtaataagaaattaaaagtttattaaaacaatgttgctagttgcagacattaataaatatatgcctaacatttgtagtgaaagccaatttttcaatataattagatatactaatatattgttttcaaaattaattacgtggatctcaacttagcattttctctaggaaggatttctctaattccttaaatttgaattagatagcccttctttgatctgtctctcaatagcagctgggtcttgactctattccagccccatcacactaaaattgcctatttcctttattgctcttactgagctataagctatttgaagggaggactatgtcttatttattgttttactattaaaacttcgtataaaggctggcacactgtagttctccaataaataggaaaataaatgctttatttgtttggttttattttaaataaatttggattacacagaaaataaagtacaaaaataattatgaagagctggattattttgtaaaaataacacataaaaagtttgctctgaagtagtcgatgaaacatggcaaaagttaggctgaaaatggagctcagtaaatgtctgtgtttgtgtgtgtgtctgtatgtttatacataaaatatatatgcacatatattttaacagtgcctaaaggtgccccaaagttttttacataaaaaattataatatatataaaatccaaattatagttatttaaaaaattaatttttatataatttttaattgtgtattttctatgccactatatcaagcataagctaatatcagaagaaccattagaatattcagaaatagttttcaaaatttacctgcctactcttaaggctatttgttgatttacttgcatatagtagggtttctctgcagcctcagttctaaataaatgaaactcactttgaatatcactaattatagataatatagtaatagataatagatctatttgcccaatactctattttagccccaatgaccttggaaaagtaacatcgagaagtcctgctaaacagaagcaaaaacaataatttttaagttttttaccttgcaatttatctcttttttgctgcatacccgaatatttttctgttttctctttttccttccttctctccctctcccattgacacacacacacacataaacacacacacacacacacacacacacacagtgccatgagttctaaaaacttttggaactaccaatcagcttacttcctagtcttgacttgggttttcctggatcatctctctgaacgcttatcttgctgtgtcttgtgaacatggataacattcaacttttatccatcaatctctacttgaattgaatttcttacttactgttattttaaaggcagaaacattatcttcatcccaaattcttatttatgaattatctatattgatgaacaatgccccaataatcacccattcccccagacagaaaatctgattgattatagaccattcattatcgttcacattgacacttgaattatttttcagaacctatgaagttttctttacatctgattaatctaatgctgtgttctttttaccaggactcacatactctttctgcactctggtatgttccctactttcatctctccaactctcctcacctccaccatgccttagggtggcttccagagtcatccaggagtcctggcagtagtttccttggctgtacctaccaggatgagctatcatatatgaaataatatacaggaaaatacttctgagaattaatgacattctttcctttggagttattatccatcatctctactgtatggatcttcaggcttatttatttctaaaatgttgggatatataaatctcaattcctttatatctcatattgagataactctactgaacattctccaggaaacacgagagacattggcttttggccaaatttatcaaagtgtcctattaggtccaccatgttgtaggacaattattcactttataaaatgaaatctgccattttggatgctctcatagaggctaacaccctttgggaatcatgctccctctcttaatgttccttttaagaaaatagattgtaaacagcatggttaaacagaacaaagcatttatttcttttgaatattggccaaaatacattcctaatctgaatctaaaatttcagagtggaaactacccagttcactgacagatgatgttatttatgccacatgtatgtaaatccatagggtttcggtagaagagacggaaatcatttcctgagaatcggtgtggttgcttagaaagtgctataatatcacaacagttttgtacatgaatcatcaaatatatcaatatgcatttgtttcctgatcttgtatattctatattataactgttcatgagacctaattattttcagggtactttttcttttccccttaaagaaacattcaagaaaaagaaccctgtttataacatgttaaatctttatcttgtttatttttatcaacagagtgtaagacatgtctatggaaaaccctgcaggagtcaaaagcctgtggcaggtttttacagaatcatctgctacctcctgagctaggaggattttgaggacagagctcaggaagttgctatggcttgggggcaaagcaggcttttgcagataaaccttaagtcacagattctaccttttagagccagatatcattttgtggattaattaatagtagtgagggctttgagcatgaaagacattgtgagaatacagtgttttcttgttttaaaacgaaggacatagactttgggggaatagttctattgatcaagctgggctttccttaaactgctgaaaaactctaaaagctctttagtctttcaaaattctacctgggtaagacaaaattaggttttctgaaatatccttccagatcttcaggctgttaataataagttatgtaacaataataagttatataatttaataatgctaatagaaaccatctctaagttttcattatttcatgtgcccttccttttctcaagtaagagcatgtatattaattcaagtatttgttgaggccatcactgtgctaggcttggaatatgtgataatatgctaactggccatgtccctttctagagaagcgttcagtctagggatgaacagaagtgttaaataaaggaaggcataattctataagtccaaattacaaaatgtgctatgataaaaaaaaaacaagtttctgtgagaacctacactggattaagtagtcacacatggattctttgaaatggccagttaacttgagattttgcaagattgatggagtttgccaagcaaagaactggaagaagaatgttgaagcagaaagaaacaagtgcaagggtcgccaggtcagaacaaagttgttacatctgaaaaactgcaaaaattccacagcagccagaatattatgaacaagggaaaagagtcacgggttttgaggagagagaggcagtgcccagattgcaaagggccttgaagtgatggtaagaagttcagaagccattgaaacacagaaacaaatgacaatacctctcccatccagctccacatttgaaatccatttaactctagagtagagaaaaagaacacacagaacagcaacaataaaggctattaatattgagcaatcctttcttccccactgcctagactgaaattaagttataacgcagaaattgaattacactaataagttgcccagacagtaaccaggaaggccattctcattgaagtccagtgacaggcaaagaacgaggaacatatttacatcaaagacacaaataaatagaattcagggaagaagagaaagcaatggtgggtggaagttgggtggtgcatgagggagggagaggtgagctatagtaaaagcctccagaagactgaagaaatttcttgagatacaaaaagggtgccttcctcagcctgtttcccaaacagaacctggattccttggtggtgaccaaatgaacacaccggttgccagatgaaaggttcagaaaaaaagtcgtatgggggttcttaaacatcaaataataacattttcaaaatgacattttgatgagttaggggtgaataaatcagagacatacagataaaatttcccttgaaatacacagaggtttaacatgatggggaaaagcacttggcaaaacataatatgtgctttgccaaacctaatatttgaaaaatggtttaagacattcagcataaccccaaagctggacatgttgtcttatcctaagtgagagaaagtaagggagggaggctacccatgaaaacattgctcaacaaacttattaaagaatataaataagttgaaatgagtaaaccatgcctaaatctgaaatcaaatttcatgctgaaatcaaacacgcttatcaaggacctctttgagaattcttggtgacctctttctatcaccacttatgtatgacccagaaccattctttgcttttcttctactcttcttcacatgcaatcattgcatccaactttagatatttggtttaccacttcttaaaaatgtgcacacacagtaaatgatgtatttacatcagacaaaaacatcatactgaatctatgtctaaaggcataatatttcattcttgagctatatttaaggcagttctaaaattaagacttttaaaaatgtttaaaaactattagtactttatatgatgtacagataagctggagttttaaggtattttttctgtttttgattctgttcttaatggattatgtccacagtgagttcgccggtaatgagcaaatcaaatatagcatgaatagcagagacagtatgggaataagtgaatattgagaagaaaatgtaagcaatgagttccaaagagaaagagtgcaacctaaaaacaaaggcaaaataaataaataaataaaagcaatagaaaaaagaaagacagataaggtagatatttctatgaatagtggagaagtaaaaaatggcgggcgtgggtggggggcgggaatttaagaaggaaagtgaagcatcatttgggggtaaaataatgtaaccaaatgtgtcctcattctgtgctctttaatagaaatcattgaaacagacaagattaacagcaaagtactatgatctattaaaagttcagagaaagtatagcagctgcctcgttattaaataggaaaataattaaatgctaaatctgcttgataattatagtggcccagggttgtagttatagagagatgatgcagagttcttttagagagaggtcagtcagtcacacagaaggtttcatagggtgatgctactttaaagggatcatctcagtttagagctggggcctgtctcagcattgtggatccagaaaactcatatttatcatcattattagtgtttactgagatgaagatcccttgagtctatctcacagtacataatagggaatattctgatactatttaagtcacccgctttctacatcaaagaacctaggaagctgaactaggattcagatggctgccaatgagcacattatcagaacaaaggggaagagaacaataacttaaatacatcagcagagaaaacgttatgaggcataaggaccatgtggttctggtgttaaaagccaaacccttctcatcaaaatctggtaaaagttgcagattaagtttatttccatttataaacagaaagggttattttaacagaaccctttggtggaatggtgtagatgaaaatctattatttgcaattgtatctgagaacaacatgaagccttctcataaaaaaaaatgcagtgtgtgtatgtacagttaacacactagtctttctgccatgattgttaccattaatcaaaggttgtcttctgctcccctgtcttgtctgtcgcctccaacgtaggttgataaacaggtgctatctgggtatcccactgccattcattcttctcatctgtatctcagcatggctgtgtctgccgagcacttcctcagtgcttgcagactggctggcatccagtatgaacaaattgctgatctttccagccatttaatgttaaatagggcttctaaggaacattggacaaatagctcaagaagccagatttagcatctaaagattggttgacatttcttaagtatacttagttcagggactgctacttctttaaagaacttcaatttggcctagaatttggcaagtagtatcctaaacttagacctagagctgtaagtaattttgtaaattactggagacaagaccatctgagctctagatgactagcacgctcaactggaatttatagatcattgtcccttcaaaccatgggattaacattgagtaggaataattattagagaaactaataaggtaccatatataaacccacatgcaaaatgcatagcaatcttttgcttgccctaatacttctttcggcacactatgaggctcccagaataactgattcctggtgtctgaaacatggtgacgtatttcaaactatcatgacaaagaatagtaaagtaattaatcctacctcgtggaaacttcacttgccagcatgagaccctttacaatgcagtgctttcagtgcagaaagcataattggaattttctacccaggctaaaagatggcctgagtctgtgagatgacttaagcagggcatggtatcccgtccccccagaaaaggagcaggaatatcttgaatatgaactcccaggagtttaagcctcaagaggattacaattgtcctattaatctttccagttctgttgtaagcagagaagctggcatttagaggaaagaagtgttattaattaaaaatgtgttgaaaagaatgaataagtgtacatcaagtattaaaaagacaatgaaagggccgggtgcggtggctcatgcctgtaatcccagcactttgggaggccgaggtgggtggatcacctgaggtcgagagttcaagaccagcctgaccaacatggagaaacactgtctctattaaaaatacaaaattagctggtcatggtggcacatgcctgtaatcccagctactcgggaggctgaggcaggagaatcactttaacccaggaagcagagattgcggtgagccgagattgcgccattgcactccagcccacgcaacaaaagcaaaactccgtctcaaaaataaaataaaataaagaagatgaaggaaaataaacacctgatctcagaagtgagaatgtgtgcacagtggtaggacatagatatactacgtgtagaaatctgcatgtaaacatttaacaaatatgcatggtggtagcaagtgtagtaggtaatagaacatagcagaagcgttattagcttcttctaatgacctggaaggcagcctgactttggaaaatgatataagagaagataactaacttgctattcagtccgtcctcatttttcctgggacctctgtatgatcattcctgaaaagtctattgcattgatccaagaccatggaactggctcagccactgatgacaatgatgtcacatttattgagtcttaacttgagaaatccagcccttggcatcaatctcaagtattctgggaaaagtcctgcagtgtctggggaaatgttacttatgtattcaaagaaagagaattctatgatgtacaccttaaacctgtttatgttgatttctccctataagagtattagctttttcctttcacatttcctatctcttttagaaaaattttcatcaataatttatctttgtgggtagcaaatgtctaccgagggatcttttgtgaatttttggaaaaaacaattggggctatatttttagcagagaacgcatgcatcaatttttatgatgggttgataggtttttgtagtttttttggtagataaatccaggttttgggtaactgttaatcagaagaaaacttaaataaaacaataaattttttctacggttacacaacaaaatttctcagtatacattcctaaagaaaggaacctcctttgtggtggtaattgctattgaaaacatctttcttccaaacatttgtggataccagtgatacacagagttaaacactaaatttattatatgggttttacgaggtagaaaaataaaattcctggcaccaagaaaaagggacagtatacatagaataaaatgtggaaaaagcaaatgaatagatgtatccaaatacaaaacaaaaaggcaccagtgaataccatggttctcaaaattatccaagaaatcttccttagatgctgtagagttgtggagaacatggtgaagtaaaagaaactttctggatatggagataagtaaaaaacactttgctatcattttcataagtcatcattattattatctctatcattatttatttagtcaaaaatgtattcatcaaatgcattttaaaactaagtcccgtgctatgtattaggaataaaacaaggcagaaaaactctcacctatatcagagcagacatttaaccagtgagattttagttatttggaacaactcctttacctctaaatatctcttcctttcacttgtagtattgaagataaatttcttggcttgcccagtttactataaatatttaaataaacatttaaatagccattcatttacttatttgttcaaacagttttattattttgactattggcactaccaaaatattccagaagctaggaatccaggtgtgaaaggtacagttttttgcctttgatggactcatagcacattatttgcctgcaggcacagataaataaaatgacatttacaacatgatctgatatgtgctgtcacagtgacaatggcaaactgaaaatggagattcaggatggtgcacctaaaagagatggcagagaaatcatggaaagaccctctaataaaaagacgtgcacattaaaatttggttttcttcttattttttgagatggggttcttgctattctgcccaggctggtgtcaaactcctaggaccaacagattctcccaccccaacctcccacacagctgtgattatagacacttgccacctcactgggttttactaatttaattttgaagtagattaaatatacttaagacttttgtgagatgaagacatggtcatggtggactatttcagctagggggataacatgggatggcactgagggagtgtggtcctctgatactaggcagctcagggagaagggtgtgggcaattcactaagagtgaaagatgaaggctaacgacttgggatggggcatgtgaggcagacacaggagggtagaaataggatgctaagaaattaaaacacctagtacagactttgcagggagtcaacccatcacaatttgcattgtgcatttattttgccaaaacctccgcaaacacttctgcggagttataatgacttgttgaatttcctttaagaaacttgcagctctattagaaatgaaagccaatacagtatatgcaaataggaaaaggaagcaatcctacatcatggaagaagataatgagatactgctactacagggtatcttggcaattgaccaaaatatatgaaatgttgctattttaaatgcccttccatgattcaactagctcagttacctggtcccattgaagtcttcctttatcccggcttcggaaggtacatggggaggcttgaaaagaagaacttttctaaggatacttggtaaaataaaggaaggcattcaatttgtctttcttttaccatttgcaatcaattttttaaacaagtgacttcaacgcccagaaagaaaagtcaataaaggtgtatcactatctaacaaatcattcacattcctcttcatagtctgtcttttagatatttaacagcttgtaatgactatgattttgcaggcacttcccataagctatatatgcattattaataaagttctatgactgaaaacttccgtcactgcaatgactcttgaaaagcataggtttattcaaatcaacaatgcatagtagtttgtcacggttttaacatatgcattcttcttgcagatggttgaaaaagaaggttatctgcaaaaagctaaaattgcagatggaggaaagaaactaaggtaataaaattctttaattcacttttatataactatgctggttcttcatatgctaaacttgtgccactgttattgtttgggatgcaagtccctatggtaccagactagaacagtctcctctgctactgctatgatcaacattatttttaatggaactacagtttttaaagaaaggcactacattctatattgtcgaacagaacacataaatgagatgctttttgtcctccttggacttgaactcataaaacactgaaaataaataagacaatggattgtgatttctgtgattgaaagattagagaatgaatgcattcatctgcaatacagaaaagtctctatacaataccttgtgagaataatttcttgaaggatggaagatttgaaccacttttgtagctcaaaatagaaattgataaaataaaagtaacatcatattcagaggtgagagaaatttgaaaagggaataagaaccttcagagaacaataacaacaaaaatcttgaagaaaaaaagtaaggttgataggacggtaaagaaagatgataattgtgtggtatataccgtatgtttagaaataatcacctccattttagaatttttgctatttctcgtattggttctgttacatatttagctttgtgctgggtgatatgcaagttaccaaatttgtagaaaatgctcaagttgagagacaaggcatttactcttaaatgtattactaacaattaaaattaataggataaatgtactaattagctacacaatgggacacatgttagttgtataatacaattcattactagaatgacactctgggtcaacaccagagaataaagtctgcttttgtttgatggttataatgaattaatatatttatttaaacaaagtaaaatttggaggggggtggagaaatcatccacaatttcactacttaaaatagctatttcagttgtaaataacaagctctattttctctccatattgtgtcttattctgggatagtgaacaaggccttaaatctttgcctggactgtttttctggagtggccctgcagccaccttcccttgaagagttcaggagagagatgcacaggagacaagatcaaatgcaaggttgctttaagagatgtggctagtcccttccccagtggtgaattgggcttagagaattgggttctgaaggaacaacaggaggaagtctttgagtagcccagcccgagtgctctcctttcccctaaaccttatcatgaccttatcaactcaggaaggagtgtggagggtacaatgatgcctctccccaagatgagtaagtcatgaccctttcttccctcagcagccatgtggaataaagagtttcttcaaaattatctaagttagccagttcagccctccactagagctgagtaggagaatagaggtgacagcattggtcagttccaccctccagcctcatgcaaggaagtaggggagatcctaaatgaaataatttcaagaaagcagaaggaggttctactgtgtggttttgtaaagtatccttgtccataacccctctgtaaaccaaccttataacatacagaaggcagtgtcaagaggaagcagagaagaacaggtcccttcccccagccaactcacatgaatatgtttttaggtagttttattcaatttgtatactattgtgtttttgttttatttgctgttactttcctgttttccgtgttacagttaaattaatataaacatttgtttgtactctgttttattatttcactttgcataccattatgcattctttcagccttttccacttaaagttatatgttttagttttccttttttttttttttttttttttgttgctgctgttgttgttaccccaggtgcacagaattgagctgattatatccttcggtttgtggccttgtgctattatcattctgggcaagagccctagctggttttattttattatcagtctccaatccttgcttcaatcccttgtagaccttcattttaatgtatttaatgtgtgtttatcaaactcattctccatatatatctatatttagctgtatatgtggcattcaaaaaagaatgtatagttgtgtatgtgtgaatgtgttctatatagcataaacatttttgtatcataaaccttattatgtttcttactactttcattcaatgttagctcttgggcagctttctatggtgctatagagacatgcgtctcttaatgatgggcatatgtcctgagagatgcatccttaggtgatttaatcatcatgtgagcatcatagagtatacttacacaagcctagatggtatgtgatatagcctattgctcctaggctacaaacatttacagtatgttgctgtgctgaatactgtaggtgattgtaacataatggtatttgtgtatctaaacatacctgaacatggaaacgataatgcattgcgctatgatgttatgaagactaccatgtcgctaggcaataggaatttttcagcttcattacagtctcataggactactatctatatgtcgtccattgtggattaaaacgtttttatgcagtgcatgaacgtctttaaatctagttcatttcttccaattgctggccactttgccatcgtttatgtgtagtcatgtgccacatggtggcattttgatcagtgatggacagcatatacagctgtggtcccataagattataaaactgatgcctactgtaccttttctatggttagatgtgtttagatatacaaatacttaccactgtgttacaattgcctacagtattcagtacagtaacatgctgtacaggtttgtagcctaggagcaataggctatgccatatagcctagcgtgtggtaggctttaccatgtagatttgtataagtacactctgtgatgtttgcacagtgacacaatcacctaacgacacacttctcagaatatatcctcatcattaagtgaagcatgactgtatatgaattgttacttatccagtctcccagctgtggacatctaagttgcctctaactcctttcattccaaacaacatttcaataaatcgcacatatatgtttcctttgaacctgttaggaattttctcaggggaatatttccaggagtacaggattgctcagtggtaagtcacatacatttgtaaatctactgactactgttgtcacactttctcctgaatgagtgcaccaattcacaccagttcaatgtgcaatacagaagggattctactttccacagttttatcagcacgtagcatcatccaatctaattatccatagaacattaccttaatgttgcttttatttgtgtttcactgataagtattgaagctgaggatcactttatctgtttagagacattcagattctgcattctgagtctattcataaactttgactattttctattgagtttcctgcttttttattcaataatttgaggaaactcataatatatttgggataataatgctttgtcaattttacatgttgtacatatcccctccaagtttatggggcttgttttgtttttattgtaaatacaaattgaacattgtatatgtaatcaccatgtttaagaacatgataatcccattatgttgataggctataatatgccaaatcatccctacctctttttttacttgatttttaagttgagtctggttttatatttatattaaattatttgtattagaagttatcattgcaatatttctcctgttgcttgtcaatttttcttttatatttttgtctgttttttgagacaggatctcactctgtcacccaggctggagtgcagtgatgccagcctcctccacccccatccatccacccaccttatgcggggataaatgagtagctgggaccacaggtacacaccaccaggcccagctattattttgtatttttagtagagacctgggtctcgccatgttgctcagaatggtttggaacccctgggctcaagagatccactcaccttggcctcacaacgtattgggattacaggcgtgagcaatagcacccagccttcttttatattttctaaagacaaatgctaagcctgcattacttgatcaaatcacacgaccattttaaatgaatcttagtatgcactgccatattgcttacccaaggagtgtatatgcttttatcactagcaacaaaaatggtcagtttagtcataaccttgaaaaattatgtagtttttatcccattgatagtttagtaactaataaataatataacatactataatttatgcttcttatataaaatttgatagccttcatttcatttatcaaggacctttgtatcttttataaattttaatgaattaataagcaatattaatagatgcttactctgtcaagcacttggctgaattctttatcagtaatacttaaatgatactacaatatagactctattattgcttcctattgtataaatggagaaactcagtcaacagtattaacctcttatttctcccaaatcttattttatatatagttagtatcacagaatttagccctgacctctgcttgaaacacgtttgctttatctctcttgctttaagctatttgagactagtgagcaaaaatggtcctcttatttcatgccatcaacagtaccaggtacttcaattgtcacttaataagtattattttattaatttctatcaagttttctacttataaatccataatagatcatcataccttgtattgtcttcttattttccttctttctcttcttttttatgtgtctttatttgtctctttaatgtattttctctttctctcaaagaaaatttaacttatctctgaatataagcaggagatggtaaaaggaaagataaattattggctatatttgacattcataagaggccatacctttagccttattttgaaatgaggttatacacatttccccaacaatacactgacaggcttgaaaacagaatacattcagcattcactttaatttttaattgtgaacactgaaactatgccttagcttatctgatgaaccataggaatttcttcatttggggaattccgtccccaaacctgtaagtaaccctggcttctctgaaactctatgacaccttagtaaaaagttattttcaatgcttacatttacaaaatacacctgacagtatgtttatgaagtctcagcaccacaaactttcttctccctcggcatctaggtcttcccgtcatcagctcctgtgtggctctgcgtatcttaccacaatatagagtcacattcttctctccttagatggacatagaaagatatacttgggggtgaaaatatggccagaagatggctacgaaaagaaatgcagaaaaaagattgtgcagtggttacgtctactagtgcctgctttcatcctagggcccatagctactaggccttcggttgggtttttgtttgtttgttttaacagttgttattcagaatggactttctttggaatgtgagactaaggtgtgcgcctaacgtcatcatattttttctttagtagtttctgctcagtatcgcaataaattcttccaggctgaatctttcttcattttcttgcaatactgacagagatgggtatttttacacctcagtgtctttttgacccaccttttagcagtcataaattacaagatgcttagaatatgagacagaagaagtaagttcctagaccaaccagtttgagaatgagtctgtacgtttaacagtgtctgagtgattttgcggtaaatcaatcagggacattagaataaattactttcactcccatcactggtgtggaatcaagtcaaatccagcatgaccaagttaggtaacaaaggcagatggaccaaataagagaacctgaaatttgtcaaggaacctcacatatattttcttctgactttttggtttgccactctgtcattacctaaagaaggcaaaagaaaggtaagcgtaggatataaagcttttggtgtttagagcaaatgaatgtgttaaacccggagtttaagctaacagattcttataacggtaatgaatattttaagagccatttttcatcaagcattttccagataagctgttacaatcaaagttgctgttattatgtgctgccatccggtgtccattttgtagaatgccaagctgatggctttgttgagtttttgtttttgtttttgttttgggggtgttttgttgttgttgttgttgtttgggctttgattttgtttttgtacttctatttgtctgctagttttttttgcatttttccaacttcacaattcaggatttgctttagggaagttttatgaagtgtttcacttggataaaatgtcccaccaattgcataaatggtacataaatgccctcatagaaatttagttctccctacttcccaattgtagttagcaccccttttccccttagatgtaatttgttttgtatgtcaaaagataagataaatacctgcatttctttttttgttttgttctgttttgagactgagtctcgctctgtcacccaggctggagtgcagtggcgcgaacttggctcactgcagcctctgcctctctagttcaattgattctcctgcctcagcctcccaagtagctgggattacagacacccaccaccatgcccatctaattttctgtttttagtatactgggtttcgccatgttgaccaagttggtctcaaactcctgacctcaagtgatcaacctgcctcagcctcccaaagtgctgggattataggtgtgagccaccgcacctggcccaacacttggcatttcttgccctaggatttgtctcctgcatggaatcactaggatcaaacccttacctgattgttacctgtaaattcctgtggaaactgatggctgtctcccttactcttggcactttggactgtcttactaaagttagatatttcctgaactgtgtgtcttagttacccctttagtctatccaacaccttaatttttgtctctctgtggaaaaaatagaaaactattctctcaaagttatgatgaaatgtggaggcactgattggtcagtgggtgaatttgcctgctgaccatcatgataggggtggaagacagggataaagggctcgcagttcagcattgcaggatggcccaggtcaggctaagacatggctttgctccaaagagaaagagattctagtacttccctgacaagtgttccttatctccccctcttagctcctctcatgaggctctcaactggcatgctcagagtgactacagagagagctgcatgccacctgctgagagaccatggagacactggagtgagcaggggcctgaatcccatctctatggcttgttttcccttggttaggatgcaaccttactgggcttcagttttctcttctgtaatatgggagtatcctaggctcattcagaagacttggtttccatgtttattgtccatcttcttgtagttagaagtacagtttttgaggaatgtcttattttccatctcttttcagcccttagaattgtgtttggcacgtggtaaatgtttaatggagacatgtgaccagcttagtaattaaatcacatagtgcatataaaatgccaggtggcatacctggaacagagcagaagccagtgcaagctcagcgtgggaagccctctggagaaagctcaggtattggacactagaagcataaattaggaaaaaatatcctatatcagaagtgttcgatagttaagaaaaaataatgctaagaataccttaataactactaggaaactaaggaacagagaaaggaaaagaaatttttcagtccttgttaatgacgaacagcaaacataaagcagaaaaaatctcgattttttctgaaatttgaaaggccatatactcttttactcaaaaaatctttaataatcacctactaaatgtcaaacagtatgcccagtactggaaatgctcttaagaggagagaggtggtttctatttctttgtgggagcttggggcatagagggacttcctagtgcaaaaactgtgtttatcctagaaaatagtctatttgcaaagtttcctcagaaactgctggacacacctatcctggctaaggcttttaagcttgtatgagttgcccacttcctgaaatgtcacctaatatattgaataagggtcatatatagtgatttggttgcgtatagaaaatatcaaatccttaagtcaaggtaaaaccttgccaagtgatcctttgcacactccagagctgacaatgccttacgagagagtcactatgttaaagtaattgggtgagaaagctattcccctgatatgctaagaactatgggcaacacaatgggtcagacatggcagccataaaaaaaggatgagttcatgtcctttgcagggacatggatgaagctggataccatcattctcagcaacctaacccaaggacagaaaaccaaacaccgcatgttctcactcataagtgggagttgaacagtatataaaaaagaaattattctttggccattgttgtaaagtcataatgtagttagggctggcttcaccggtgtgcgtccagggccccatgctcagaaggactctgcccttgatttaatgctagattgttactgtcttaaaatacttcataatttttggacacggaatggtgcatttttattccgcactgggctttgcaaattctgtacccaattctgtttttcactggcagataggtgtaaactcatgtctttcagttattcaaaaaaatatgtattgaggccctaaaaagtaaattaaaaaaatttggatttaaaaaaaaacagcggccgggcgcggtggctcactcctgtaatcccagcactttgggaggccgaggcaggcggatcacgaagtcaggagatcgagaccatcctggctaacacggtgaaaccccatctctattaaaagtacaaaaaattagccgggcgtgttggtgggcgcctgtagtcccagctactggggaggctgaggcaggagaatggcatgaacccaggaggcggagatttcagtgagcggagattgcgccactgcactccagtccagcctgggcgacagagcgagactccgtctcaaaaaacaaaacaaaacaaaacaaaacaaaacaaaaaccagacagcataaagtaacgaacagattataggttttggagctagagaaactgggtttaactttaaatctaagtgtaaggccttaagttaccctttgagcctcatttttcatattagtaaatagagatgttagtactttcatcatttttgtgtatgaagctaagcataaactagatgatcaggtttacgctaggtattctaaataatttatgctaattattattttaaaagaatcatgggaaaaaatcgagatgaaagaggacatctaaaaggttgtcagcagcattattattcttcgttttgaaatgaaattcttttcaagcaataacactgagcccatggaaaagctttcacttttattcagagaagatagacagtgtttatagtttataaattcaaaacaaagtagcaccgtacataaggcgtcagagcaagtcatgttgctaaggttttgagacctgcagttcttaccctcttcagttttttcatccaattcacctaacaggcacacagttcacagcagttcaaagtccttataaagaacaatgagataattgcgtttcatgcaacttcagctctaaccagttccatttccaagtttaaggatggggagagtttttgccagcaagttctataaatgatcaacatctgaaacagatccaaatcagagccatttatccaggacttactatagataggatgcaaataaggtatagtgtctccttgtgagaatatgaaatgtatagtgggaaatataataggtaggttaaatatggattcttcgtgtgtgagggtgttctgtactccctgaccacgtatggtcaaaataagggtggtgttaaaagatgcccagactagacttctaataatctttctctttttcctgtttggagtaatctattattatgacctgaatgaagagaaggctattgctgcttcaattcactctgctgctgctggtacctaaaaggcaaaatgggcactagggcagaaggaaacgtctgtgtggttttctttctgggttttgttttttcatcttttcattatttaattgaaaaattgatactcttcatttaaagacaagtgggtccaagaacacagtgtttgtatttggatgttgaaaaatacacattgtgcttcttgtgtgtctgcttattctgttcttttttaacacaatggtgtatcattaagaaagctccaggcatataagagcaacctaattctttttgtaaatattaaccttactgaatcaaagctgtcctttcaatcaagctcttagtttctaaaagacaagtggaaataaattacgcaaagatcttcaatagtcatttaaaaagtattttggtgtggttttctattgacctgaataaagtctttccataaacttaaaaaaaaatcacttttgtgaaatgaattcaactgttttgaagtgaatgttaagctgaagcaaactgcagcaatatgctctaatgggtagaaacttatgtatattaatctccttaatatctttactatctacaaaagagtgccttcatgacatgaacatatatatattctaactatagaagcaatatgtgttcaatgcagaaaacttggtaaacaccaagaaatacaaaggagactcaaaagccgcgattttaccacttgatttaactactgtcatatcaagactttttttccaggccaaagttcagtcattgactcaatacatatgtattttgcgtctattctgtccaaggcaccatgctaagcattgtggatacctttgtaaagatgaactgatttctaccatctcgaggctcatttcttaatggaggatagaggtgaaatttatgaaaaatatttttaaatttatcataagtgttatgagaggaagtcatggaaggcacatatgacaaagcaatgttttgacttctaattaatggaattaataatcagaaggagtgtatgggtgaagaaagtcctaggtaaatagcacagcacggttataaactacgtgtattatggtctgcattaaaaccttcgcacatcagtattcttctacagcatagggttcattattccattatatggacctattatatgcaatttatttaacctatcttttttatattttatgtatggaattaacaagtaatgatgcaattaatttctatgcatacagactcggcaatttgtgagactatttctctagaataaatttaaattcgtagggaatggacatttttagccaaaagatatacacatttttagggatttttaaaaagcacattttcaaattgcactccagaaaggaagcaacagtctgcattcccaccaatagtgtatgagagaatctatttcctacactgtgattatccctagatgttatcagatgttagttcttttattccttgacaatttgatgtacaaagagggaaaaagcatgtcactatttttatttgcatttctttgatttctagtaagattcaacattatgaaaatattttgaattaagcaatgacacatgaggctggttagtttttaagactgaaatacactaaaccaatgaagagaagaaacaatgaaggaaggaataggttctgattcctatttttactttgctatttttggtttgctgtaaaaacataaactttttatgggaaggatgcacatggatacacaaaaaatggatttttggtagttgaaaaagatattaggaggatctataaattaagaaattcttactataaatgctgtacttttaaataattccagaatgtctttattattacccaaattccataccacttatagattttaataaagaggagacttttagcaagactgttaaaaataaagatggtctctactcattccaaatgttgctcatactgtatctataaatgatttcttcaactgataatgctttctttcccttttatttttttgtcctaaggaaaaactggtctacttcctggattgttctttctagtcgaagaattgaattttacaaagaatccaagcaacaggctctgtccaatatggtaagtaattctctgtttctattgttaaatatcttttcagaaatattgtagaattaaaagtttggttttatcagaaatcacactaaaacctccaagctaccaacatctgaaaacagatggagaaaatgactcaataaacttttaatcagatgaagggaaaatagaacttagtgtctgttttattaagtggtgcatttggagaataatcacaaaatgagatgtatggtgagcagctatgtagtaatgcgaaggtaacactttaaattaaggtgccatttataaatgccttattcttatttatgaaatgatcactaaatgcagctacttgctcaaataatgtattataaagtatgttataaaatgcattagtaataaatgcttaacggatgatactatgggaagctgttttaaagaatattataagacgtaaatcatattaaaccatgtatgtgcatctttaatacatgaatttaagttggtatctagcatgctataaagtgcttcagacattaataaataataataaactgtttataaatggcaccttaatatagggtattaccaatgaggaaacactctaaattagccaagtgattttttatcttcgtctaactgtgacgttcactatatccagctaacctttttgaatatttctatgactccatctaatggagctaatacaatttctgtatcctgtagttattacaaagtgaaatttgtagggtttcttccttgtacctggaggagggcctcacatatacctacaaagatttgacagtgataataagtaagagcaattcggagccagttactggggcaattcaagctcaaaaccttgctgcccaaacacaagagctaccacaagatgtaggagacagtgggcaggcaacatatctgacagcctcctgattaggaaggactccgggcaggaactaacctgccacagcccatcggcctgatggatgataaggaaaggggtcgcctggcaggagttacccacaatgaactaatttgtatttgacaggtaataaaacgatgggaagttctttgctctccagccactagttgtgtttgctatgtaatcctctttaaatagaaaatagaaaatcatttgctaggagatttttcttaaaagaagattttagtaagaacaaaaggtagcatttgacttgcttctgataaccgcagtagcctttatccccaagtggcttgctgattttggagtctcagtgctgtccgatctgtaaactaattatgaataaattaaaaatatatctcagtcctttgtatttttaatttaaactgcctcagaaatttgttttagggttttattttgtttttatttttggatacagtaaggttgagataatctttttaaggaaaataaagtacccctaagggccaggcacaaaacaactaccatccacttgcaggtcctttgtcttccctttgaatgagctctaagggggaagtcaggaggggaggaaagtcgctggccttgctgagtttggctgctgaaaagatgatcttcccctgctgagtgagaagaattccattgggaggagagtttatgcgaatgtgtgggataatgggagagataagattccatattttaaagcatttggtttatttttattttattattttaatctctttataccatgagatataattatcagctgttaaattttatacaggtgaaagaaaactccctttttgattgcaggcaaatcttgcaagttagctcactaattgcatgcctctcgttcaaccttcagaactgttgtaagttgacaatagacttgacttgtagaagaaatttgttaacattttcctaggagtccttatttattacttctggccccatttttaatgctcttatggtttctaccaggcactcattgtcttcaaagtcaattcatggcaggaactaactgtgttttgtggtaatgggtaagagaattacagatttatgtttgtgctgcatgaattgacttgctagtcaacttcttggatccatttctaacccagtattaaaggcctagtgggatagcccacgtttaccagttccagtcttagagaaacgatacaacgattgccaggccttgattaaagatgctgtggttttattttgaaagagatttatgctcaagtttctgaatttctcttgcacccccttagaatttttctggtgttgctcattgtgcttctggaaaaaagtctgccctttcctcctaggggtcaagacaagctgcctgagtgagtgcagaatgtgatttaaaagaataaatggtattttagtccttatacaaatgatctttaagtgttaatgcagcagtgagacaaggcaacaaaaccagccagagcagttttgaagttggactctaggggatgtaattcctttttttttttttttttttaccactcattagctgataacattactcacttctttgagcttcagaatccttacctgtgaaatgggcatagtgatacctgccaacagaattagtaaggaatgaaattaattggtaaaaacaaatacataatgaacaaaaaattattgtgctttattatatcatatgctattaaatacagaaatataacatattctatagtacacaatagagagtataattatattattacattagttttgtacttgacctgattcagacatttatagaagagagaatatactaattaattcaagaaactccatcatgcatgacctccaaaagaatgtatccagaagtagcataaaatgctgtctcagagcaatgactaatactgaaaataaagccagccatccatttagggctctagatgttaacctcttgaatgtccatacaaagtttcccggtgcccccatcttcttcctttggctcttacccttactgttttcacatttaatacagcatgttacaaagtattctgcctgaccccacattctgtgtttggttactttcctttctcactgaagttcttccagttcatatctgtcttactcagttaggactgctacatcaaagtaccaatggctgggtggcttaaaccacacacatttatttctcctggttttggaggctgggaagtccacgatcgaggcacaggtgaatctggtgtctgctgaggtcctgcttcctcatttgcatctgtcctgtcttctcactgtatcctcacatggcagagggcagaaagtgagagagcagacgttcgtgtcttttcacataaggccactaatcccattcatgagggctccacctttatgatctaattacctcccaaaggccctacctcctaatggcatcacactggggtttaaggtttcaacataggaattttagagtaacacaaacattcaatccttaaaaatatccaagtcacatttttatcaaaagcagccttactgtgcaaataagcacagaatcactttgcttattttcatagagattcataggtacctcagtgagttagtaaaggagaaggaagaatgacctattctgttcttgttttatgaaaaggacattaaatcgtaactgaccacctactatcatcagcattttataacagaaaggacattataaaatacccaatccaaaaaatagaaaggataaaattatcagaataaaagacaccctttaccaaaaagaaaactgtcccccttatttgcctaacatactctctcttttgctcatcaagacaggtggatcgggactggctggtcctccagtgaggaggaaaaccactcgtgtccctagatccagatttcctgaattatgaaggaaaggatggtgttcatattctcatatttttaatgtatttttatttataactcacttaaaatattataaaataatacagaaaccattttaagtaaaatgtataaaacatctatgtgtatttttaataggtatcaatcaatcacctgcataagcactacccaggatgagttatagaccctgccagcccttcagaagccccaacccctatcagttgtccctttgtcatcatagcctcttcccttctctggagttagccaagaacctgcgttttagtcattatttcattgcctttcattattttcaaacctatagctatataccttaaaaatataatttaggtgttttttaattcatataaatggaatcctagtgtatgtttcttttgtttcttgcttctttcactaagtatttcttgctttttctgtcctttaatattttatcattccatttttttcttttctctactagtttgggaggatacactttgtttctgctctgttagtatagttagcctagggttacagcattagtacttatcaacaaataaagctagtgtgagaccctttaccttctactaagatgttaccttggaatatttttaatcaatttatccctttctcaatgtatatgttattaccatctggtgttttaatttttttaatatcaccagacattattattctcttttatggagtcaatgtttgtttacatttgcctaatatttgccacattctttgctatttatttctccatgaaccttggacttgctttctaggatcactttttcttctgcttgaaatatattctgagaaattcctgtgctaagggtcttgcagggacaatctatctcatagtctgcttacttgaaaaaaatctctatttctccctcatcctagaaatatatattctctttgaatatagaatttttagttggtagtcattttcagtcagcatgtcaaaaatatcattacactgtcttctgttatccattcttaaaatcaaatcacctgttaatataactgatcttttctgattgctcataatatttttctcattacctttgtttttctacagtttcatcatgatgcatacagatgtcagtttctttttatttttcctgcctggattgttatgcttcttaaaattattgattgctgtcattaatatatttcaaaaaatttccaatagctatcttttttttttttttttttgagatgaagtctcactctgtcacctaggctagagtgcagtggcatgatcttggctcactacaacctctgcctcccaagttcaagaattctcagcctcagcctccagagtagctgggattacagacacgcaccaccaagcccggctaattttggtatatttagtagagatagggtttcactatgttggccaagccggtcttgaattcctgacctcaagtgctctgcctgcctcaccctcccaaagtgctgggattacaggtgtcagccaccgcaccaggcccaatggctatcttttcaaatgtagccctttttacattccctctctcatttccttctaaaccttcagttaaacccatgttaaatttctcactgtattctctaaatgctttacactctcatttttcttatatttttgtctttctgagctgcattgcaaataatttctctttaggtatcttccagttcttctttctccttaatttcaattattgtaatttttatttctagaagtttgtttcttttaaaaatgtactatgtatattgttagagttaattttttcctgcaggcattttttaagactctattttattttgttataactaggaggcatagttgttttataatctgtattttgtgattctaatatctaaatttgtgtcagtatgtttctgctggttcttatgttgctttgttttcttgtgtgtctggttatctttgactgtgtgctaatcattgttattgaaatattatcatgggaggcactctgaggcctaggataaatgtgtcctactccagagtattttagatttttctcaggaggtttgggacattcccagagactgactatctcaatctaaattaacagtataaaactctccaattatgtctacataataggagggccgtagctatcctgccacttctcagggacaagattgtgcttcagtttttcttattttcttattttacattgctcatctaccaaaacagtcttctttatatttccttcggtttggagaaaggccacaagtttaatatcggttctcccttattctttataacactttggccaggaccttgctccattattctgggtttgattgaccaaagctcaaatgtgtagtataaacaaatgacctcaggaaaaatgcagttgtgttactttgatattcagcttccctcactgaattcatattcccacccctaaaaaatatttacagtggcagtcccactgtcttttcagactttcaattcttttaaggggtaattttaaaaagaaatattttatccagcatttttattgttttcagtgggagaattgatccaaaaacatagcttctcattgcaatctacctcacttcaagttaagtatgcatttggttaatcaagtttgtgctatttatataaatcttggtgggaaaagacttcataagaatatgtattgaaattctacaatgaacagcttgctcgttagggctacatataaggcatagagatataatcaagatatagtctttgccttataaaatctctgccaaaaaatagggtgagatgaaataagaaacatagtagagttgtttttttttttttttccactgagattttgaagaaggcgagctcacatctgtgaaagatttgaattgggccttgtaggaccgttataatttgaatatgtggagatttgtagggagggagtgcaggggcataaaaaacatgaacaatggcataaaactgagaatggacagagcctgtgcacaacaaggagaaatgaatttttgttttggtttgaagataggataagagaaaaggattgagaagagtttcatggcctgagatttgctgagtgacaaatttttaataagtagtgttagcgttctccaggtgtcttcattctggaataatctgtcatggctattgttttaacaaacatatactgaacagcagtactagtcagtggtatgtgtcttaaaagagccaggcctattgtagggccaaagcaagagaggatgctccttcttcgaggctcttcatctcatttactgcagaagtgaaaactttttcctcaaaagcacccacactagtgtttgtttcatctggtgctaaagaagtactagagaatcaggagttgtctgtttgatttatcttctcaggccttgactcacactccttgtatttttcaggtacactttcctattttagtatcagtgaagtatttcaattgactctagcacttcatttgcagcttgactcctaagtacctgctgtactttgtgattttagagcttctgcttgatgtgttcaggaggcacctgaccatgttcatgggatttggcaaatctccatttttggttaaacaaaacccatttgatggattgcatcatagagaagaagctctgcaatttagaacatccattcatttattctctcaacagttaacaactcctaccaggtgtcatataatttttttctttttgttttgttttgtttttacattaggggcaacagaaatattcaaatgaatagtatatgatccctgctcttaaagtactcacaatatggtaaaagagacataattttgtataggtttattataataaaaccatgactaaagtgttaaaaaatattagacaacatgccatggaaccatagatttagctataggtagtctttttccagagaaactattgttgcaagtcatgttcagcttaggtatctctccttttgttcaaatattactgtttgatattattatatcaaatattattgagcatctcttatgtttaagtcactacgataggtgttctgaaagataaaaaatgaaccagactgaaacaaatagaaagtatggccttagattgagtatagtgaagaaatggatgttggtagttgtcctaaaatggcatgaacagagacatggcgtcgttttatgataactcaagagaagagtgtgattgcttccatttggacaggatttgaaatatattcatggaggaagtgacatttgagcacatttctgaaggatgtataggattttgatgtaaaagggggcaaaagatattttatgtactaataagagagtaattaatagtgaactatggaaaattctttttttgttgtttattttacagatgtatattgatctcttgccttcttccatgcactgtgtactagtcactgttcttgaaatgtttgaatgggggttccctgaggcctggagtgaatatttcctagtccagagtattttgtgtttcttctctaagttgcctgggagtgaggaacagctttagactaagttgcggaacagcattgtggaacagcaaacagtgtaatttggttagaaagtcagtgtggaaccggtttaggaaagactttgaacaggattgggagaagagatcatttcattctgtaggtaatgtggggtttttgtaaccaatatgaaatattctcaaattaagagagactcagagttttcagagacatgtttagggaactgatatatatatcagttgtctataaaattaagtctctcttaattttgtgtatatataacttaaaaacacatgcaggacttggtaaattatccgagagacatgttctaaaaatttatgcaaatagatgtgagcaataaggcctgagctcttacgacagagaaaattgtaaaacggctgtgtgtcatcattttggctcaatgcatttagtaaatcacaggacatcttttcactgacaaaatattttgatattctcatatgtctctgacctccaacagtatggccatttctaaagacgttctagtgcaaagagaacaagcagagctatccatctaaggagagcgaaaaacatgctgtcccaagaactaggtgtgtcaccatctcagtgagcacccgttgcaaacctactggtgcttccatctgactccagaacatctgtttagtgtcacaccctacttaaacaaatgcattgtgtgaagtctttccaccaacaatcagacgctgtggaactcattgtcaccaattgggtggatgagagccaccgtttctattatattcatcacacactgctcagaaaatttagtgtcacttttgatataaattcaaaaacattgtaaacattttagggaatattttccccctaaaatggtgtggttctaaagccagtatattcagtagaaagcctatatgttggttgtgtaagggacttttttgttactcttatgttttttattttacattgtactaatatgtatttttaatcagagccaacaactggcaatttttactttttaaaaattatatttttgggttttacatttaagtctttaatccatcttgagttaatttttgtatatggtgtaaggaaggggtccagtttcaattttctgcatatggttacccagttccccacatttattaaataaactataaaaactctagaatgaaatctaggcaataccattcaggacataggcacagacaaagattttatgatgaaaatgccaaaagcaattgtaataaaagcaaatggtgacaaatggggtctaattaaactaaagagcttccgcacagcaaaagtaactatcatcagagtgaacagacaactttcagaatgggagacaatttttgcaatctattcagctgacaaaattctaatatccagagtctataaggaacttaaacaaatgtacaagaaaaaacaaacaactccattaaaaagtaggcaaaggacatgaacagatacttctcaaaagaggacatatatgcagccaaaaaacatgaaaaaaagcccaacatcattgatcattagataaatgtaaatcaaaaccacaatgagataccatctcacaccagtcagaatggcaattattaaaaagccaaaaaacaacaggtgctggtgaggttgcagagaaaaaggaacacttttacactgttgatgggagtgtaaattagtctgatcattgtggaagacactgtggtgattcctcaaagacctagagtcagaaatattatttgacccagcaatcccattactgagtacatacccaaaggaatatcaatcattctattataaagacacatgcacgtgtatgttcattgcagcactgtttacgatagcaaagacatggaatcaacctaaatgcctgtcaatgatagactggataaagaaaatgtggtacatatagaccatggaatactgtgcagctataaaaaggaatgagatcatgacctttgcagggacatggatggagtggaaatcattatccttagcaaactaacacagggacagaaaaacacacttataagtgggagctgaataatgagaacacatggatagagtgtggggaacaacaaatactggggcctgttggaggtgggtggtggggagagggacagcatcaggaagaatagctaatagatgctgggcttaatacattggtgatgggatgatctgtgcagcaaaccaccatggcacacatttaactatgtaacaaacctgcacatcctgcacatgtaccctgaacctaaaaatggaagaaaaaaaatgtatttttaaaaagtacagtgtgatcttttgatgcatgtatacattgtggaatgattaaatcaagctattaacacttccattacctaattttttgtgtgcaatgaaaacatttaaaatataatcagtgatttttaagtatataggatgttattaattatagttaccatgctgtacaatggatctctagaatttattattcttgtctaatagaattttgtactctttgagcaacatctccccatacccttcccccaaacccccagaccctggtaagtactattctactctctgcttctatgagtttgacgttataaaaattttacttttaataacagaaaactcttccaaggcatttaatgaactattaacttttccaaaccactcattcagccataaccttgaaagcaaaaatgggcaacataaaaggcctcattaaaataatttgttttcagcctggcccacatatcgagaccctgtctctacaaaagtttttttttaaaagattagttgggtgcagtggcccatgcctagaatcccagtactttgggagcccaaggcaggtggatcacctgaggtcaggagtttgagactagcctgtccaacatggagaaaccccatctctactaaaaatacaaaaattagttgggtgtggtggtgcccacctgcaacctgagctacttaggaggctgaggcacaaaaattgcttgaacccaggaggtggtggttgcagtgagccgagatcccatcactgccctccaccctgggtgatagagtgagactctgtctcaaaaaaaaaaaaaaaaaaaaaaaaaaaaaaaccacacatgcacacatggtggtcatgcacctgtaagtccagctacgtaggaggtcgaagcaggaggatcacttgaacccaggtgtttgaggccgcagtgagctatgattaagtcactgcactacaggctaggcaatagaatgagactctgtctctaaaaaaataaaacaaaataaaataaaataaaataaataataatttacttttaaaaaatattgtttactttcaatatgagtaatgaacacacacattaattaaataatgcaatatatctaatgctcattcactgtagtatgactttaacaacaaaatgaacttatttatggaaggaaaatgatgtgatttagcaaaaagatgaaaatagtttcaatcagaaagctattcatgaattattgagtattccgtgcaaaatgaatatggaatgattttatctttgtagagtgagtattgagcccttattcagacccctgcttaagaagatcatgaaaaaatggaggggcaaacaaaagatctatcagccttagactaatgaaggcattttaaaatctctgtttaatcatttaattctcataatagtagtactcttgccacatcagcatggttatcattgatgcagtatgttagtatagctgtagattgcaccatcatatggcctcatcaaacatttaatgattaggaaaaacaagttacagttcaaaatctggaggataatgggtagagatggaaatacagagaagaaaaaaaggaaattaaagttcagtgttttattaatgtaaactttggaaggaaaaaatcaagtgatcgatattgctataaatgaagccatgttctctggttatatttttttctagctttggccattaactataataaattctgtaacttacataatttttaataaccacagaaatccatgaaattgacaggattctttacaaatggatcagagcttactgtccctcaataaacctcaccttaggctctctcagaaaactgttttaattatgaagcttgtctctctgtggtttatcattttggccaatgaaatgcatctgttttggagcttgcatttctctaagataaaatgagcttttaccccacagtgtattttttaatttatagagtatatgtatagtctttcttaaaaattcactactaaattgaaatgctctgagaagcagtatcacattaggtagaaacaggggctttcaagtcagatcacctgggttaggaatcctaggttcatattttacttgctgctctagtttattttcaaatattaatgataaatttattttcacatatttattggctatctcaactgcaatatgacattaacaagggtgactatctcgtagaactatatgtgagaaaattgatgcaatgtgcctcacacagagcaaacataataaatcttaattgtatttatcgttgtcgttattactacatgaagcaatagagtatagtggttaggagtagtggcagatgagggaagggtaaagggagaatgtgggaaagatctgcatgtgcctagaagtcttttcgctcacattccagtggtaagtataaataattggccacattctgatgcaaatggggctgggaataaagtcttcagctggcaagctgcttcccaatgacaacacaaggcacttgaagagggagcacaacacacattttggtggagaacgattcacctctgccacagcgagagcagcatcagtggtctcaatcctggttttctggaatacaaagcctgaattaagagcctgactttatctgggaggtacaaatccaggacaagagagtgaagtgaaaaggaagtcaggccagaagtgatgggcagtggtacagggatgttaccatgttggctccccactacaatgagcttcaaagagacggagagaaaagggtctgcaagtacgctggtgaaagcttaaagcaatctgtgggaggaagggagcagaagaaggaaaaggaatttatctcccatatttcttcccatttcctgcacttttcccatttcctgcacttttgattaaagttcaccacccagagtcttcacttgcctgcttcagtcggacctgcctcagccatgggaggctactcagaaagccaggtcccactcctgcaaagtggcatttcatctaaagtaggaagtggtggaaggagccaaaggcccttctatagtctggcagcctagggggaaagtctggtattccaagaaggtggctggtcattctcaagaggtggactgcattgcccaggcagggctggtcatctgcagggacagctgaggttgactgagtggatgacagtctaagaggaaactctgaggaggcacctgagacatcaaaagtgtacccaagctattcaccttgcagaaataaattgcctttttaatgtaaatgtaagactatatcagttgagaaatataatcattatatttattccagcaagattttgattcagaaacaaatacaataggtgctcatttcttgaaaagtgtagaatactttctcctcaaaaacaaacaaaaagcacataacattctagtgcccacaatcactaacaaaggtttatttttctgaaaatgtggtttgatttggtcatgtaatatactgagaaatttcactgtagaaacaatttctgttattattaacatcatttatattcatatacataaaacccacatcttataatcaaagtatcctcttttatgttgacaggggccatactttagacattaataagatcaggtatccattcagccctctttcctaaatcattttgcccaaatgagaatatataaatgagttttatcctcctccatgaacgattttccagaatcaaaaccagttatgtgataaaacttaattcctctaaacagattttgtgtttcgagtttcaaaatgataaggacaatctgagtctatattctggaatagcaattaatccaaaataaaaaatggcgctaataacctatttcataaaatccgagctttgtctctctttttgaaccacatctagtaataagggtaagaggctgtgcggccaaatgatttgtggcctgcgtatatgcccaatcttcatcatggaagctatcatcaagctaaagagcatctggcctttgatattttcttaatatacattaaaagactatggaccccaaatatcccataaagaaaaatgggaaacttaatcccacaggtttaatctaagtcagagaaaaaagtattacagagaaaatactcttagctattattgggaaatggtgaagatagacgaagagaataataaaaatcagaagtgcaagagacctagggtcaatttttaatgacttcacattcctctaaaaaagaggcttttatgttttattgtccaaaagcagtaactcttaaataattctatttaagtattttaaaaatcagtcatttctattttaagtttaccccagaagaaatatggtgtgtacattcttagatttaaattcatatttagtcattttttaaaaagtgtatttttataatgatgtagaatatgatccattggcatcatgctgttcattagcagactttttcttgtgttttatagctgtagaatcggaaatatgttttctattaaaggattctttaatttcaggcttcttgaataaaatcttgattgtcttccgaataaattctacaacttttctgaactacttattccaataagtagtttaaatgtttaacatttaaacactgagaatttcttctaataatctcgattccctaaaactgctcttcaggcataggtctttctgctgtagctttgtgaaaatgaactacttattaggaccatttttacacaatcctccagctacttattctagttttctctttttaaagcgaatatatttattattacttaagaactttgtttttttatctgtcatacttttgaattcaccccaaatctctattagctttgattataccatatgatcagttcttacttaaagttggtataaaatggaaatattattccatatgtacttctcactttgtgaactgtcattctgagatgtattatttatttttatttgttaatgcattggaatcaatccagatatttttcattgtcattctctatccagttcctcaattatttcaatagttcacaaataactgttgaacacttatttggggccactttgctagattctggaaaaataaagaaccataagtcaaacccattctcttactggatagctaggggaaaaaaaacacaccaaaaaggagtagcaatgtgtgactaacaagagttgtaacacagtatgtttcaaagtaggggaaatggtggaaggagtgagtgactacctgcagagggaaaattctccccatggatatttttatttttttaagttgtgtcttgaaaatgagcaagattacggcagatggtaggcaagcagggtagattgaagagagagataaatgtatttcagatgaaaagaatgaatgcatactcaaatcccaaatgtctggcgttgtgaaaacacattgcattttggaaactgccacggatgtagcgtagctggtgtgaagaatgggagaacgcatagaaccgagagggatggttggaggaggacagaaaggagctcgtataccttaccaagggatttggacactatcccgtagataaattttccataataaacaatgtgaggtttgtgtctcacattgaacgaaaaaaggtcaaaatacagagaatgaattgcaagggtttttgactggccacagaggcaagaggtagaagaattcttgtgagagaaaataagaactctactgaggttaaggtcatgagatggagaaaaaggaactaattccagaattcgagactttgtgccttttgattatggatggtgaaagaaaggagggagttaagaaactttcaggtgaagtgagtgaagggattattaagcaagacaagcaatagagaaaaggaggcaggtaggagaagaagataatgatttcactgaggtgactgtgctacactctcatggtaatgtagaaaatataattctgacacatcagagggagctggaggccagaggcacccattgaggggtcaacatatggcaggtaatgggacaagactaggggcaagaccaaaacccataggaatcacatgagtgaggagaaatgatgagggcctagaacgctaaacctggggttactaacatttagaaagtgggaagaggaagaggactcagtggaagaaactgaaagggaagagtataaaaggtgaaatgcttccatggccaagaaacaagagggctctaaggagaagggccaacagaatctaacagtgcagagttcaagtcagatgcagatggggaacaaggcatcagattgtttttgttgaccttaatggttaagacattttagaaaagtcaaagaaggaagtaaatatcagactgcagtgttgaagaagagaatggagtctgagcaaacagagaacatgaattgaggagaaggacaaatctggcaataacggaaaggaaataagtgagattgagaaaaagtgagggtgtggagttgatgcttgcttttcttcttcttcttttttttttttaaacgggtaatgaacatggttagaggctgaaggacacaatctatttgagggggagaaagtagaacgaaatgtgaaattcttattcttggacaactcaggaaatgagggacaagactggatgaaattaggaactagagataaataagccttgggcagaaggagtatctcttcctctgaggcaaagcaggacatgccttgtgagtcctttttgtgctttatggtactgacaggtcaggtaattttgacactcacagaggccactgtcctgccaaggcatgggagtttattagacagatgggccagtcacagccccagaattttggggctggaagacaaagtgggaaatgacacaggaaaaaaatggaaaatgtgaattattattcttggacctgaaaaagccatttttaggtgaactagtaggaggaaaaaatgagtgtggaggggaggccatggattccattgtgatcaagaactttaaacttggaatccgataaaagtaaattcgtatcagctcaggcactttctaagtacatgaccttatgtcaagcacttggccgctctctgcttgggtttcttcatgtataagttgaaagcaatggtaatattttcaaaagattgttgtaagaagtaaatgagaaatcaatattaagctttcagagtgcaatagaggaagctatcattaaactttatattcatttgtttatttggattacacagactaagtatgaaagtgggaagagttgtgactgttccagcacaagggctgtgatctccatgaagtcagaacaaaccatttcgtggggtggactcataagggttgaagctttcagagagcagtggcaagaggaagaagagaaagtgactaggaacacatacaaagtatcttaagcagagtcaaaggcccagctgaagaaggtagacattatttgtaatattgctaccctaagtagtcaaaagttatttctccagtattcggggatatgaggaatattatggaggggcaagcagatgagagcgatatccttggaggagagggcaggtggagggggtggttgaagtgactgtggaatcaggaatataggacctgaaaggaagtgaagccaggaaggaattcagagactgggagattgcacaaaggtcaatgattttaatagcatcagaaacacacggataagaaaatctccagaaatggaatctgtcagatgagcagcagaatgaaaatcactgaagtggagacaaggtgaaggagtgagattgtaaggagtgcaagagacgggcaaggtcctggagaggatggccacagacagggtttggattgtgataaacccgtgccaggtactgtggaatttgccttaggaggctgtagggtaaacacacctgatagcaatagcttaacaatctctttggaatgaccctctatggcagacacacctgaatgtgtgtttcaagctagggaatccaggaacagctaacctggagattcgttccttgtccgtgaggaacacctgagccctcatccagtctcgtggatcacaggctgcacaggggaatgaggctttgagttttgggttggatgaaggttgccaggtggaggtccttaaggggagggctttaagtgaaaatgctatataaactgcatgctggtagcaagaggttgtggttttcctgcccagccctccgccactgggctgtggagcccgctgctgctggtgcattcttgtacgtgaggtgtttctcctgtccagcctggcaccactggcctctttccccggtatgtaaacccttaaaatcccatatcttgtttgctggctctgggtctcgtctttggcctcttgaacctcagccctattgggttaataaggattcagcacaacagatgctgatgagaacattttgagattgacaaagctagatgatgagaaaactgtaaaagcttagactgttttacccacaggtttcctttagctctatagcatatggagtttgtaggtaattatacagaaatctaaagctaatatgagatttttcaaggaagagtcagtatctcccttatccctggagttcagggagcccagcacagtgggtaacacattgacacatagtaggtgtgcaataaatgttaattgagtgactttgtgtaatctcacatttaatccaaatatgagtcctttgaactgtttctcacttttccaaatcacaaagactgcttaaccatttaaaaaaaatacaaatcttaattgctataaaattgggaattttaagacactaaagtcttccttccaaagcacaaaagctagttgcattttggtatttttccttcattcatgaattcagcaaatattcattgaacaacaactatgtgccaggcactgttccatacattgggaaaaacagtagaggaaaaggcaaacaaggccctagctcagggagcttaattctagtgggggaaacacagacagtcagcatataaaaatatatatgttaatttcagttaggaggagggctgcagtgaaattaaaacaagtagtgggatggagagtaaccaggagtactggagtacagctcttttatataaaagacagtcaaagaagacctctgacaaggtgacatttaactgggaactgaaggataagaaggagccagccgtgtgaagattgggaggtattccaggtaaacaggtggtgtaaaggacctacggcaagatcacgtttaacagagaaggacaaaaacaagatgaatatgtctattctggagtctagtgagaaagccatagcttttcccaaattcttacatgtttttagcatatgatcacagtgtctattcaatttttaagggctgcatcatggttaagaacagtctctgcagtgacactgcttggatctaaatcctggcccctccttttctagctgggtaaccttgaggaaatttacctaactattctggcaggttttcttacctacaacttagtgatgataatacctacctcatacagttgtgaatgtaagatttcacagaatcatttggttaatatttattgcacacttattttgtgtccatgtgttagccacagtgctgggccctagaactccagaggcaaggaaaatacggaatcttcctcattttagccttagacttctgtataattgcccacaaactctctatgatacagaggttatacactaaacgaattatcaataattgttgtacgtaggtaagtacctggaacataaaaagtgcttcttaaaataattatacctttttaaccccctgacttgactgtatgggaaaaataagccattttgttacgtactcttaatgattattttcgttggttctgagtatcccctaatgtaattaaatctataagaagcatgttgttgttaatttttctacatcataaatcacttgacaaagactatcattatcatgctttgaaatctaaaatagtgatcacctgggtggcagagcgtgggtgaaacaataaaaacttttcactgatcaaaatctctttaaggagcatggctcattttgatgggtttctcctgaggttactaaataacaacaacaaaaaaggtagatatgctatcaaattctatcctgccggctgggtttatcctgtaggaaagttatacaatgtttcaaaaaaaaattcagttgccagaaaaaagtctcataatttaccataaaaaaacaaatttctggcttctgaaaaagcctatttatgttgaacttatagaattggatataatggctaagaggcaacaaacatggacagaatatgtttttaaaacatatttaccattctttcataatttcatgttttatcctaatgttcataatgttaaaaacattggctaaaaatataataagcttcatatactaaaattctgaagtattttatggacaatgacttgagaaaagtatggaatctacagagaaacctagaaaatttatctgtggagaaacttcttgaaaaaatagtaaagaaattctcaactggtaaactttttaaaaaataattggcggtatggaggtatgccaatgtaaagttgtataagtatgattaacttgaatcaagtgaaaatatgaaaagacaaatgtgggtgatattcctattgattattgtgaattattgaaataaaaaacatcttttaagtaatacccacattgtaattgtgtaataggaagcacacattttaatccttttggtctaagttaaatttaccaaatgaaattatatttgtgtgtatagtcttaaagtctgaaaagtgaatttctaaaaggcatagttgacacttaataaatatgtattgaatttgctaacatgtgaaacacaaacctgaaaggggaattggagattaatccacctgctcaattttctagatgatgtagtcagattctaagcaactctactatagtcgcaaaactaaaactctgtaacagttttttgcattgcactatgatttatcaattttttcttttactgttaggtctaaaagtaatataacttaacatgcttttatgttactttagacattgaagagcaatattccatattactaaatagcagattttaaaactttcattattcttaaattactaaagaataccatctcaaaatatcagtattctagatattaatttttcctatggtttatagttaattaaataattttaaaaataagtctgtaattttagacattgaaaaaaattaggtcccaaatgaaaattcctacaaattaggtttcccctggggaaaacaaaaaaggcattatatcataaatatgtatagctgctaactcaataaactcctatttctctgacatctatctacagtgttgcatcctcttattcttacttcatttttgtgattacagaaaactgggcacaaaccagaaagtgtggatttgtgtggagcacacattgaatgggccaaggaaaaatcgagcagaaagaatgtctttcaggtaagaatgttacatatattcaatttattcctattctctctaaatctgagctctcttgggtaactaaaataagactaccttcttgtgatgtgctcatgtacatgaactcgttgtctgaaggtcatgaaaggcgactcctcttcccagttgaatctttggttttgttgctttttttctggcgactggttgctatctaaacacaaaatgtatgttgcacgttgattaatataaacacacaaaagtcattgaagtttgcagtatatgcgatagatgtctggagttcaaacatgggatgtttgacttaagtagatttgatctagaattttcagatgcacacaaactaagactcaccaagtataagctatttacattcattgacactcttgccttctagtcattaattacatttaccagtataacttacaagaatggagagggctgaacagctataaaaaatagattctttcatattgcttactttagttttttgaaaaaaaaagttgattaataattgcaatcatattcgattgaatggcaagaaccagatgaaatccttgagagagataaaattggaaaatgtaatttcacacgttaccaaaatcacctaattgcgtgatttatctggtaattaataatttgagatcttggagtttgatttttgttctattttatatgaaatttaattttatatttccaaagtaaccagtaattagatatattttagaatttatataatttagtagaagagagatagagtataataattattttttaaattaaatgtcttctgagagcatgttggcccttgaataaaagtcaattcttctactcttaaatgctttgctgaaattaatattgggtcctatggaagcataggtaggtgacattttctaccgacactctcactgaggggaagaagctggtttccagttcggtttgtattttccagatgctattcaggtatatccaaataatttgggtccataaaatattttaacacattctagaataaattacttttctggttctagttttattttgcttaggtatagagattttttatcaaacaagaaagtgagagaatatatgcaattattatttgtcaattaaaaataaaatttaaaaaggaaggaaggaaataaaagggagagagaaaagatagaagaaaaccaaacacgcttgtcctgaaatcaatgctctaaagctgaaagtgactaaaatgtggctttacagaatcaagaaggagaaataaactttctttcaaagggaggaactatagatcagtgacttcccctttcccccaatttcttactcttattattctaccataaataacagtttagaggttataattctagccttatgacaacttagatgatcaacataagaagctctgaagtagaccgggaaagctcagtggtagagccttattatgtactgtgaatttagcatcctaatcaccaaaattgtaaaagatgttgaaatttgtcatagacattattcttggacaatagcaattctttggagatgggctaagccagcctttttcagtttcttctgttaatcttatgaagagttaaattagttcacaaatgaggatgacagtcagctatatttgatgcatacagggctgaaaatattgatgaaaaaattatgtatatttttatataactatgaacattatatgcacagatagacatttcagccacctatattgacagtgtgtatcatcccaatcttttcaggatatgactaatcacctcctgttgcaattttctatttgatttttatatttttgaatgtagatccttccaaagatattaaaaactattctcacttttggtagctttctgaaggtgaaaattttgccagctagttttgtttgtaatgtaattgaacagttcatggggcctcagtcttcttacagacgctttatttttttttagtcttgtacttttagagaaacaagaggtgatcataaggatattgtgaataacaaaccaaaagaaaagattcaagtttcatgttctgtttcattctttttgagtgaatcccttggtttccttgtcgtgctgaaatcttttcatcacctaaatgcatgagttttggtaaaactgactaatacatatccatagatacagactatgagagtaagccttttgagaggaacaatataaatagcttctatagttctgttaacaaaaaagcgtcgggaaggatttgccagagagctaaatctagatgacttgcatcaatatttgattagatacattagctggtcgaactctcaaatgatcagaataaacatgattatgtcttaaaaacatggtattaaggcattgttggacgttggagtgtatgtgtgcaatggtttcattacctgcagaataatgaagtgtttcttcctgactgaaaaagaccatcatagcttcagctgatgtgctacattggaaatagctttagaattccaagtttgaattaggcttggtgttcaatctcagtctatgaattatagattacagatagcaaatgactattgagatttttggttcaaggaaaatcaaagaagagcaaaattagaaatattttaaaatttgaaatctgtctttaaaaagtttgatggattagcaattgtatgccatgtaattacaatgtctgcagagaagttgaacttaaaatgaataggaaaacaaacaaaaaattgtatgtgcctgagaaatgttgcaagtctcagaagcacacatttgtgacaaccaaaaatggacagatttcatttatttcatttgttcatatatgctgtttggatgtttgagttgttttctctttgtactgaaatccaaattttccttcctagttgaaatcctatcaaactgttgacatggactgaatcttatttgattgctatgtggaaacataacaatgacaacattaattattaagttttggtattcaacaactttcagtaaatcagaatgatacttgctaagtttaagaatatctgcatattttataacagcacactctttggcctaattggtacttcttaacaataaataataaaagaattctataataaagtatgtattagatgttataatttatattaaaatatatacatgaatatacatgtataaaatatatatacttatatacataaaatatatatgcaaatatacatatgtatatatactctacctgtgtgtatacacacctaatagcttgaccttaggaaatagagtaagcacttccacacacaaacacagaaagatagtacacatttataaaagatcatacaaattctaagttaaagtggtaaatgtccattgctgctaacttttgtttaattctgcatttatgttcattgtcaaggactgtcacaagtttgatgtagttcgagaaacctttagcaactcagctataacgagctgggtacgcgttttcttagttaacagcaacactaggtcttcatcagggatagagtgaataaaaagatttatgttcaaaccacatgttttaaacattcctgctaagtgctagtttgctctttggtgtttagcctgaaatttaaagcactaaggattaaaaggattacaacataatcttaaataatcctaaatgtcatttacagagagatagttgtaataactaaataaaaccatgtgaaaggatggcagcattgtcaggcagcctccctcacacaagcggggctactgtcaccttctgtttcctggctgggcatgttaggcagttacagtctttcaataagaagttcaactgagaaaatggctgcaaaataatttagaacaagtttgtttaaaaaaaaaaaaaactcttatatcttgtttctaagttgaaggaaatttttcagttaggttttgtcttttcctttgaacacaaacctttctgagttaaatattttggaaagcctagggaaaggaagttcgtgacatggctatcaaatagacaactgatgtatctctaaaaaattccccaatgtccaaggagatacccccttattaaatatgtgagagtctcagagcactataattatttccgtgtcattaaatttagtacttaaatatcctttacttaaatattctgtcatgcaaattagtcttgtctccccaaagaaaatacatagaaactatatcccatactgtcttctacttattaagccagaagactgaacactttttagctgaataattgttactgctaagggtacagttgcattcctttaataaaacaaaacaaattcactcctattaaaaaaaaaaaagttatttgtatccacaatataggccctgtactccaaaatttccagggtgtaaaataggaagtaaagatgaagaagataactgtttcctgggtctttttcattacaggttataagacagcattatttatttaagataattaaatcatttttactctaaaaatttaccttttcttagagccagacagtgactggcctcagttttcctgagcttcctttaaaataaagtttttaaaaacatacattgggctcttctatagatttcatgctttcagtaggatatttctgccaattaataaatcatggctgattaggaatatgtcaattacctgtttgctgcttgaaaggcagaaaaaattaaatgactaaagaagaggaaagtctgttatcctccccccgccaccaccaatttgtaacctcaacaaatatcatggtcacatttcctggatttgagattatttttcaagattctttttcaatatattaaaaaatagatctcgggggacagattctgtccctaaaagtaaacctcggaatagatttattatttatattacttctctgactttggatggagtcttctgactacaatgtatattaaacttttttatgtaatattctccatggatatgcattacatttaaacataatttgatctttctgatctgaatatgtcttatcttaaaatgtttaagtactacttaagtttattaatgtgaagataatttaataacatcttaaaaaaacataattttaagccaaaaggaaaactactggtattgtgcttttatccatttccttgtgttacaagtggtggtttaaaataaatccgagcttttaccaattttctttcatttttcagtgcttgtagttagactaaatgcaaaaggatgattcttcacattcatacatgcattagatttccagtaaagctggtttcactttagagaattaaagtatcttaaaagacacggcattaaaaatagaccagagtaagagaaacattcacgtctaacacagttgttttttgccctacagcttgtccccaatcatttcatctacctattagatattcatccaacattcaggaggtgcagtggagagaacacatgggtctggggatgtgtgttccaatttgggctatgtcagttgtaactttatgcagaactcacagcaggatcctcctccaactttgtcacaccaaggaaataagagatgacagtcctcacctcacctgcccatctgtgttaatactaaaatgaagcaatcctgtatgtttgtttgagagcaactacaaagaagtgattttaatacaaatacagcagactttcattattcatctactaaccacatcatctcacaatgttttgagggaaattccagatatgaattttagaagaatagggttgagagaggtaaatatctgtgaaatgtaactcaaaatttctgctctacttctggtctttctgttgccttctgaacttaatagactgatatttaatacacaacatgaaaatctttttattgtgtgactaagaatatagatccttaatcttatttttaatgtgctattcttagtggcattaatgtaatatccaattaattaatcaatgacatattcaaattaatacttaaaagcatatcaccttgaaagccctaccaagctgttaatagaaacttgcaaaaggtaacatagaaacaagtgtagcaactatgccccaagtgaaagagggacaatagtgacacttattactcccctactgaggtatcagtacaatactgtttttctgattgaagggaaagagatatgattatttgtatgatgtttagcttcacttttgttgatgcggtcacacagattttgcacagagggaggcataaaattttataattagagatttgatttaagaatatgaatgtcaggggtatataaagattgagtgcaaatgatagaatctggggacaggaaataaaattgattgtaagaatctagatgagatcaagagagcatgttagctttgactgatgaaaggagaaacagaaacaagaagatggatggaaagtacattctgcaaatgaagaacatgcctattggttcagataatgtgacttgggaaccactgtctttttgcacgtttaattttctaagaaataataaaacttttttaaaaaatatattctagacatctagaattaagatttataaactaagtgtatcgttagggaaaacaacacgaactttatgttgcctgggtgatcccgtgaaactcactagtcaaagccttagacatcaaggatgtatgctcatttgcacaccttcattgtttcattactagagggcataatgctgccttactagattcattctttttgaactatcaaagcagcatgcaaccggatgacagtaaagattgaaaatagtagtattagtacattttggtccccaattagtgaagggaaccaaaattttgtaattccaaaataacataaaacaaaagaaaaaagtcaacttggcttcttctgtttctaacatttcagcagaagaatggatgcacgtcatctaatgaacttagacaactggatagctcacttcacattgccttctggaatagctggctatgtgagctcaaagatatgagttgtgcagttggaataaattctgggttttagtctgacaccaggctaaatgcaccatgctgttcttcatttaccgacatcatattgtgaatcccttcctctcatggaacatattctgtttcttgatgatttggtagagctagtgtggtagtctctatgccatccatgggctcctgtggcttgcaacgcactttctctgttttcccataagcagaatgagactaactgagccacatggagatcaaacctgagacttgacacgatgcactccaacctgggcaaaagaaaccactgccactggggaattttatggagtaaggtagaatcaacaagtgtatggtttttctacttgttattttaatctcatttataaagtatagaaaatatattgatgctagcaagacaatattcaagccaagggatcctttttcatatctgtttcaatatcttttatttttaaagagagcagccatgtgtatttcatgctgtgtatgatttttaatagcaaacagacctattccagaaaaaggaacaatttaatccctaaagctggtacataatagatggggccagtaaatggtatcacattttacagcttgtccataaggatgacacaggatgaaataaaattgagtgcttttggatagcataggatcactggctgataaatagatgacgctattcagtttttagaaacataaggtaatgaagctggatctgaaagcaagagaaaaaatacatatatatatatatgtattcagtgtttatatgccacaagccactgagcaggaggaaaatctgggcagcggtgagcaaagctgaaacctcagagcaatgtttaaagcaatataagaaaataacaaagcaagcatccataaacaaaggcttgaaatgcacagaaaaataagttcaagatgaaaggaaaatgcccacacttatgcataactggaaaggccacttatggcatctatgcatagagtctctcaatgtaagagttaaacatactactaaacatttagcagaaaaaaaattcaaaaggatataaaacactgcagggcagttaaggattcttggtatttgaagaggggaggaggctgctcttttatcttaacaaaacaggatgttgagaggtggcctaagtgaaacaatgaaatgaaatggttgatgttggggagaaatcaggaaggaagctgtttgaactcttttcagataacactgatgggtatgagatggcttaaccaagggagaggtgttcacatggagggtttagatgcatttctttttagtagagagctattagattcttgacctcagcctcatcaatttacctaacattgcatttccggcactgggagaaattctaacagtctcactttctgggtgaacaagtgtaaactaaaaaaattacagtggcaaaattaacaaattgctgaagcaccttgaaaacggaaataccaataatgaggattcctttcccaagtaacttagaaagaccttgattgtggtctttttttttttcttgaagttgaattttaagcaatgcttcattttcaaaattcccatgcccttgatcaagtaaaaggcaagcttctgatatttgagatctgcgatagatttgaaatcaattcatggaaagggaggttacgaacatactcttttgatgtgtaggatgtactgataggggtggcagaaaattatgtgaaacccttctcttttgacagctatactggaacatttacaaccacagatgttatttgtccatcagaaaagaaaatatttgtttcaagcttcaggcattttctactacagtatcaatatgaaattcaacctcaatttaatgtttaatgcatatgaaaataaatatttggagggggcaaatactagaaaacaattgaaccccacaaaatgtaactagcaatatggaaaaaaatgctggcttcattacgagcaaatttgtccttttactaaagtaaggattgttctattattaacataggaaatcttagatggactgcaaagaatgctgcattattcataaaagcattgctgccatctggtggctacttggcatttcaacactggcttctctgattcggtttgactgggtgctctcgggaggtatttaaagaagagctttaagtggtaaaatataaatgtggacatcctctggccctacatgtcattcatctgatggcagtcctttctccctgtcttgtcgtggaatggaggattcagggagaggaaatgagatacttggatatcttttgtcctgaatgtgaaagtgtattttacatggcttatctaaagaagttactcttggctgttgttgactgatgaattttatcgacattcatttctgttggcaaataaataagtatatacccaaatattaagaaggtttattgaatctaaagatatgctattttgcttaaataagaatatacatgagatgctttaatccctcatttggatctaagcatgaatttttttaagttatcagtcactgaatttgactttagaaataatataatttagaatgtcaaaaaagaaaatgtacagaggttcataaatttcttcccatttattcaattgttatattaaaatgggaggattgttaatgactcagaaactcgtaatccttcttcatgaattttcaagttaaatgacaaatattattcagttcacatcgcactttttgttgaaaataaaatagttaaaatttaagaaattttgatgattctcaagcatcagtgtattaactcattcttaacaagaaccaattagaattaggatatctctgtaattttagtacggttttaagtttccaataatcgtagaaagtctccttggtatgtaatgaaaaccttgaccctttaaatggctatttatatagatcacaagtctttgaagattataggagataatgagttaaaattgccccaggaggaaagctgaagttttcttctgaattctcagggatgatatttaatagttaatattcagtttctagtgaatatttccctgtatcattaaactgccttctgatttagtaaaagtcagataacaaagaaccattacactaaatctggagaattatatactgaattaatattatcctttacaagaaaatgtggaaatgcctatattgaaagtaagacttttgggttttatttttaaatttgtgggtaagattttcaatctgtgaatacatacttgatattccctttgttactagctatttctaccactaaaaataattccttcttcaaaatatgtaatttggcttatggaagaatgttgctcatcttctctaggaagatggctcgattccccatccttcctctgttctccattctactcacatttaggaaggatatgaacaacaacaacaataaaaccttgcaaagaaagtaaaatcgataatgattatatccctgtctctttcatctgtaagtataaaatttcaactaaattattctcctaatagacttggatacaaccctgtggtggtttctaatggctccataatagagatagtaaaccttgtagctatggtcaggatgccctaggttttagtcataagttgctaatgtttgtttcaataacatttgctctttggcagcttttacagctacttaacactaaattcccatttagtcaggaggatcattcatatactgtaatgaatgatgtcaccttaaatcctttactatgtaattgctggatgttacattttatagtggggcatttgatggtgtatttgtttatgctaaattttatgacagtgacagctgtatcttggaggaatgaccttttttttttttttttttttttttttgagacggagtctcactctgtcacccaggcttgagtggagtacagtggcaccgtgttggttcactgcaacctccgtctcctgagttcaagcaattctcctgcctcagtctcctgagtagctggtattacaggaacccaccaccacacccggctaattttttttttttttaatatttttagtagagacggggtttcaccatgttggccaagctggtctcgaactcctgatctcaggtgattaccagccttggcctcccatagtgctgggattacaggcctaagccacggtgcctggccgacccttttcgttcataggaatctagtttcaaatctttttaagcaaatagtttcatcatatttgccttctggcttaggctaggttcccctgaaagaaaaatttgagactaggaattgtgtgcaagcagtttatttgattgaagaaagcagaaattaagaactagcaagagtgaaacagaaggaagaaaagccaatgcagaacccattattgagttggtcatagggtagctaggacaacttgccagaattttccacccaaggatagacaagatgaagcatttgttcattagctcctgagcctttggtttctggttgcctctgggtggggataatgtctttagatcttgagtttcaggctgttcatgggtgggcgtgtcaagaaggctctttcaggtttcctaccctgtagaaccaggaaatatccacagcagatagtaaaagatgtgtaacgcgtgctgaggcaagatgcagtcagtacaaaggagttgaagtccacacagaactgttgcaccagctgcagctgtagtgacacccacacagctaagaggatgtgaagcagggcacaggaagcatctgatgcaatttaccgcttgcaatattcaaatttacttatctcatgttaaatctaatctgttgccatgtcttcaaaatgatggctggcctcaatctctacaaaagagctaataaaaatgtttttgtttaaaaaataaaaataaaaaagctccactcctccactgcaactgtgtatgaggccatatttgatatttatcatctaccaccttcactcattctagattttcctcatcctcagccaggaggagtttagtcggttttgtttgtctgaaggagtcaatcggacctttgtatatgcggggtctgaacctttgattttttttttttttttttttttttactttgtcacgccctgttcactgtagttgacagttcactgctctcatcaggcctagatgtaccacaagacatctcactgaatcatctgacttccagattcattcttcctcctgctgctgtgcatatgcaaccttactttctcattataattagggtcagctatccccatgaatatagtagctattttagttgccctcttgtacacatcatgagtatccatagttaccatgcagtggtcacagctttgagttcatgatacttactaatccctgttagaagcagaactctcccgtatcccaagaataagaatatctaattcagcagagccaaagttgcaaaacccagaagcatacatgctgcagataggttactacgggggctactcttactcctaccttttggtccttagacccacatattccacctactggagacaccatgtcatgtaacatcatgtatcaatggtgtgccatgcattgattcagtgaatatactgcaacttggaatattgaacccccaaaaaacaggatcctgtctccaaactactacctaagcagacactttaagaggccacttcattattagatcaggttgatttcttccaagtgatgtgacatttagtaagaacggcagatcttaagatcacgtgcctggtgtttcatttccctcatttccttgatttcaggcaagatcatgaatcaccccacattgctaattcagcattcttaaagatctggaatggtagggcaggcagagacaccataatcagagaaagcaaacccatagaatgaatcactgttcccccaaggatggaaggggtctgatgttgtcagtttgctgtcaaacacctggtttgtcctgaaggggtcagtatctgcctctgctgctggaagatcatgtaatcagtggtaggtagccttggggagaaaaagccatgatgttgagtgtgtgcagcatctccatctctgccacatggccactccactcatgggcctattgtgcatgttgtaagtgactaaagagaggctaaagaacttcaactgaccagtcatctggtacattggcttaccctctggtagatgtagacaaggatctgcatgctctggatacattcttatgaatcttctaacatttcccaggcttcttgtttctaatctttcagactgtctccttccaggcctctaaagagcaggaaaagtcaccttccattgcctggaaatcagtctatattctaacctcaggctaccctcctctcaagatggctgcttgcctctctgtcctgtgggaggatttctcttcaccacagtcctataagatgactgggtgggtctacggtgaagctgcagtcttttttttttttttttttttttttttttttttttttgtgctcaccaacatactgagctaacccatccatgaatcaggcttgaggttttttttcatcattcatcagctggcttcaagcatctccatgaagccctaggggtgaactcagggagaggcaccagtgttaacagtgacaagaaaaatgggaatttgagccatctgttcatggaactttcttaatccctctagacctgtttaggccaaattctgaatatagcatttcaatccatggattgttgtccactctatgattcagtgaattcaaaaatacccaggtcatcatgagaagctgaagccatagagttgtctgatgtcatataattagatattccttctctattctgacccagcaataggccagaagctacttttcaaatgggaaggatatttttgctgtggaaggtaaggccttcctccagaaccttaaagactttcattgtgaggctgttagtataacctaccacacactccacagtaatattatatttcactttctcactaaattttctgaatcatattcccaagagtcaaggagctcacatgacagcctggacctgctgcaggcattggtagttatgaatagccaccctggtatatgaatgacattcagaaatactcctattgtccaatctactaacttatctagtaatgacagtcccgggcttgtggtcatatcaccctatgagaatatctgagtgaggcccagattcctgattgtctgcaaacagtggcagttttaaaccactaaatattgggccggtttgttacagagcaatagctaattgatacaagtaatatgtctacaaatacagtagtttgatttttacaagaaatggtgacatatttgaaagtcaagttcaaccggtattaacggaccttggaaaaaagataatgagaccacagttcttggtgtcagcttctaataattaattaccaagcactagctccatagaggcttgtagagaacatgcaggtggtgccatttcatctggtcatgtagcttttctgttactcagattgtttacagaaatagctgcctaacaaagttaacttctaggaaggatgccaggttacacggaatcataccagagtcttagaatcacattgggctttcacccaaagtttttgcaacattaggtggaggcaatataatttggcttgaaaagttacaagggaaaaaaatgtcagaaaatgctcatggaacagggtgttcagagtcttcaagataggatctttcttggcctcctgaaaatcagagaaaattgtatatctgtgatttttttttttttttaatagaacgacccaacagaatccagggttgtcacagatcattattaggccaacaactgtagaagttctaaccccaaaattgagctgtaagacataggagcagatagagctacagttggaaaatctaaacatagtctaaaagttttggcgcttcaagagcttctgggggaaagaaaagaaatttgatttctgtgttgctgatggaaaagctcaaaaattacctgagaaaattgtatttgacatatttttattgcaaatggtattttgctatttgtttctaaaagttgaaaatgaccttgcacgttaaaaatcatcagtttagaaaaaatatgaagtctgtttgcatttggaattaagtattccaataatttcttaaatttaaaaactacacatagaaagtgttattattattttggagagttttcgtaggatattccaggccaatgatacttatctgggtaaggtgaacatgcaattcttagacttgcctttgttaacttttagtttttttccttcccaaaatatataaacaaaaaggtttaacttatttctttctgaatttttctgacataaataaacccaagataagcatagtgtattcatgttaaagcttcataacgctaagtctgttctgtcttggactgaaaatttatttgaattccttcaattaaattaaaatttaaagtttcaataaaatatattatttctaaatctattttaggttaacttcaggaatagaaactgatgaaaaacagggggtaaaattattcagttacatcaaactctaggtgttaagtgattttttttcagagttattttcgaaactgtgtgttcagttattactttttcatagtactgagtagagctccagaaacttggaagagtcagttttcaaaaatatctaatttatggttaggaaactgaataacagtcaactatttcccattgtttcccactaagtcctttgttccacagttactttaaataaattttctcacttcatataaaatgcccttttgataatactgtcaatttatcttctaaagtcaagcaaaattaattttttcaatataatacaaatcaaactatggtgaaaatttcagtgataggagaaggtagctgaaatatatttcaagtacaagctctaagcaagtaactaagacttggattatgtagagtgcttactttctattggtgaatactactttgctgggccccaaaacagggcagactaaaggtggttggtagttgccattgtatgaaggtagattgcttttacaaaagatacaatttggaaatgatatgtatctatgatatgtttcttattttgttcacttagcatatttaagtttacttattaaaaatgaaacatttctgagataattttctattttaatgactccaatctgatttagagacagagagatagagttctccttaaattattttgcatagggtttccattgtatggacaaaattcttatgctttttttcataaactttgctcaggattcactcatgtttctaaataaataaaagataaataaaaataagttaatgaagaaaatactaacaggacaatacaaaggaccaagtatcattggagttttggtttatcatagttccatgtatggcccctgtatcagccaaaataggctaaactatgctttgagaacaaatttctgttgttcagttccatactgtcttcagtctgagatccaggttgatggaatagtctctttctggaagggtgtgacaagcaacatgtttgcctttaaagctcttacctgaaagtggcatatgtcacgtctgtcttcatttcatgggactaaggaagtcacagagccaacaaagcacaaatgcataatccctccatatgtacagtgacgacaggaagaaacactagttggcatggtaaagaattgtagaccctaccacagtccctacacaactaaatattcagatcacctgctcaatctaaataaaggtttgccatagttgttgttgctgttgtttaaatgaggcaaactttgataaagccattccagagataaaagcacatttaacataatttattgagtacttgtaattgatggtaacataatgactgatttaaaagaaccattcagctcctttgataaacactgttaagtgtcaagttattcaacaacatatgtcaacctgcatgccgattcatatctatttttaaaatttggaagtgttgggaatatgggaaatttgcatcaataattatttaagtccaaggcagatgcataaattataggagctgaaggtcaaagaattcagggtgaaataagtattttctgaaggtgacaaaaatgaggtaagggttgaaaagtatttgctttcagtaattgaaatatgtaaatgggtttagtcctttttccaatagtaaatgaatgtatgttatacatcatcaaatgaattggtattctattcacagatatttgtataccatttttaaagatataaagtgcatacatatcctacataaatgtttttggcatgttgggaaatgctctgctgagaagatatgctgttgagtatctttgttattggaataattgttttttggtatacaaatatttagcacaaaaaatattttctctagctagttttatgaaatatatccatgtgggcatgtatactaaagtgataatattagaatggatcacagatagaatgatggccattaatgtaaattgctcaatagaaagaaaaccccacattttgcttgggaaaaaaccatctgtattttcagaatgaggcataaacctcatttttaatgctctagatttgttacaacaagtaaaaactactctaattttagcaaaagtaccaactagagtcagtgaaaaatgattgcaattcaactctatgtatgtaactatcatggcaaactaattttatagagtgtagttttttttttttttccactttgaagagattggtgttaaatcctatttttctaatgtagagcatattggtttaaaacaacaaacaaaaaggccctcaaacaacagtcccagtaaaccaagttgcaattagctgccactcctgggaaatattctaggatatgtggctggcacttgaaaaatttacaccttctgaggaaaagcagaaaaattctgtcaaacaattaaactgattggaattcccaagaatataaaaaaccaaaatgagtcttatgttagaaaagaatgggaaatagttctatatatggctgcaaattggagcagaacaagtaaaagattttttgcaccttgtataaatcattttttttctttagaacaaataggaaagtcaaggaaaaactcattgtactagtttatttttaaaaattacacgttagagtttgaaaatgtaattagttaaattacctcaaaatagcaataggacagagagttgttagtaatatttttggataaatgtatgagatggttgttagatctatgtatgaatatacattggacaaccaagttggttaaaagtaaaaatccgtatattactgttaaagaatgtagaaaatatcaagatgagaaatattcaaattaagagtaagatagaagaagaaattggcacttctaagattcaattaggataaactcttataactttgattaaaagaaaactatgcagtacaatggaaagggaaagaccctattgtatctgcctttcctaagtaaatatattccaaagtgttataaaaatttagacatcttagattctcaaggaaataaaatgttttcttgtttaaaacgctgtgtgtttggcagatatcttgaagaaagagaaaagactatggtttgcatgtttcctatgccaaatatttctatgctaacatcttcaaatatgggttcattacgttcaaattccctaatttatatagaaattaaaagcttattaaagtaatgcttctcaaacttttccattaataagtctctaaagagagaataaagtactttgaaagtctggagagcggtcagagataaagatatagatttagggattttcagaatttagatgatatttaacacatgaggttgaatttttgccattaaagctgtaatttttgtcacatataaaagaaatgagtcttacggaagtcatgatccttacaatcaacttgctcttcagttcctaaatttcactatcatagtgatttgattgtattttttataacagtactccttttcagctgatggcagagactcttgatctctgaattaatatagcctcaatgagtcatccttcattagtaagatgaagaatgaattctcttttacccaattaggctctgagcattttccatgaagatgaagcacaaaataatcctgaattttaaatctctgagttggttatgcatatacaccttccaattggaaaaagtgtttcaaatcacttcctataagttataaatgtgttagtttttttttaagtcaagctacttttaaaatatttatttttactatttctttgattatactgagaaaatcaagaggaaaattatttaaaataaatcattctcagggatatactggccacaggtttatgataccaatcttgcaatcatgcctattaattgataagtgtacacatcccattacatgcaagtatcagtacctttttttacagaagttttccaaaatgaggtacatatgttttgttgagggtttataagaaaaatatttctccattaaatattaatctgtgttacttttttttgttttttaaaaacagagtctcgctcttgtcgcccgggctggtgtgcaggtgtgtgatctcggctcactgcaacctccacctctcgggttcaagcgattctcctgcctcagcctcctgagtaactgggactacaggcacgcacccccacgcctggctaattttgtatttttagtagagatggggtttgccacgttggccaggctggtctctaactcctgaccttaggtgatccacctgcctctgcctcccacatattcttaaccaactacatattttttatgaaacttcatttgattttaactttgcttaaaatgttaccacacagtagtcttcaaccttgtagacatttctgttttgctttgaatatgatcttcttggtatttacaatttaaaataaaattcttacccatcctgatcggtagcttttcacttgtattgcctatttttgaaagaacttcaatattttttagcatttagctatttgacccattggtgatatttaatatgttcataatttattttgctgtgtagtatgaagtaactcaagtactctgcacattcaatatcatttggtaattaatgaattgctcttctaatgtttcgtgatgcttatttgtaattacatactactttcctgtttaaataaatgtatctcagagacattttatttctttggtattgacatagtattactgttttagttattttaaacatataatttattataactactagaaaatcaagtctcctggtcaactttttcttttcaaaatatctcaatattgctatagcattctcagactgttagtatggtatggaaacaacctgattttggcttttgtaagtaacctctttggcactcgtgtttatatcttcattcagaaaatgttagaaaaacatatttatcagtcatattcaaaatattttaatgtatattcaaaaacatttgaggtcaagttatttgtgttaatgttcatatcactgatcaagttatgtttttcaatcttcacaaattcacactttctgtccaatagctcctctccatttttcatgtgtaccatttctatctcaaaatttccatctgtctttcttctgtattagaaattgaagtttctcctttccattgtcagcacaattttatgcactattaattatgctcttttctttctttaataaagattttaattctgctactgtatgtagatttctcctgcattgattctttacctttcttcagccatatgtgcattccatttggtattaaccctttaaaaaagcaaatcttccatttctggcagtataaattacaagttttctgttactgagaggtcaacaccaggtacattcctaaagtttctatttcttgtaataaatctaccttcccccttaacccagataaacattttctccgtatcttttaaggatttcttctcttctaacttgtggacaccttttctaggacccaggttgatatatggttgttgtttggttttgtttgtttgtttgcttgttgagacggagtctcgctctgtcgcccaggcttgagtgcagtggcgcgatctcgtctcactgcaagctccgcttcccgggttcacaccattctcctgcctcagcctccggagtagctgggaccacaggtgcctgccacctcgcccggctaatttttttgtaactttagtagagacggggttccaccatgttagtcgggatagtctcgcgctcctgacctcgtgatccgcccgccttggcctcccaaagcgctgggattacaggcatgagccaccgtgcccggccgtttcttacaggtttttatactttcaaatctacttgagttctaacaaactcattcactctcatcttgaaggaaaatcgatgtgtcaaatatcgttttccatgttctgctcattaaaaggagatggatttatttcaagaattaaattgaaatgtattttaattttaaacagtttgtggaatttcaaacagtttgtagttctttttttacttggatgcgggcatgaatctataattccctagaagaatgaactatgccttgtgttcttttaaatcgccggtcattgttgattttacacatcaagtgaaatctatcctcttctcatgctgcttccttagaagctgatggtggtggcaggtgaagaagatgggataaaaaggaatgtgaatggtcctggtggccccagaaaacaggtcacacatggtaggctgatgattgtgaggctttgctgtgagcagggcaggccagaacatattagggaggagagctaacaagggctttcttaacatccatactctttctgctttttctgcttaacatccatactttttcttcattgaaaagttctagaaatgggccaggcacagtggctcactcctgtaatcccagcactttgggaggctgaggtggatagatcatttgaggtcaggagttcgagaccagctagccaacacagttgaaaccccatctctactaaaaagaaaaagaaaaaaacaagaaaaaagaagaaattgccaggtatagtggtgggcgcctgtaatcccaggtattcgggaggctgaggcaggagaattgcttgatcccaggagacagagattgcagtgagccgaaattgcgccactgcactccagcctggcaacagaatgagactgcgtcgcaaaaaaaataaaaaaattctagaaatgcattagctgctcatctcaatccaggtgatctaaagtatttagagagtattatgttctctctctttgagagaactgccaatcgatattcttgattttcagtactactaaggcctgacctcttttgttttcatgtggttttcagtagaaaaatattaatcaaataggtacttgaccaccaggtcgatccagaatcttgctttttaattggatgtgttttaaatttaaatttaactctatatgatggaatttttttttatttttggcattgtcatctccaagtttgacaatggaaaagtactgatgtcaatatagactatttttattttatgttttcaagtactttcttgatatgtttgccagtttataatttcattgttcttgtgtcttttcaataaattgttttaagattagattagtttaaataaattatttatacttctctatatacatcattattctattgctatttgtgaacactatattattttaaaacatttctgcttaaaatattgctacactaatatcctcattttcaaattgttgacatccaaaagtgaaagaaattgggtgggaatactttcatttaacaaattagttaaaaaaaaattcaacaagctctaataggaactaatacatatttttgaattatttgatgatgattggtaataattacagatacttctcaacttatgatgggctgacttcatgataaaccctttgtaagttgaaaatatcttaagttaaaggtgcacttaataccccaatgaacctattgtaaagtcaaaaaaaatggtaataccatcataaattggagaatatctgtactaaatggttttatagtataaaatgttcaacctaactctagttaataagtatatgaacaggccacttactagttggatgaaatatattacaaataaaaaatcataatgcatgtccttatgccatatgttgcatgacattttaaaaaatattaaatacgtcagtgtgggctaatattttatttgtacaattttttaattttataaatctcttctgctaatcttactttgtaaattaatttttaacctattttaaatgctagtcatttccaaaaatttcatttccatattttattcctataaaacttcatccagttagtaattttctatttattgctaatttatttcctgatgaatacaaagattattgaacatagtctggctcatggagttcaaatcttttttaatgaataaatatattttgtattttttttctggaattctaacaactcttctgttatattatgactgggaaaatatctgaatttgatacatgaactttccagaaaagtatggctttctgcatttggtggccatccattttattgtaatcactacttatcctttaaaatttttaagtaaaatgtcctgtgaatcttgttacctttgtcagttagatggcctcattaagtactctgttgtataaacataaatatattagataacaactttgcagcttcgaggaaaagtggcaaatgtctctctactccttgttatctgggccttagtgacttatctaagtcctggctgtctttaaagttcagaattttaggagtacaaagctgtctttaataactagtttgtttccacagagaaaaaaaaaatccaaagctcttcattaattttcattgttacattagaactagcttttctctggtcttctcatctgtacttcattaagtcacattctgtggtataatgttgcaagtttggaaatgcagaaacagttcaagaaattgattctatttgttctttctgttcaatagacctttgatctgaaatgttcaatggtgcctggctgttccacacaagccacttttaaaccattgttcacattgtaatagccttgttatcaggttgtatgaattaattccatcacattaggagaaggaagttagacttccacagcacaatctaataactgtctcatgttaccatacaattgattgggtcacaagacaacacatcgtgtttataattgaactgttttgtaaggtggtcttggtcttaatttcagaatttcataacgacattaataggttttgatttccccaggacaccttgcccaacagtctttgagaacctaacaatgtataactgaaaatgtcacaatgaagcaggccaccactcttggtaaaattcccgaatcaaactcttctgtgcaatgatgtaaccacctacaaacaaaaccagcactttgggaggccgaggtgggtggatcatttgaggtcaggagtttcagaccagcctggacaacatggtgaaaccccatctctactaaaaattaaaaaaaaaaaaaattagctggatgtgtcccagatacttaggaagttgaggcaggagaatcactttcacttgaacctggtaggcagaggttgcagtgagccaagatggcaccactgcactccagcccggacaacagagactccatctcaaagaaaacaaaacaaaaaagcagaaaccacccacaaactaaaaaggcaattatcttgatggggcaggaggagttaggagaaatatggaagttctctagtcagccgctgtcaaaccttggcagagagtagctactaagttgtctgtggagagatcccagagatcccacaggcttgccacaccatcacggaactattgatagcaaaaaatggaaattaactagtaagggaatggaataacgtgttacgttgctgtctctatcacatattactgagcttggtggtggtgagttgcagttagacaatttgcaaacagtaattttgaaacagttcaaatagacacattaacaaattaactatttgatgagctgaattcattcctccacctggttaagttcgtatatgtgagattattctcattacttacttgaaaagatccagtgagcaatttttccttaaggcaagcttcctgctctttaggttaccaaccccagagggatgatcaagtgagttcccagattcttttatgtaaggtaacttccagggctattaacctatgataatgtagttccctggacccggtagtcctctgatacgctggtttgcttgtgtctgtactcttttggtgatatgtgactgctttgaaacaatggataagccctttaacaccactgttcatttgttcatttgtttgacttcccaatgctgagccatttccctcctggtgtgccctcactttgcctctcttccaagaccctggctatctgaacaggtagggcttgtaagtcttaagctattaggtacctttgggcagctttgttagacaactttcaagtgacaagacaaatccataaacccatcctttacaacaagttctttcatgaactcttccttgacttccatagcgagaatcgttcttcccacctctactcttctgtagtgcatacaaccttaaagagactggtgtgaaaattaaacataacttagacagaatggctcccacatcaagtgttcagtaagcatgaataatgtttatgaagaccatttattcagcccaccatttctaatcttatcattaccctttaccaaacactctagtgaaatctcagcactctgttagatctttcacgtgtatcatttctactctttgcagccgacttaccaaatgtatagcttggtctgttttcttgtttaaatgaaagaatttacagagggattagttactttcccctatttcataaagctcttatggcaaaatcagggtttaaacacagaggtgggttgcctgtagtgcctgcattgctaatgtttatttaatattacttctggatgacagttttgctgtctttgtgcattattagaattattaatcccatttgttagacattttttgttaactggcatttttatgcatattttcatatgcctacatattccttctctcattacattttgcatctttgtaaagcaggggccacaactactttttaaaatcttctggccaggtgtggcagctcacatctgtagttttagctacttgggaggctgaggcaggaaggatgacatgagcccaagagttcaaggctacagtgagcagcagtggcaccaccacactccagccttggtgacagagtaagattttgtctcttaaaaaacaaaacaaaaaaactttagtgcctaccatagtttcttgcatggtgatgcttaatagtatgtttattctttgtttggtttaattttgtaccttgctgaaacattggcttagctttaggcacacaatagaaatgagcaaaaacttcagagtgatttagaaattgcatcgttggagacttccccaccacaccatcttatcatctttctatgcactgaggcctcatatttcacagtgttctttgtagttgtcttgtttctgttgctgtgattgtcatttgtgttttgatcctggatttactgaaatgcttccttacaccctcctgaactttctttgcttttccccctctagtatgcccaggcaacctaagcgtggaaatgaattcattcttagccattctcttttcaaacaacaagaaataaagtcgtttatttttcatttgttgcacactcctcagtaagaaaaaatgggcagtttcattacgtatcatttgtttcttatttctttagtgtaactggcagacatgacttgtttgcttttggaaaaaggaatatgagaaggacagattcagggactcatatcaggatccagaatgtccccccaggccttagaattatatatgtgcttgacacatagatgaaatgtctgcctgggtatttggacagatagaacttttacttttacatcttaaggtaatagccatctttgggcatctttctcagaaaaccttcaagcagaagccaatgagacaaatccagagactgtactgccctgctttgtttactaaatgcacctatttatagacaaaacttgaagttggtgataatacctacatggtgcaatggggtcacaacacccattttaatcagctggataatctttagattgattagtttctaagcctgaggtaaaatgggccatgattccttcttcaaattctctgtctctgcatcctcctcttgctgtcccattctcaccagcttctgtaggggccttttcctgcccagttctctccatatggtttatttagagaaaagtacagagaatatttttatactctgtgaggaaatttatagatatagactatgcatctccagcatcttacaaagcttgggttcattatctgaatatttttacattggttgatagtggcaggtctgagactctagcagaagtaattctgaaaacaattccctccaggttgtatttgttacatttatattttttaaaatcccatatttatatactaaacaatacagacattttatcctatgtagaaagaaaatgccaagataaaaacagtgccagggttggttaattcaatagctcagtgacatcattgacaacacagttgttccttcttcctgtcctgtcatcccgtgtcaccttctctcactcacggctgcatgttgcctattgccggtccagaatgttcgtgaagacctgacagagttaagcagattgaaggattctttcttatacctcttgaagatcaaaaaatgcttctcccagatggtctgcagcaggcactcttgtgtcttgctggactagaactgatcacatgcccaccccacaatctaaccctataacctgcgagaggaatggaggtaccatagttgacgaggaaggaggactgacatttccccaacttaaggctctactagtaaagaagaaaatggcttttgagtaggtaactgagaatgcctgctaaatttggccccttttttagacactgaccttgggcattatctattgtcattcacatttcttaccccaagtatctaattatctagtccaaatgcagggtttttttccattccctaatgtagagttccatagtgcctcaaatatttctattctggtacaatgcatatacaactacttaaataatactaaattgactactacagcaatttaaaaatacaagaaatcttcttatttatagtttaataaaaataacttctggcctcttgagcccagaaggcactgtgaaattcatagtcacattttgagatacagatattttgttctttgtacctagctacgctgaagagtttctttctttctttttttttttttttggccaggctacatgtaagatggattaaaagaaggcagatttattatacattgtaggtgctgtttttactcaaatagcagagaatttagaggccacttatttaagtacaaatgctgcctcctacctaagtcacttaatcaggacactttaatttctaccactgctaaattcagctaataatacctgccccctatctacctctctgggaagctgggaggattaattagataaagtcttaaagctcctcagagagaagtggtatatgtaaaagatgttattatttctagggaagaatgaagcggtatctcttttatggactgtccacacttctagaattttttcctcttattcagctcaagtgccaattttgtggattttaattcatcatgtgagacccttctcattctcaagtagttgtacttagagaaaagattttcaagtattgcgtctgatgatgggaagtacattcctgagtttcactgaatatttcagagcactatcctgcaaactggtatatatgctggaatctggttgcaatatttgtaaaaacaagccatgactgcattgcagaatgtgacccgggcctatttttgagatcctttccaatccccatgatctaagtcaggtcactttggacatagaagacaaattgatagtaaaatcttgaatctctcataaatcttgttaaatagtttatatttaaatattcttttgagctatacatttttatatttagattacagaattctatccttcaagaattctcagttttggttatatagttaagtgtacacaattttcccaacctatgatccactttacagagctttgagtatgcttgccttttacattgctttattggacattgaacactttcattaactattacattgatggtttcctgtttagaaattgagttagcacatccctgtgtgttttggtaactgcagctgctacttgatgttaacaagtctgcattctggtcagtggtgcagcagctcattacagatagagatgggcttattttctcacagtagtttgagaagccagtgagtcactggatccactggagatcttgggagagcttgggaagtggctgttgctgggaacagccaggttgacttcccccaaacactttagagaagattttgaccaccttcaatcattcacactttctagaaatgaattcaacctataattcttcacaagtcaaaatgacagattctttcaaagcaaaagcatagctatatgatttactggaatcaggttttcatatttataggctttcttttaaaaagataaaatttcttgtttttcttccagttctaaaggaaaagatgagaaatgagtgtcaaatttgactcagtgactaataccaaactcactcaatctgccaggcatcaggaactgggcaactcaataggagcaagaaaggatgtagggagcacagtgtcattaggggaaaagcctttaccttgccggaggatagagtgaagaagaaaatcaagggtcaggtcatttctaggtctatttatcacatgaagaaacaataaagagaggttaatagtgcacttaagacttgcactaccaaccacttacctaagtcaggtattgggccctgacccttctcatcataaactcctctgctcttggcagaagctagaaatgagggtgagtgaacacgggcctagcatgagagaaggcagaaatggtttttccccgtatggtgacaacatggcttttcctagtgttaccagcttcattcatcaaaatgtattatctgtctatggtgccttcttgtgaagcattcacagccaagaggagtgctgacattagcttaaaaagctaagttttaaggctttgatgaaggattcactgagtggttttgagaaaggagaatcatggctttgaaattcaaacacatccttaactaccaccctcattccaccaattaaataaagtgaaatgatgaataacagacaatttataagaaagtatctatagttttagatacaaagagatgacaaatgcaaaaagaacacccctatattttgctagaagaaaaaacatttagatacagattttttagaaagtagtacagctaattagcagtagagccatgttttacttactacatgctagacactaagaacttatgcttaatccttaaaacatcactaagacagttacacccattttacaaatcaagaaaagtaacaaagattccagtcacttttccaaggtcatataattagtaagtggtaaaagacaggcccagagctagggcgatctatttatagatggcttcatgttgactactctgctacacatgtaatgaagacaatttaaaatgtggaaaataataaatgctaattccagattttcaaaatacatcaaatatatacataggaaggacagtaatcacaagacaccattaggctactttaatataaaaagaccaagagcttggatgaagtcttttatacagaaagtgctaaggagcatagcaagatgagttttatattaggatataatataataggataagatatgacttattgttaggatgtttttgcaattaagatttgcttaaaaatagaaacatgcttcatgaggtcctgcaacagttcaggtaggaagcaacagctaaatacaagagatacttcaaatgactcttccataggtaacgtggactcccgggaaacgggcctaagaacccaatctctcagatgttataatgaagctgcaggtcctctttacattggccaactgttaatgatgatgtttcattatggtaatacaatggccagtcattaccctcacactttattaaaatgtacatgtgttgcagatacctcatcttcattagcaatgatagactccgaatattctactttccattttaaagaatcctactattgagataaagagaagaaaaacatttctcactttattccttttttatgctttttgattgctgaattatgtgaaagtgttacctagccaaaaatatttttaaagtcttctatgaatccagtattcataagcttatgtaactcttccttcactctcagactaaatgaacttgttatagatggaattgaataaagttaccatctacagtactcataagttttttcttttagtagttttcagttttagtaacttcttggagttatcactttaaaattgtgtttctaatcctcctatacttgtaaataaatttgtaaatatcagaatcatattgtttatgatatatgtaaagttttatttccccctaaaagtctatagactttaatctgccctcgtatggaagtttctctattactttaataataattttaataatgttataattacagaagcaccaaaaataaggcatgcatccatctctcattgtataacatcattattggtgtattagtttgtttgcatactgctgataaagacatacccaagactgggtagtttataaggaaaaagaggtttaatagacttacagttccacacggctggggaggcctcacaatcatggcagaaagcaaagaggagcaagtcacatcttacatgggtggtggcaggcaaagagggagaacttgtgtcagggaactcctctttataaaaccatcaggtctcatgagacatgcgcagaacagcacaagaaagacctgcccccatgattcaattacctctcactgtttccccaccaacaacatgtgggaattgtgggagctacaattcaaaatgagatttgggtggggacacagccaaaccatatcaggtaaatattaattgctccatcttaaacgtgagaaaactgggattcagagaggttaaataacttgccggatttcacacagctgataaattacagagccaaaatttggacccagatctgttttcacaacttgtactcttctcacactggcatgctatttagaaggttagcccttttctggttaggcttcctcctctactttacaaatcattaagtgctgcctcctgttggtctcccttggcgttacgctgtagccagcccttcaatacaatcagtgaaaacaatccttgttgggagtagatcatttcggagtattgattctaaatttgtcattgttttccgtgaaagctaagcatagagtataaattgccactcaccacataaagttgatgactttctatgcccaaatgatttgacaatttgtgatttttccccaggagtttttttgctaacatttttcaaggcaaaatattcaatccctgtccaaaatgatcaaattttgccctgcagcaaacttgtaaatttttgccaggacccgtgaaacttcacaaggcaagagatcaataatgtcacactgttcccttctcaccgctttcctcaatgtacacactatctagtttgaaactgccaacatgagaaagtaaaaaatttaagggacaagtaaggaactctctcctcatcttttaaaaatataggtgatatctttaaagtagagatgatctgtctgtgctcaaaaatttgaagtaagacaaaaatttagttttggatatttaaattaattttacaaaatagcaacatgcatgactctactcttgtattatcctgttgtgtatgttcacatacccaaaaatatttttggtgttctgcctattgtgtctgatgctgtcagcctttgttgcaaatcaggacttaggcaaagagcccagatgggctttgcactgctgtcatgccaaggcactaagacattttacttccacctgtaataatattaaggctttacttcttcaacattaatttgatgcatacctttcttttttcccccacattaaaaaacgtcaataagtgtgagccaatgtttcagtagatttcatcactctttctcttcaaactttgtctttctatccaggtctgtcttgtctgcctgaattgtaactgtgaatattttcccatgttcacctattgggctttcattcttcttgatatctaattcctccttcagataactcatccattttcatggcttcagctatgcctttacttgaatgatttccaaaattctatcgccaatcctttcccctcatctaagcaccagtcatttattttcaactcttcactggacatttctactttgatgatttgcccccttttcaaaataaacaagctgaattctccacccctcgatcgcctcccactcctgatttcgtttttgttttcaagaatagaaacctgtttccgaatatttatttggaaataaatattatccatacttgaaactttgggccaaggcacaagaatggcaatgcaaagacgtacaaaaaactggagttaacatacagaagtgcagtgagccaggctcagctgtatggacttggggccttggccctgttttactcagcgccacctaatggtcaccatttagaaaggcaggcctacttttgccagatgcaattttgcaaaggaaaatgtaaatgtcaattttatagtgaaatttatcaatatgtttaaacgttgtcactgttaaacaaaatgcagcactctggaagcaatatgaagtttatatatgagtatgtttattccaagagctgccaatttgtgaccactacgaaatcagctgagctaaaagacaattggaaaatatataaataaataaaaagtaactggcagctcctcttggttatgataatgatgctagagctaacacagataacccaaaagaatggagccgttccagtgcgtcacaagactttaggacacttacatagtgttctgaaaaataggctaaactaatttcatcagtgagataaccaacattgagctaaacccacaaacctgaaattaaacatcacacattgtaaatcagtgaagcaaaaatcaaacatccagaaactacaaaaagtaatcctgtctcttttaaaataagcctcaggttattcttctttccttaaaggtgctctgaggcatgaaaagtaaattttcagcctaagagtggtagatttcaatgaatatacaatatggttcccatgtctcaaattcttactttgttctgtttttttgaaagacaatgtacatttgggttttacataacatataagcctttggaaataaatattacagacttctaatgttagacttgtggaaattgagccaaagacatacaccagtcaaagacatatattgatgacataaagcaatctttgtgacaagatcgcttaagatttcaaaaagacatatgcagatgaaattaagcacatataaatttatccaatggttacttaaaaaataaaaataaaaattagattaactgccttcacacttgggatttttacttgtaaacccaatactaattgagaaaattaagaaactatggaaacttaactaattcaatattttttttcaatatactggcaagggtatttttataaacataaaggaaatgcaaaatataaatatactaaaacattaagatatataaacactcaaactatcattacaaaatctatgtgaaatataaatcaggcaattgacagtaaataatatgaaacttgtactttgtttgctttagaaatattattttattttccaatatctttacctcggtcaggtggccaaactgtctgattagaaatatcttagcataaagatgaaaaatgcattctatgaactactatagcataaaggcttttgaatttcttctgagttgccattgatctgcacgcattcatttctgaattagaaaacagctaatattttgtgaaaagaggatacatatttctttaaattgagaaactaaatttcatgttaatatagtatcagtttattgtacttcagattttagcacaagcatttcagaacactgaaaaactatatttagagtgagatctacatattccatacagatggaatcagtccatgaatatatattggtatcattcttgccagtcctaataaaactctgtctttagtgtgtttgaacaaggcttaagttatacatgaaaactgaaacatcaaaccattatataccatttaagtgtagataaaataattttacatccgtacaatatttttaaatgttgactttagcaaaaacttaaaaattctctgaaatttgaaatgaaaattcatgatgcacaaaattatgaaagaagaaaatgtctactccaaatatcccataacttttttgaacaaactctgttgtgatttaatctttttcatttacattttctgtctgtatttgagtttacaaagtgctttcaaatgcaatacaacatttaacctgcactatggccttttgtgaaaagtggtgttattgtacttttaatgatgagaagagtctcctggaggtgaatgaccaacttcatcatcacacaaccagaaataaatggtaggactgaagcttgaagctctggttctctgaatgccagccagagtgttatttctaacagaccacagtgtgctatgctggtttctgatcagatccgtttttcctctatccattttacacacataaaatacatgagaacaaggtaaatggaacaattctaagttttttagtttttctttgtaatttgactctcttgaaatcccagctttgtctaagcatagcataactcgaatatgaaatcatattcatgtttgtgtgcatctgcatgtgagtgtgctcacccatatgtatacatgtaatgaattcctatacaattaaatgcactgcttccttttattttcttcagaaaaattgccatggttctaagaagaaaatagagaaaaagagaatctcagtaactatacaggaatcaaaggatttagtaaaatggaaatgcatcggcaggaaatcataaatttgttatttttttaaaatacagtcatgtgccaataggattacattctaaggaatgcataattaggcaatttcttcattgtgtgaacatcatagagtggaattacacaaacatagatggtatagtctaccacatacctaggtgatatgatggaacctattgtttctaaaccacgaacttatacggcatgttacggcattgatcttatgggatcacccttagtatatggactgttgttggccaaaacattgttatgtggcacatggctatatatagccaggtgggtagagcccatctggactgtaaatacataattcttaggagtctaaagttctagaggtgaaatggtttgacctgagtttttgagagtggaatactcaattgaacaaatgtataattctgtttctgtttcttggcgtaaacttattccatatatattcatatagcttatttttgtctaatgctgatataaaatttgactaataacaaaataaattatattagtccttagaagggaagtctgcttttgactttaatgaaatgtgccccaaaacacattggaagagattagacttaatctaattatctgttctcgtactacttaggacaagcgctttcttcctttctcaaaatccatcttgtcttctgctcggtttcactgtaaacttgaaatcactttatgacatcagcctgtcaccctgaaaataacagatatcccagatgtgtcattgaaagttcacttccaaaacaaagaggaagatagaatgggctctcgggggcctctgatcttgtttaaagaaatgtctgagtcccagcgcggtacctcacgcctgtaatcccagcactttgggaggccgaggcaggtggattacctgaggtcaggagtttgaggccagcctgaccatcatggtgaaaccccaactctactaaaaatacaaaaattagctgggcatagtggtgcacacctgtaatagctactcgggagggtgaggcaggagaattgcttgcacccaggaggtggaggttgcagtaagctgagatcgcgccattgcactccagcctgggggacaatagcaagactctgtcccaaaaaaagaaaaagaaaaaaagaaatgtctgagacttctgctctgtgggtctctccaggggaggtgaatgcccagacatatctcacccctgcaggctatgcctttcaggtgaaggatgctgaatgttccattcagactgactttctgatcttccaaactttaagaggttgtatcggagtcatactttgaaaagttatctcctcaagttcctggtattccctgatggttcagaactcatacaccttggcacatgtagttatgaaagctctttgcatttgatgagaagcacgaagaagcaggaccagtgcaagcccatatgggaaaaagtgccatgtgattcaatagtatataaatcggcctcccatggtgacagaaggtgtcattcaaggccataggccacagggagagtgtcactcatatgtatgcacactcagttcagtcctgtgcacatcctacacttccgaatgcatactgaccattttccccttggagtcacgtacacaacatgcagaatggttatgtaggagaaatccatggcaacagcacatagcttgtagattgtatttggaaaaaaaaattaccttttctaaagttttaaattttaaaacatgtaattcttgagatttacttgattcaaacttgaaaaaaaatagtgttgcacaatttttttgagcactagcttatcttaaggctttctgaataacctaagggctattcagtcttccttttagaaacctccgagttatttttctgtgctgtgtacattttcatccacaagaaaaatattttcttctcattcccttagattcctcgggacactttttttttttttgtctgcagacaccttaaaggactgtttaagaccctatccactctatctattcttagcttcacctgaagggcaaaatccctaagatcttgacacacatactgataaatacatggaattattaaaggtgccatctcagcagaagaggattgctgctgcctttgttctcgggggaatacatatttcacccagtagcaagacacccaactgctgctacaatcagaaatctctgaaatgcctttaagctaatcatctttgaacataagcctttgttgttgaatcagggaccttctagatgcaaggcacagaaacctttttttattattttgttttttctccaccttgcacaaaacagcatcaagcctgtcaccaccgacagtaaggttcagtgatctgtcaacattcacccctgatgaagacagtgagagaaatccatagctctggagagttcaggagagaaccaaacagtgtgtttgcaaaagagcatttttatatgttttcttgtgacagcactagtttaacagaaaatagttggagtgtgccaaaaagggggaaaaatgaaagacagtagtagtaagttaggctagcatgacatgatggatctgggctatgacaaaccaaattggaacaaagcttccctggggaccaactataccaggtttgctgaattgtatttcttgatttcttactgtgcaacagtgcttttactgttagattgactaggcttcagaatatttttaaaattgtacaaatcaaaatccatgtagcttaaaaatgaaggatgtaaaaggtttaggagtttgatgtattgaaaggcattctgtattccctcatgtgagtattaagtatacactttgtctgttcgatgaatttcaaatctttgtggaaggcagtagacacgatagcagtttacagggtggaaaaccctggttggaaagcagggcacaggctggagagattcaaagcttcttcctgcttatcccacccagatgtgcccaggaattgcaatatgcagcatctgtagggtctcacttgttctgagatgtttatataaaggacaagtaaagaaaccttaaatctggtgccctcttaacaaaggtgtgatgcattattcttattacttgtcctttcaattcttacctagtggctttcacatagtctaaggtaaggccagaagaaaaataaccaaaaaaagaggaagaagaattatttcaaagctgctaaattttactggttttcatataccacgtgaaacctaacaactagacaatctgattctttacaatagtcattcataataaactttgaataaatatctaaatgaaaggactttcttaaatacccaggcaagtttaggtactcaagctgcaaaggcataaacaattgagtccctatctttaaggagtttacaagcaatttgaataattaatgaaactgtcagagtgtaatgtgataactaccaagcaacagccaagctcaaagcagatagcaaactatctagtgggcttgatcaacacagctccatgactttcccaatagctatttacgatcaggagaagggtagagtaaagggatgctgaaagtgaggtggttggggttcagtaaaatagaagatctaagtattgaggaaggagagctaaataagacattagttcagaacacattaaagtaggaaacacaggctaaagcgcttacggctggtaatgtaagggaataaagtggtggtgtttaagggttaaggaaaataggaaatgatggcaacaagcccaaactcgagtttgtcccatccaaaaaaagaaaaaaaaaaagggcagcggctattcaactatagcccattgatgcatgccagaatgtggagcaatattgccaaatcttctggtcttccaagagaaaccagaaatctggattttcatataacatatatttaaatttagaaaacttttttttaacattacacatgacgtggcattatgtgaacccaatcaaatgcacctgagaattgttttagcccatgcactttcaagttgcaaccgtttttttgacatactcagatagtgtgtaataatggatacacaatgtaggaggaggaacagggagcctgaactgtttggggtaatcatcagattcaaatactttttaacagtaaatggctggaatgggttaggctgaggatacaaaagagatttagaaatgagggaaacacagattactcacttctcaagtagagtatgatagccggcagcaggtaacgaggtagaaaagaacagagccagctaagtgtgggtatggtcaagaaataagagatttgtcagaaaggacttaaaagacagaagagaaggaagaagacagggtgttatgaagtggccagtgagatcatcagtgagaggatacacagtactgttctgtggcctgaaagtggcattgagctgatcacaacagaatgccctaagtatagatttttaagagaattattgagagcaacagactgtttcaaacagatttgactttgaaagtccaggtgatttaaccctggtttgataatttctatcagaaatacagcaaataaattggttaactgaattcaatgcacttgcaaaatgtactaaagacagtttgaatggtattcgattaagtattttggggggtacttggggatgacaatgaatatgatgatacattagacactacctgtcccaaggtgtttacaatctgtatggaaaagcagcagacatgtacatgcaaacacagtttctctccctccctccctccctcctcactcactcactcacagacacactcaggcacatacatttgtgtgtgttctaatgcttgctaagtgttatgccataaaagcaaagcatatatgattgttcaaaatcaaatgttatagttttttctctaattctaaagtacttcagtgtattaccaggtgggttctcttcagagaaccccaacagcaggccaggaggcagtgtgctggtagatgccaggcaatccagacaggatcccattatcttcctctcttgccacttttgttaaaacctggtaagactagcactcagcaaacgttcagtgagttacatgttttaatttgaatgggctgatttgaattcaaactgatgaggtttgaaccttgcccctctatatctacccattttatcattgcccaccttctcttcaccaaggctagagctgagactagcgctgaaaagaaaattcttggtaaagaattccggaatcttttaagagttgtacccagacactggagaaatttaatcaaaaactcagttacatagaaacagcatatttaaaatgtttagaataaaagtattttagaaactgggaagttttaagacacttttgaaaagccataactacctctaacgcgatggctatttcacagtggtgctattagacagctacagccaagtgccccaaattaatattaataacaatgagtataaataatagtgggcttttctgtatataagcacatcctattcttattttaaaatacagtagcttgagttttgcaatgactattaaatttcatcagccattttggggtgacagttagcttccagccaataacagaatattataaaaggagaaagttaagatcaatcttaaatgtaatagtttttatataagtgttgctgcttttttttagttaattatttacaaatgtattttctcaatatataatgcaggaagatgccaatattactcaattattttgatccatttataccttgaactaaggaaataattggtatgccacccctaatattcatttactgaaagatttgtatcctctttggtttggttttatttatgtgtaaatatgcatagttcaaaacttgttagtagcaacactaataatgtcatttatatacttcaccttgtccatttaaaatggattgttctatttatagagtaacagcctgtaaaattaaattaaatttttaatagaaaagacagtccttttaaaaattattataatagaaaggttgatttttttcataaatcacttccaaagtaatttttaagaaaatcttattttagttccaaaactttaaaatagtcttattgatttttaaaaataattattcatgtaaaataatttatggcagagttttctgtacttgaaaataattcttataataggaattttacaagaccatttattttagcagtgctaggaaacacaactataatttagaagctattgttgattgtttctagaaatatatatcgacctcattagttttaagtgataacattactaagccaaagttccaatccaacagtaccagaattactgattgtaatcagttttcttcgaacttttcctttagcacttagatttcacttagcttatcatacataaatataaatgtaaatttaaattatcttagaattctcattattaaacagtatagaattaatacccatggaagctccagtgtctaaagtcttttgttacagtccctttggtatgcatttggggtctggttgtattgataccaccctcttggacactttattattaatcaagaagacacccaatggtctcgagaatcttcaccacccaataagcattcactgagtcatttattcatcgagtaatgctctagaggagaggaagtcatcatcctcatcactagcaactgacatttattaggtcctcatacatgccaggtgtgtttctacactcttaacatgtgttaacatatttagtcctcacaacaaagtgttcctgaaaatgattttgtgaagtttgttagctggatttacaactgttaaatatttagacacatggtctgcacatctccatttatattcttgtcttgagacccactgattgttaaaggctatcccaaaacatatccatttcgcacagtttagagtgtgattttatttatttcggcagaggatagattaaactgactttggtgtcttaaaccacatcaatgtgtcaaagatgtcaggctttgttaatgatgcacaatttactaagcacctgatgaaaagcagagactaaaagtttcttaggtaagggtcttcaggctgggtgttctgggaggaaggaaacggaaagtaatattaatatatatgttttgcaactattaagtgtcaaaaggataatgtgatcatgggatattcatattcaaatccaagtttaggtatcatttgctgacaaatgtttaacacaaaaactcaaaggtaaaatctctacttttttgcctattcagtttgaaagttctatagttaaggcagagacaacagcaaaatcaaggataaatatttgaattactctaagtccatttgacaaaaataaagttctggaaatgtaactcaatggtaaattagtcttagtcaatttctttacttaaaactcttctggtatttgtcataatgataaatgatcatctcctctaagcccttcctttccccataactgaattcctactcaataagcaccttaaagattctaagacagtctctgttgttattcttacatactctggaacccacagcacttaaatttatgaatggtttgaaccaccaacctattatgcaagcgtaacctaatgttctttgaatataagcactaggtaaacaagaaaatattgccacatgcatttacttagtgcttctgacattttgacatttaatggattgataattaactttttcaagactggtagacttctctccaaacatactagttaggataatactagctgctgtaacaaagcccaaaatagataatggtttaaacaaaatagaattttattttgcactcatgtgaagttcagcatggacattgttgattggcaggctgctttcctgcagccattaaaccaggaaccctgactcttcccatgtgatggacccagtgtcttcaacatgtggcttctaagaccactgtttctctacatcaagccagtggaaaaggaatgaagaggaggagggtcctacttagactggaagtgacacacatcacttctgcttatttcttactaggaagtgtagcctttgggggacagccactttccagcatcatctgccaaaggcactccaaaatgcaaaaatgtcagtgattagtccaaagaagtgactggaggattcaggttctctaacatccagccaatggctcttgttactagatcactgttttccagccagtgggactctttctgcaaacaggtgacctctacttggagagaaaccagaagaaaatttaattgaattctaagctaatgagaagaaatgtaatcataacaaaataatagccagtgtttattgagcattcgatatgtcttgggcattcttctaagcactttatatatgttagtttggttaatactcagggtgatgctaaaggaaattatttttagtagccccattttacagttggggaaactgaggcatggggctgtgaatatatttcccaaagccatatggtaagcatccaatgaaatctggattcaaatctaggtagtctgattccatcagattattttatcttccatcaaagatagaaaaatgccatttgaaaacaaaggggaaaatggagagaaaaggtttcttcctgaaagaaactttctctaattaggcatggcttaagttacacagtttgtaattctgtacaactcactctcaccctgtagacttgaaagcccctgttcttttccctatgattacttaccttgtccaagtcatgtgggctcagaagagggaaaaacttaaaacatggtctctcatctcaaggaagttagattctgttgaggagaagagaccctaaaatggtaggaaagaacagtcaagattaaaggacaaataaaaggcagacaataggatttcagaaaaggctgtaatcaccacacataaattaccaagaaaggtttcatcaaggatgttcttctttagctggtccttaataaatgggtaggatttcatgaatagagaggtactgagaatgtcaggggagaaggaagctgagaacaaagtttcgggtagataaagacacggtgtttgtagcagccggtctgtaataacaagcaattttaggaattagtgagagttacatctttatccatttttactttagaacttatttttttgcatatatttttaattctatgtaaccatctggtaatgcctggcactctatgatttgttgcagtagtagtgtttatctaaggaactacgtatgtaggcacaggaaaatgaatactgagttctgggaacaaaggctggggagggatttccaaacaaatgtcaccttctactcatttcaacaagtgtaagagttaagaaatgtgcctcgctgtcaccacatttctgggcctctacggcttgttacagagaacctaaccaagacctcggtattctggctgtcctgtctaactacatttagagtaactgaccatccttacatacctatatcacttcccatccctgctctctcatgcagagaatatttcatccctccctcaaatcaagggatgagcccctggaggacagcgagtgagttctgaattctctgaggagccacctctgactacgactgtccctctctgtcaatcacagagcacttcgagtgacatcatggctgtttgcagtattatgctgttgctgtaggcagcatgaaattgacaaggaatggcacagagaagagctgaaagggcacttctgcttttgtgatgcatctgacacctgtagttacaagaaagaaaacagctttcataagcatattgctaggtgatgtagaaggtgaatgagaatttagaagtagtttttcaatgtaatagcacaatagaatctaaactgcttctgtgcacttgcaccctaagaatatcttcctaagtggaagccatccggtaaggtagtttctcagaaacctttgggtaaaaagttaggcttcagtgaaaacccaatctagatctcagaacgttttggtctatgagatgggggtcttaccagctctgattttaataaaatataccttttttagaaactcgatcttcacatttttttaaacttttactttaggtattagggtacatgtgaaggtttgctgcataggtaaacgtgtgtcatgggggtttgttgtacttactatttcatcgcctgtgtattaagcccagtacccaatagttattcttcctgatcttctcccctctcccctcaagtagatcccagtgtctgctgtttccttctttgtgttcgtaagttcttatcatttagctcccacttgtgagaaaatgcagtatttggatttctgttcctgagttagtttgctaaggataatagccaaatatacctttttttccttaggttatatgcttatttgtatttcttctacctgagaaatcatattatagattgtaaagctagtgtccaaagtgaagcagaaagaaaaaaggtaccccagtatcttcctgagggggagcctttcctatgactgaactaacaaattgacctaaatttgttattattactgtaatagtaagagcaactctgacaattaagccttagcaagagaggggatttaagcccaaataaagtcagttgttttgataactgaagtagttttaacactaagtggacaggttacaaaattgggaagcaattgattgtactatgctgagagatcacaagtttgcacaccatccataatgcattcaacttgagcaatgtactgagtctgcagtactctgtgtgtgaacatggttgactctgcaccttcctgtagcagcccacagtgcaaatgtcatcttgataactctctgctgggtggctccttagaccctgtcatcctgatcttttgcctgttgtctggtcatggtttcttccttgttctcctttaccccctttgtgtggaaaaacattttagtctttagcagcaaatcaaagccattttcaggtgacactggtgatcttctctcttacaggtatatccttctgtttcaggtttgttatgatgaatgtaaggagcacagtgaggaaagctattgccagtcttactcacaagcactataggaaaattaaaaggaaaagtcttcctgtaactatttgtatgtctctcaaaccatggaaactaagaagagctacaattattgaaataaagtgctatattccaggctaggccaaatattcagcagagagcctgaatatttcatgtatatgcagtcaggaaataatacagaaaaaagaaacccaccacaaaacagtataattgaggactattactaggccacatgttttgaacacagtatctcatttaatcttagtgacaaatgttctgtgtgatcttctacctttagctcggcccattcctctacattcctatgtcattttgtagacttatcattttaattgttaaattatactgccctgggttcatagatatcattctctccagtgggaacctcttactcatctttttattccctggcatctatttatctatcaattgccaaaacaaatagataactagagttgatttgttccctatcacttctcttcgggctctaaatcacatcaagttctcagatatctcatccacgtatgtattgctatagagatattagtacttcaatccacactatgaattcccatgtggaaaaaatggtaaaaaaggtaatgttaggattacacctcaaattgatgtaatccctagttagcatctcgtaatactgaaactctttattatcctcttagtacaccatggtattgacagcactttgttttaccttatcattataacatcatctgtaagaatttctacttgtatcattaaaagatgattatgacagcttcgctaagcctcattcatgtgaatggaaaattagtgccataaagaaaattcctaataattattttctaggacgtgttggtacttttcaaacttaaactcattaaatcgatttgaatctcatttgagcaaatccacacaaactgagtgtcttattaatgtcagtctcatactacttttaggaaaagatttaatcagaaaatatgttaataaaatccacatgcatggttttaatctcctcacatatatggcaatagtgtctatggatctcaatatttgggaagtgattatcacaataatttacatattataaattatcaaagtaaattgaatttaataattaaattatcaaagtaattcaaataataagagcagacactgtgctagttgttttacacttattatcttatttaacatgagaatttttgtccccactttacagatatcataattgtgaaggtcagagaaaagtgacttgctcagggtcacgtaatgcatgtgtagcaaaaagctttttgggacatacttctgatagactctaaaatccttatttttttaactttgctacaatgtcatattgattcatgtttccagcactgggtccttcctttcattgtttcttcaagagcaagagtatgtgtctgatataaaaagcaagtactgagttttcttaagttctagttcaaggtctaaaaaataatgaaggattaaactttttttattcaacttatccattatgaaacatacttgaacaaatacacactgcagtaattaaaatcagcatgcaaaatgctttatgtaagtctagagagacagagtcaaacctcaccactctgaaaatttgtttgggttctattttcccagtgagtcagattttcctttttaagcatcaagagatagtagccaacattttggatggaaatcctctaaatatttaccacactttctcataccttgtctgtatctaatttaatataatgctttattgatgacatctcattataaacatatattacattatgtaatgttacagagtggccctcaataatcgttgagatatgagagattattgaatcctacactgaattttccccttattatatgaagtttcaccttctagtcttacccttatctgccacttttttctacgctttgtgcttctttccatggtactctctctccttttcctgtttggctacaagttgagaaaactactttcttaaaattgtgtctaaaataaacactcacagtccttaatgaggatctaaagagttcttctgtaggcaaaatacaagtgttttccatgaatgtgtaagtcataagtggtgaaaatttaaattgttttaccatgaattaagacaggccaagtagtttgtttacctgggaaatattcatggaatattttggaaacaaccatgttggaaagggcatttgagtaatattaaagaggaagggttgtcatctttcaggcagatatcaaccaacaaagtcttcatttttctccctcctatatcaacaaaaatctataatacacttgtaaatgaggcagcaagatacttacctcatgtgattttgtttaataacatttgataaatgaaatatctgggattataaaaggaaaattgaaatgtgtatagacaaactataaaacctattcaaaggggcataaagtctgggaacgtcctacaggagtgtgattaacctgatacctatgtagaagggaccaggtctgttggtaccagtgtggcacatggaaatacatcattcaatttggtcaacagatttggcacattcaaagattaaaatgaagctgaacaggatgagacctcaggatcaggtgtggccttggtgaggaagaattaattgctaatactatatataatcataattttttcatatatgaaaacttagtaaactgtatatacttttacatatggtttcaagttatctctaagcatccatttggttgtccatataggatcctcagtgtatgagttggtgtatccctaactaatacaacagatgagccagaaatgtagaattgcttaactgaaacaaacattcagacctggaactctacattcctgtaagcactgggggttcttggttaggcagctctcccctatgcagtgattcagggaccctggtaccttgcattctgtggctatgcttcctcctgaggcctcatcctttctgtccaaagagagaacatagacaagacacacagctacttaccagtcttgtcccataaatagcacacatctcatccccttacattccaatgattagaacataaacatgtggttactccaaatgcaaggcaggctgggaaatggagtccaattgtgtacaagttagaaaagaggaatttggcactcttgggtgtgttacatattaaattactacaggacctgtctctcagagggaactaccaaaccaacaagtttggtagcaactgcaccattgtatggatggaataactatattaatgaataccttaatgtgtatgcaatgtctgactacacttttttttctataagtcaaaccctcagcatgaactctaagacaatgcccttagtttttttaccatcatctttgccctttcctggtgactgtattttggctaaatactaaataagtgaacatgacaagaggcaaatatgaatgagatgttcctgaagtgttatatctaatacccaaacaccaagaatatatatttgagttgaaacttaatatttgcattccttttcactatttacttgttaaatcttagattattaaaggagagctgttcaatgtctctacactaataatgttttgaagataataaacaaagcccatttgtttattacacttcaggaacatctcatcagtatttgcctcttgtcatattcacccatttagaatttagccaaaaaatattcagctttgtcaatttatcattttcttaaaggtgacaaaagcactaataaagaaggcaacagtcaatatgtgataaactttagctatgtgtataaaaattgtctccacaagtcactatgattacttgatagatggtcaagatacacatattgccaccattgtctctttaaaatatcttcatagagtttatgatgtaggatatttttaagcgtgaaactttcattatgaaatttgcttaatgctaatatagcaccatttctgggttgcaaagagtttaatatttcagtgaatgtgtggattaaatatgtatacaaaatttgtatataacacatctttccatatgtgtatatatgtgtataatacatctgtccatatgtatgtataatacatacatggacggatgtatctatatacatccgtctagatatatatgtatatacatatatatggagacaacatatatatggggacaacatatatatggagacacatatatatggagacagatgatagagacatagagatagaatcaatgctctttaaggattttaaacaatgaatatgatcccactaggttaatctaatcaagcaacaaccaaggtaattttataaaaaaagttaagaacttctctgtttctaaaataggacagtgttttgttttagactttgatatttgctataagcatgtccttgaatgagtttttaatttcgttaacctcaatttgttcacctgccaaatagacgtaacctcttttacataggcatgttgaaatgatcacgtaagatatgaatatcagatgtctatagattgcattcttggtgttccatatccatcaatttcttcctctttccttctgtgtgattctacatttaaaatatcaccccctccacaatcagtaccaccattcttgtccctataagactgttaaagaggacttttaattcaactgacagattttactttctccccaagttaattttttgtttaaactttcacataaaaaactatagcaaggtataaataatacttcttgctctgactaaaaataattctgacactttatatcctttttgaaaatttcagtccaatgtggtgtgaaattctgggctgaaaaatctgcatttctggtgaaaatacttatttaacttagtggcacagatatatggaaggtgcagaagtaattctattttatgaattttatgacaaaagttgtctaaaagcagaaggagatcaagcattctccagtttgtagatgactctaaattctcccaggtagtgaactatccacccccgcccattagaaagctaaactaatatattttatatgcatatctattcccttcatgtgaattcaggaggaatagtcctgcctcacaaaatgatccctttatcaaagagaaaagactcaattgaataaatcatgagcttgaccagaagtaaactcttgtaatctaaccctgattggtgaggataaacaaaagggcttatatctttgaagataaatataataattctgctcctctgtaaataagtataaaattacaaggtatatatgcacattcacaggctactagaatcactttctaatccctggcttgtccatttaactttttaaagcagattgggctgaaagtatgaattaaagacttaaatgtaagacctaaacccataaaaaccctagaagaaaacctaggcaataccattcaggatgtaggcatgggcaaagacttcatgactaaaacaccaaaaacaatggcaacaaaagccaaaattgacaaatgggatctaattaaactaaagagcttcagtagggcaaaggaaattatcatccaagtgaacaggcaacctagagaatgggagaaaaattttgctatgtatccatctgacaaaggattaatatccagaatctacaaggaacttaaatttacaagaaaaaaccaaccccatcaaaaagtgggcgaaggatatgaatggacacttctcaaaataagacatttatgtggccaaaaaatatatgaaactggccagccatatgtagaaagctgaaactggatcccttccttacaccttatataaaaattaattcaagatggattaaagacttaaatgttagacctaaaaccataaaaactctagaagaaaagctaggcaatacattcaggacataggcatgggcaaggacttcatgtctaaaacactaaaagcaatggcaacaaaagccaaaattgacaaatgagatctaattaaagagcttctgcacagcaaaagaaactaccatcagagtgaacaggaaacctacagaatgggagaaaatgtttgcaatctactcatctgacaaagggctaatatccagaatctacaaagaactcaaacaaatttacaagaaaaaaccccatcaaaaagtgggcaaaggatatgaacagacacttctcaaaagaagacatttatgcagccaacagacacatgaaaaaatgctcatcatcactggccatcagagaaatgcaaatcaacaccataatgagataccaactcacaccagttagaatggtgatcattaaaaagtcaggaaacaacaggtgctggagaggatgtggagaactagaaacacttttacactgttggtgggactgtaaactagttcaaccattgtgcaagacagtgtggcgattcctcaaggatctacaactagaaatagcatttgacccagccatctcattactggatatatacttaaaggattataaatcatgctgctataaagacacatgcacacgtatgtttattgtggcattattcacaatagaaaagacttggaaccaacccaaatgtccatcaatgatagactggattaagaaaatgtggcacatatacaccatggaatactatgcagccataaaaaaggatgagttcatgtcctctgtagggacatggatgaagctggaaaccatcattctcagcaaactattgcaaggacaaaaaaccaaacaccgcatattctcacacataggtgggaattgaacaatgagaacacagggacacaggaaggggaacatcacacaccagggcctgttgtggggtgggggaagaggggagggatagcattaggagatatacctaatgtaaatgatgagttaatgggtgcagcacaccaacatgccacatgtatacatatggaacaaacctgcatgttgtgcacatgtaccctacaacttaaagtatataataaaaaagtgaacttagagttttgcattcatctttagccatttgattgtaaatatatttattcacaagtgattaaaatgaatatcacttatttaaaaataaaaatacattaaatatatttaaaaagctcatcactggtcattagagaaatgcaaatgaaaaccacaatgagacaccatctcatgccagttagaatggtgatcattaaaaagtcaggaaatgacagatgctggagagggtatggagaaataggaatgcttttatactgttggtgggagtgtaaattagttcaaccattgtgggagacagtgtggcaattcctcaaggatttagaaccagaaataccattggacctagcaatcccattactaggtatatacccaaaggattataaatcattctactataaagacacatgcacacatatgtctattgtggcactgctcacgatagcaaagacttggaacccaacccaaatgccatcaatgatagactgcataaagaaaatgtggcatatatacaccattggaatactatgcagccttaggaaaggatgagttcatgtccttttcagggacatggatgaagctggaaaccatcattctcagcaaactaacacaggaagagaaaacaaaacactgcaagttctaataagtgggagttgaacaatgagaacacatggacacggggaggggaacatcacacactggggcctgtcagggggtcgggggctgggggagggatagcattaggagaaatacctaatgtagatgacgagttgatgggtgcagcaaaccaccatggcacgtgtgtagctatgtaacaaacctgcacgttctgcacatgtatcccagaacctataataataaaaaaagtatgaccggtcttaaagcaatactcatctagttttatgggtgcttcatcagacttgtaatataagttttgtttgaaccaaataaaattactaattttgtagtttaaaatggtcaaatattggctctctaaacctttacaaaacatagcacttccaaaataaaaattaaatataatagtggtaaaattataaaacccaaataatatagatatatcaaacttgagatacaatcaatcttcttattgcagcgtttaactgtcaatgaactctttggaaaaaataaatctctaaagtgaagcaagtagcatgtcggtgctttaggaaaactggttcttctatacaaatggaattttagcaactgttgtaaacaaattaagggtaatttaaaatatataaataaaatttagtgccaagagcatgccaatcaaataaaactagttaatactatattctttaagatattcgccaaataagtgcactgtgtatcttacaaacaaatcactttactataaaaatagtttgtgagaggtacttacgttgaatttttaacaaaggttgttttttaattttggaaaaaatatttttcaaacacctgttttcccactactttattaaaatcttttggaacaatctcagtaatattactgggcaaattgtgaatttcttatataaggatatggcacatctcttcaaatgaaaatactgcgtgacagaaaaatgccttaatatatttaccaaaaatgtgagaaagacatagaaagtcgttctgagacttatggacagagatcaaagaaaacagtggttactacagtgttcggatttgtagagatagggggagacgactgcctgcttagaggagagtaaacactgtagtgtgttcaaatcataagacttggaattggctaaatctgtgtttgaacattggctctgtcatttactagctaatgacaggcacatgtaacccacacatatcgattatatcttctgataaatagggctaataatcatatataataatagacctcaggtgcttatggagatcaaaatagatgatatatgcaaattgccttgcacagtgcctggcaaacaaacaaaaatattaatccttcttagaattacttaggagaggatctataaaacaagtataactagtctgaagaccattagggttgtccttggataagacagacctaagtcctctgaatccagacctccatttaattcacccacctcttcagtagcggaaggattttgttttcctcagtgggagcagcccttggatagtctttttcctctcactttttccatccctttcccccaaatcccaccaactttctgaccccttagaattagttttctattgctacatcacaaatcacaaacttgacagcttaaaacaacacacatttataattttacagtgtccatgggtcaggattctggacacagccttgctgggttctctgctcagggtctcacgaagttgctatgaagtcgtcagtggggctgtgatctcctctgaggctcagggtcctcgtccaaactcactggtgttgggagaattaagttacctgtggttgtagactgaggtcccaagtcccatacactttatgacatagctgattgttttcttcaaggccagcaggagaatattgcttctattttgagccctttttctggggaagggcttgatcatcttttaaagagtgctcttgatgagctcagccctcccagaagaagcagccttctgattaactcaaagtcaatggctttgggaccatggttacatcttcaaaatcccctcaccaaaccacaggagtgatatccctcatattcacaggtcctgtctgtagtgaaaagagaggattatattgggcatttatgccaaggggttataattttggataccatattagaattttgctttccacacctccaaactatttcaactaaataaagggcatttcatttggcaatatggataagttttaaatgctaaggctcaataaaggtagtaacatgatatcaacatgcaactgaggtatcatcagttaatacattctgatcattctgatcaaaaccttctgtcccatattacaaattgaataatgagggaaagaggttgatctggaggtaactggttaatattttcagtgtgaaaagagagagaaaagagaaactttgcccctcattcaaacgaaaaaaaatttcaaatacctactgtttggagtcttatccagtttaccttccaatgacttaggactgagagagctgaacattagggggtctcaatcaagcagctggtaaaataaattacataatttgaaatattttcttttttctacgatataattcttatgactccatctccaaaagaaaaaaagttccatttaaatgaggcatcactgcatttattcatggattcttatatttgttgaaaagccttagttttagtctttcatgaacaagaaactagatacagcacacagttttatacctttcttgatgaaaagaatataattcacaacctctttcctcaaacatttaagcaaaatttaagaagagataatatgcaaacttttaactgtgagcaattttttgaaaaatccttcagatggtaagctatgctgttaggtctttggtatagctgtgaggtagaggagaatggagagagaaacagaatgggaatgaaattaatcattacttaattgattcaataaaaatagaataccataaatagacttaaatcatatctaagtaaatttctgtcttagagtttcatctcatactctattaaacattttcaacttttcttatgcattaagagaaccataaggggaaataagcaagcactttgtagccagaaagaaccaccatgggattcttgaggtcgcactagctcactggataatattaggcaagtgactgaccctgtccaagattctattctttaaaatcaagggtaattgtacccagtttgcaggattgagttgataagaaacacacacacacacacacacacacacacactacacaatacactacacagtgcctagcacatgaaagagctatggtaactattgtaattatgagtctttatattgccaatggcatgtatagattgttttaagcaagaatatgatagaacaagcatccctggtaacctgtcatgaaatgctggggaatgtgataactgtaaaatcattgagtaagtcaacggagaagtgcacgttagttatttggtttaaagaccattataatgttattattacatgacacaagtaagactacctgggaaaacagaagctgattctacttaaatactttatttacactttcccatagcctaagaaaagatagtaaatcaggaaaaaagggcaaacagatatattaaacataagggctagtatttgtgctgctaatgaaatttgtatttggtattgaccttcctggcagccaaaaaaaaaaaaaaaaaaaaaggaagaaaataatatattttaagaaaagaaaagtttttatggagtttattctgataatattatctcatattgttctttgtgtgttagtgcattgctaaaggtattttcatttttgtagtctatcaaggactgttaatagaaaaattagagcgtaataaaagatgacacactgaaggagatttgttcagctaatgaggcctattcttgtggaatcaaccttttcccttcatgctatacctctatttttaaaatttagcaacaaagagcctagtcaaagcaatttggaactttggccaatacatcagaaaatacacacataataaaaatcaacattatacagataccatttgcagctgttggctctgctgagagcagaggttcccatgtacaaaagatttgcctaaaatctcagagtcaagaaaattcagttcaaatccatctacaccaaagtgagtgtaggctgatcactacacttacttggatagttatttaacaacctttaaatgaagaaatggtactatactgatgtcaatgcccacaacagggcctagtacatcggatacactccacaaatatgttttaagaatgaatactattcctctgtgatggtggaaccagtttggtggctaaggagggttagttgatacaaatacttgatatttatcaattagaaaaggggaggtggtaacaataaaatccctaggtatgtatcagggtttctcaacctaggcacgcttaatattttgtatcagataactctttgttgtgggggctgtcctgtgcattgtagaatattcagcagcatcactggcttctgccaactagatgttagtggaatctcaagttgtaacaaccaaaaatatctccaaacatttagaccccatttgagaaacacagacatatatgaacttgtgtgtgtgtgtgtgtgtgtgtgtgtgtatacacacatgatgatgatagataatagctttgttgcatattatttgcttttattgtactttgaatatgcgagatcaattattttcaattattaattttatgttctttcaaggcataatagataattaacacaattagcccaatggtcacttattttgaaaatagcatgaatatggtctaaaagaattgagcgttttccaaaatcacagctaatgtacttcattgcattgcttatggttcttgataaaatcacgcaaacataagcagtctgatgttatttttttgtttacagtattactgtgttgttttggttaacagaatgaaaaacagcactgtaatactacaagtaaaaatgttttattcttagtttgtttcatcaataaaagctgacatttttgcaagaaagatgttatactattgaaattaacttttagtcaattgtaaatgattgtattatatcggtatgttatcatgaagattagaaatcatttcctacagaatcatgtttttgcttcctcagcactgtttcaattgaaaggaatttgaatgaagtgcatctcattactaacataaagtagatggagcttgaataatttttatatttattttccatggatcgctattacatttcttatctatccaaattttataaaataaattgttttaatccattctttggagaggagcaatgaatttatttttgcaaaagctatgcatctgagtatattgtaatatgcataaagctctgttaacacagttatttatataaaaagtgtagctgccttaccttttatttaatttacatactttatttactttctgacaggttcttctctttgcatttttatttgcaaaccaaaaatgtcttttcagataagtcaactaaaactttgatgtactgtataatctaaaactctataaaatgttttatgtattgtataggtttatatgaatttttagactgaggatatagaattttggaactatttcattaatgattcctatatggtaacaccatacttcttaaatatgatgatagagaattgtcttttgtctgagatcatgtttaggaaaacctacagaacttaagcccagtctgtttcaaatagaaaaacatatctctggctatttttaagggttgttattttttctcaaaatatgaacttcacataatatgaacatcttaatccttagagaatttggtacatttactgtaaccttatacaaaagattcatatttttctactcaaatgttggaaacaataaaagttgcccttgtatgtttcataaactgtaacaggaatcacccaccagtaaagtaataagcacacggtgtatcaattcaaagacgtccagttttagaaatataaacttaatcctcttcccctcccttttttttttttgtatttagcttttgtaagcatggtttgtatttgcataacccaccattcatattcttgtgagttcatgatataaataatttgaaaaatttcattcagttccccaaattattctagtcattatggatgattcatgagaggattaatctcttggatgtgacataaaactagagaggaaagacactacctatcatatcatttgcagttaagaacatgctgcatatctttaagctttacttaaagtgcttatagtaattgggtgtgcatgccttagctccgttaaaacccaaacagcaatatgggagagtgtggtttgttttttaaatgtgcaaggaaggaaaattagtgaaatctgtttaagtcacaaaactgcctcattcaggacccaattcagcagcatggaaaaagtaactcaagttaactgtactcttagcatatgtctaagctcacaaatttcaattcacttcaaatttctttcttctcccatggatctgcctgcaaagaaaagagatacaaagatggcaaaccggttcaacagttcattagccctagattctcttagggttttcagaataaaaacgtgtccatttgcagaccaaattcctttatgtgttggaatggcaatgcgcctcaagaactgtttacgttgcattgtgggccttccttttttttccctcttcaccctctactcctgccactgccatacatgattacacacatgcatatggagttaagggtataatgtattttgattttatccatgcaagtaaaatttggtggaggaaacaaaactaagctaatgaacaaaagatttcagaattatacagagattgtggtttagtgacctaaattgcaccataatcctttaaaggattacagtatttggataggaaaaaagatttatctttctataatggcatctctgtataagaggatattattggatatgagctgcatggtagcagcagatatttttctccacgtctttcggcaattcagaatagttctctgatccatctgagaagtagcactgaagaattagtcctcatttataatcaaacattcttgaataacattttcttccaatttttgttttaaaggtctaacatttgatcgtatgttttctttagttaactttctatattatatggcaatctctgcagttatttttttcaaagataaaaagaaaaaaaaagcatgttcaaaaatgtagaagttatttttgcagtaacgtatgtcatgatttttaaacattcaggcctttaaactttttttatagtgtatgttcttgccaatcccagcacagttctacaaagtaaaatatttggcagtgaattcatattaacagatggaacaagaaattaacacgtttttgcttcgctaattcacagttcttttaatacgctaattctaaatcacctgttctgactttgacaggctacagacacctgtttggggtaatattccacagctaattattacatgagaaattcagtttccaacaaaagagtttctgtgtgaaattgccattgtagttaacaaattaatatcaactatatacaaatacatttctgatgtcttaatttaaatacagctaatatactactcatctataactaaagaatggtatataaaaactaagactgccctcttagtgtttgaattctgtctgtcacactttacaccatggttgcactgatcaagtcagaatgttcttcccagtagcagtaatttactgtaatactgtattttaaatggcaggaaaagagtatagaattttcaagtggctggaaaaattcctaactgtatgttaaaaatgactcaggagagttaaaaaagaaaaatactgacaagatgagagagaaaaaaagaaaaacttagcttgggtagcataatatggaagacagaacaataaataaacaggaagtccactgcactaccgagtttttgaagtatgacggacttacatgaagtcccatgaagactgttgatttgtttgctaagagaaaagcaagtaaacgatgccagatattttatggatagaaaattaaatacccgcttcttataactcaacagagttataacttaatagagaaactacttctattttccactaaaacctgattttctttatcttctatattgttcttagttattctgacatggtcatttcccctgtgtcacctcagacaacttcctttaacactaactcctttccctgcctccaatttcccccataaaaaccatgctacgggaaagtgtggaggcaaggagtgtgtgtatgggagggtaggttggtggaacaagaagcaaaaatcagaaacgtaaggtttttagatgtttgtaacataacgacagatgctgaggtagagtctatctttaggtttgccaaaggttccattttgtgtgtctgttttttgattctctctaattgctgttcagctttgtatgtggctttgctaatgtgtcttctgtagccacattgtcgtttctttaattaaccttgatatcctagtacccagatagcagagttcatcaagcaggcacttggaacttttaacattcatgctgttgtactttgatttttaagagttattgtacaaagtatatttttaaaatgcatttttattctgcgagacttaaggtggatgaggagagggctttttttttttcttgttttgttttttgtttttacatttagcctccagcctccttgtaattttattgtttttctcccaaatgctactctagaaagcacatggtctttctctcaaaccatgctttatgacattgctatttgcagaaatttaactggcagcccaccccaggaagataaaatcctgtttcatccaagtttggttccctcctacacccacacctgaaactatatttctgccagagcctacattctgctaaggaagaaaccaatcttttataatacttcaacatacgtgaattttattttatttttaattaaaaaattacatttctcatccaaaaatgctagatgacatttaaagctagaaaagtgtttccaaataactcacctttacaattaactcttatcaggaccagatagttatttcactgtaccagggcaagcacatggctgggatgaggctgggcagtgaaaggcctccatgatgattgtcactcgatctcttggcaacgtgcagaagcacattatcccacaggatttgctcagggctcaaagtttgtaagagagttactggtacataattggaatgagaccagttttattttcagttaataagatgctcaaagataaatgaaacttcctggttttcaagggagaaaaaaaaagactcttaggaagcttatacatctcttaagtttttcctgaaaacatttttagacatacatttgctacctctaaaacaacttgaatgaattagatctagatgataatggaaaatatttaaggtttaatactgaaaggataatgaccttgcaaaagtgtgtttggcaattatattcaatgtgaaattcttaagaaaattgctcaagataatgaatgacatcacaacgcaatttcactcatctgtcctcagttaaaacactttgacaaatcaattcattaataagtaaatctaatatccctgtactgtcctaccttaaatatactcattatatataatgcaagacaaaattatgtaattttgctatggactaatatatatgtacgtatctttatttttatgtatgtatgtgggtatccacacatacatacatatgaatacattttagggagcctatttaatccttcaaggaggtttgcagattacaatgagttcttgcagcaacaattatatttcacttaatacttttctaagcaagtagaattttaacatatcagcctttcataaaacagatttatgtaactagcagatgctattaattgataatcaccatttatagccttatacatattttaaaatagttccctatacatataacattacggtactatatttagggttttatttatagaatatattttagaaggaattaggtagctttcatttaaaaaatttaattttcttaatttatcctaggccaattctattaatttgtcatcttagaatcatgatattattataataacaatagcttactttgatatacatgtggctcccaagcacagctaaacataagaattgctgggataatttttgaaaaatacagataccagaatactaactgtattgccaaggagtgggacacagctgtctgtattttataaaaactccccaggtgctcctgtgcaggatgggagaaaatgctatcattgcatagtttctactagccagaaataacagttacagaataatactaataactattacaggaacaataccaccaataaggacaccactaaaatctactctctccaacattttttaacctaaaaaatgacaagtcgtgttatatattcctgaatcaccttaatcctttaagaaataaatatatattaaatatttatttaggcctggagcagtggctcgggcctgtaatcccagcactttgggaggcagaggcgggtggatcacctgaagtcaggagttcaagatcagcctggccaacacggtgaaactgcgtctgtactaaaaatacaaaaaattagctgggcgtggtggtgcgtgcctgtattcccagctgctcagagggctgaggcaggagaattgcttgaacctgggaggtggaggttccagctagccaagatggcaccattgcactccatcctgggagacaagagcgaaactctgtctcaaaaataaaaataaaaataaataaatatttatttgtaaggatcaaatattttttaattcaaattgttccagacggggcattatttaagaaaatcagactttcctcctagtttaggtaggaaatcaccaaccaaccaatcaatcatcatcaaaccttcctgcaaaaatgccattctcaaacaagcagtattgacaactgctgagatttgttagaaatgcagaatttcaggccaccctggacctactgaatcaaaatctgtattctgccaagattttcaggcagtttgaatgcacaataaaatttgagaagaactccccagcacttgtgtgtgcccacatccaagctaggtgctagagtacccagaagcaatataggtgtgcagagatttatctttgcctggcagaatctcgctatttgtaatatatacatatatattaaaatatatataacatatattaaaatatatgttatatattttaaaacatatattaaaatatatatgttatatatattttaatatatataacattatagactttggaggctttcatttgaatttgcatttgagtcaaagtcctaattctggctactgtctctgatccatcatgagattctctgatcaattctgtctccaaatatgtaatctcactataagtatcaaacaatctaatgcctcaaccttcaaaatgtagctagaatctcaccattatttccagcctagattacaataaatcacttcctaactcagtccctgcttctatattcactcctcttatagtatattttccaaaagtagtcaagctcagtgacttcaaaagactttaggcttattgttcccattcaaaattgaacttacgtagttatagtttatgtactttaggtgtctgctcaaatggtagtgcctcaaataaacttttcctgattattgcatttaaactaaacttcctgtctatccctctctctctctctccaactttaccctgcattttcctttagggtcctgtggtcctcatcactctttgtaagcaattgtgtcatattattaaatagttgactgcctgtcttcacttggaaatataagatccagaaaatagacactttgtctttcttgtcccccagtgcctataagagtaccagataaaaacaggaagcaaataaataatttatgagtgaatgtttaatcaaattagtgagctaggatattcagtgcatgtgtggttattcattgagtgtgaagtgtattcattgaacacctaatatatgtcactatggcagactaaaaaatggcacataaaatatatgcttttgagaaataaatacatgaataaacaataggcatatattgcacaaaataaattctttgggagttgaaggatgatttcagtggcatgaagtagaagaaagaagacttgttttgagaagtaggtgatatagtgatgacattatcacaagggcaaatagcaagctttagggctgaaatatctagagtattatgcgtgaaacagcatacctgtggaattgacagttcattagaaagacatctagtgactagcttttggtggctttacctccaaaactgaggaatttgtactgtattctgtagataatattttcgagaagatagttatgtgttcataaccgtggtttggggggattcatgtaaaggcaacatacaggatggactggattaagaggctgcaaagacagataactggttaggagattgctcatccgaagcggaaagaatagcctgggtgaaagtgtagtattaggaatttaaagtattaagtgaattaataacattaagtttcagaaaagcagatagcatattacttgcatagggtttttgttttgttttgttttttgctatcaacaccttcatcactattatggcacataaaactacccataaaattttatccttttttttttctttgatagagtctctgttacccaggctgaagtgcagcggtgtgatctcagctcaatgcaacctccgcctcccgggttcaagcaattctcttgccccagcctctcgagtagctgggactacaggcacgtggcaccacacctggctaatatttttgtattttttttttttagtagagacagggtttcaccatgttagccaggatggtctcgatctcctgaccttgtgatctgcccacctcgatctcccaaagagctgggtttataggtgtgagccaccatgcccgtcccataaaactttcacacagtcagaacgataagggtactaatataagctgtgtagataacaatccttccagtgattatggatattatcatttcctgttgatttaaggctcaaatgatttagcatagcagtcttggcaattatgaatctaaaaacgggagtttattatcttagaaaaagccatcacttcacttccagattaagggccttttttttttttttttttttttttttcgaacagtcaatacaagagacaagaatcttttcctatattcaaaagcaactttcgtttattgggtggtaaactgcttacaggcacaagtcttttaatcttcattgcttcctatttctgagcaacagttttcttaacccaacatgagaatattaaaatcgacctggtaggatcatgatgagggttaaatgacataatctaagttaagtctcagtctctatgcctgagtagaaagtcaataaatacatgttgccttctctttcccccagcacctagaaaagtatcttgacaacattaatgctcaataactgcttgccaaataaatgaatgttgttgagtttgcactaactaaataatgactttttaaaccattgaccaataagcattcaaatgatcaggttccgaaaactcccgcgcaaatatcttatagcaatgaacctcaactgcagtcctgaaattttttcttaatctcttctagcccacaaatttctcttcctatagatttgtgtagttacctacttttccccttaatattcattttagccatctgtctcctatctcctagaccacaatttgttgattacttgccaggatatatattttcaatgctcttagattgatagctccatttctttttctatcccttccactcccctcttgtgcatggcaaaagattttctttattggttcccgccttttttttttttttaatatggtgtctcactctgttgcccaggctggagtgcaatggtgcaatctcagttcactgcagcctcagcctcgcaggttcatgcaattctcccacctcagcctcccgagtagctgggattacaggcgcgcatcaccatgcctggctaattgtatttttgatagagatgaggtttcaccatgttagccaggctggtctcgaactcctgacctcaggtgattcacccgcttcggcctgccaaagtgctgggattacaggcatgagccaccgcacctggccaggtcccacttttatttaatgctgttaatttctattttaaataacataatatgttcccatattctgtgctccccaacccctgtattctctcttctatttattcttctttcctacttattttatgaaactcttttctgatctgcactataaaaatattttcatctctttgcccattttgtctgttgcccaaagtattatcttcctaattggattagaaaactcatctttatagggccttttatgtgttctgtgcacttatggttttctgtaaacaaaaataataaataacaggtggagagctaaatatataactcactaggaatggagcatttcaaagaagaggaaaaggctatgtcagaaacattctacatagagtacaccaagatcggtaaaaatgtaaatggtcttcaactgttacatttaatagactaagtcatgctgtttattaatcataaaaagtaaacatttctacttatctacattttttcagaaaggtattgtaataaatattattgtaagtgtgtgtgtctgtgttgtaccaccaaacatgaaacgtctcctctgtcctcatctctacccagttcttggtaggtagagagacagatggactcaatgaaagataattaaaactatggggaacttgctaatataaactacatgacctgattaggattctttagctgcatcaattctgtcttcccatattttaagtcctaccagacaaaggaggggccaggacagtggtgggctggagctggctgcagagctgattgtgcacatctcttctgaactccacattccatgacataatgtcagccctaaaatggccgcaatgggaatattcacagtagggaaattgataaatgccacaaatcaggacttccccaccccccccccccccagagatcctatgataaacatttatttgcacagcattcacccagggcccagaaatttggggcaaacatatgctgcaagtcacttgactataattgagagaaagcagtaagaagaccctagaatctaactgggctaagcaaagcgggacgctacaatctaactgggctaagcaaagggggaattcagggatgaatcaacaagatgctgctccgggagaaaagatcatagcaaagagttaaaaatgagactagacagggaagcttgggaaaattctcccagcaaaaatagggtaactgcatgttctttgtattggatagttgcgtcccctggtgggttagagagggaggttaatggattgggtttttaaagccctaaagtgaacaggatgaggttttaaataaaaagtgactttttaagattcatattgctgcagagctttgcgtgctctgcagcaatgtgactctatcaggtaacaacagatgtacctggtgagactagatttctgtacttaggtacagctgttcctagctgtaacaccaccttgcagccagcaccaggcttttgcccggggcctaacagcctccacttcctatggggggattcacagccacggcccttggatagtcatgggtacccctggatgcctggatgcctaccctggctctcagggcccactaccattttcctggtatcctgagcattttcacaggggaagagcacagtttcagaatgaagatcgtgtgaatgtggaaaagaggaaaaaggcctcagagaactagaacaagcacactcaagtgtatacaaaacatataaacacatggtaactgccccagtccaatgttaggtcatggaaagtataggaccttttatattgcaagtgacaaaagctcaactcaaacttgtggaagcataaaagggaataaactgacttaagtccctttgctctcctcttgtccactggttttatttataaacagttttgctctcatagtcggttcacacaaatgtgctcctccttagcactcaggcaatcagctaataggagagagtgcttacttctggtaacttccgggggaaagtcctaagagggctgttcactggccttgccgtggtcacctgcccttccctgaaccaataactatgagcagagaaataaaattttcttctggactgagatcctctgccagacatggagaagggcctgggccccataatctgagagtacttcctccaaggaaggagtgcaagttagctagagagagacatctattacaattctttagttttgtttttgagacaaggtcttgctctgtcacccactttggagtgtaatggcactgtcacagctctctgcaccctcaatcttctgggctcaagccacctcccacctcagcctcagaagtagctgggaccaccgggtacacaccctgctacatttttgtggagacaggtctctatgttgcccatgctggtcttgaagccttggcctcaagcaatcctcctgccttggccacaattatcttcctaatggagtcgtaggggacttgctgataacctccgtaagtagatacaagctctaataataatcactctatctagatgattacttcttttcttgctaattttcatctttcctggattctatgccttttaaaatttctctctcctgcacatacccagtgttctttatttctactgtttttggaacagttccaatgaggccgctcaaccactccctgccacgcccaactgcagatctgtatcagagttgagcactctcagtggctggactcctaagcagtttgtttctgtcaggctgactgatggcacttaggagatactatgttgatttgccaagaaaatccgtgatctaagtagaaggggctgctttcttagcataaataagctaatacatttactatttaaggtgttacttttattcataattaaaaagtttaatcagagagtgggctaccttctcggtaactctctagagcccaccgtaagtagcttgtgaaatgaatggcacagaaataatagaacaatgatagttaatctaaaatgccatgatggatttcctactaaatgtagaaatacaataatgtaataacaacaaaagggatattcttaataatagcaagtaaccacaaaattaaacattttcctttagttagaattttgaggcttaaataagttttgaagttttccattttaaactgttgcctgatgggaaaaaccaaaagtcagcattaccgtggatagaatgacctcaggatctagcctaattattgctgttactgaattgtttgtttacttcccgtctgagttgcatgatgcttcgatgtggtactggattagagaaggaggaggaattcatgagtgaaatgtttgtcctgataactgggagaatggctaaggtgaaggtttaatgttgtaagtaagcaacactattccatttgcaatgatatgaacttaattccttatcttttaatgtttgtacttttaattatcaaccaactggttgtctgtcttagactaatgaaaattaggtgactttggaaataaagtttggtgctgaatagttaaaagcttgtatccatctgtccctcccttgaccaaagcttccagtttgcctaggactctcttgggttgatgtatgtttttcagtgtactttttactttgtgcctccttgcataaattgtttttatttagaaaatgtagataagctacgtttatgttatgtgtgagagtgtttcacagattgagaaggaacacgtacaggtttgttacatgggtatattatgtaatgctgagatttgggcttctagtgaacccatcacacaaatagtgaacatgctttttgttttgaaacagtggattgctcaccaaaatcagtggaaatgggtaatgaatgaggtcataaaagtagctttcttcaggaatctttaggatctgatgaagctggatatgtgcattgcccaaagatggcttaagaagtctatgaatgtgggaattgacttggacttgatgatcacctttacttagcacacaaaactataaacacttcggacagggatgaaacgtctgaaagtgtgaggaaatttacttcaacattgaaaaatcagtcttacctcaaaaatgattcagtggcccattctgttttattatattttctaattaaaaagaaatctaggctgggtgtggtggttcacgcctgtaatcccagcactgtgggaggctgaggcgggtggatcatgaggtcaggagatccgagaccacggtgaaaccctgtctctactaaaaatacaaaaaaaatcagccgggcgttgtggcggacacctgtagtctcagctactcctactcgggaggctgaggccagagaatggtgtgaacccgggaagcggagcttgcagagtgagccgagatcgcaccactgcactccagcctgggtgacagagcaagactccgtctcaaaaaaaaaaaaaaaaaaaaaaaaaaaaacacctaaataggcagacaacgggccatgtatcagtgaatttcaaacattaggatttccttaaaatgctttataattagctttggaaaaactatctgaagagatgtaagcatgaagaagttgaggccatgtgctatcccatctcatggatctgggcttcaaatgtcaactctactacttactagttttagttcagtctatggtattttggtttaaaattgcattataaatgcacccacatacataggaacatacccacacacaaaactacaaggagaacaaagattcgtatgtaatcatttctttccttagttataacatccactaaggttaatattttttttacattttgtttttctaacattttcttcctgttccttagaattatagcatattctatgtggactggaaaaatagtcaatggttttcttttggtgtttgcgttcttaattcctgaggtgaattacatgctaaaaatgacttgtatgtctgtttggtgggctgccaccaacatagaaagtctgacatattttccgtggaagaaatacttattagtttgtaacctaatatttatttgcaccgtattttagtgaggaaatgaaggcagagtagaaatgaatttgttcaaatttaagcattcactagtactttcatttctgtacttgaacgtacagggttagctgggaaaaatctgtacattggttttcaagccataatcttacgttcagattttgtatgctggtccgttgtgtaaatatgaatttttaagcaatttagcatttcatcaaagtaacacggcacttgattttcattcatccatatgaaaacaattaggaaaaaatgccacttatcttaaatagtatttgtcagattttcttcatcaaacttggtaaatacagatctcttgacattttgatgaattttcatcactctgtggtaaacctaagtgactaggctgtggcccgtgaacagcttttgtttctatgcgacattaaaatgtattttttaaaaaacatgattataatgaatattcaaaattagattcattctctagcatgtgcacaataggtcacaagtcatggctggagaagaacacttactagtcaatctcaaggttttattatttcttatgaatcacaatttttttcagagatataactatcaaagaggaaagccagctaaacatacaccattttgagtttgcctagacaactctgaaaattcatttcatatgtagttaacttaaaagttactgtatttccctagctgtgtattgtcttgactcaaaatttcttggaccgtatgttcaagacagcttgaaacagacattataaatgaagaataatcagttaccatagttcagagcatttcttcaaatactcttcaatttctggttccagcaaaattttatttacttaaatataaatcctcttttttaatactctagagcctcctcctcaacaaaacacctcattttagtacaattgtttttatatcctgtcacaggatgatgatgataaatggaaaatgattaagtatattgtttgtcagatttcttctttcacaattcaataaatattcccagagtcctccctagtcaccttccttgcaatgattatcaaacggaaaatatttgaaattcaaggaggaaacctcgtttttattttggttgttctccttttccaaaaaaatacaaaacatgaattaaaacttttgggagcttacaaaccaagttaattacttagagacattaagtcctttatttggggaccttgagctgttgtatacttcagaaaaaatcactctaagcctctctttccatggaatgtacatttgtaatgaacagtgcttctatgttggttatactttcattatttaaatacttgatttccatctataatgcacttattcaatgaaagtttattacatctactatttattatatgccagaaataatcaccaggaagaatgatgacaagtaaaaaaggaaacaaaagtaaatcctttccctaaatattgcccacactgatcttcatggtccccgaaaattccacactattttgcactttgtggtggtaaattatagggtctcagttgaaaggctaattttattatttgctgtatttgtctatttctaaacttccttgtttcagattgatcctaaaattgcttacatgtttattatatcaaatacaataaggcaatagattagagatacttaaccaaacagaaaaacgtcactggggaacttatgctatgagtgacctacatttttatggtactttattattttcaaagcccttttctcatttaatatgttgttatatattctttccagtaatcctgtgagtaaacaacaacatttgatttactattatctgagcaacacttatgaagtagttgcttttactccttttgttctaagtgacaaaatggaagttcagagagttcaaataacttaccaaaagtcacactgctacttactgacagagctggaattcaaactcatgtctgcctggctctacacagcactattgagaaagaatgataaacggctttatcagctaaagtccttgttcattcactgagtcttttgtatcttttaggaaccagcctaaatctcttctttaatagtgacttctccaacaattaactcatttcaagtgaccaattttctgagttactgtacatgccactcattttgacatttaattacacactattttccaatattatttctgagtgtatgcattcctgacttttctaccctgtgatatttaaatgaaagcaacactccttcatgctacaaagtctcaataaactaggtattgatgggtcttatctcaaaataagagctatttatgacaagcccacagccaatatcatactgaatgggcaaaagctggaagcattccctttgaaaactggcacaagacaaggatgccctctctccaccactcctattcaacatagtgctggaagttctgggccagggtaatcaggcaagagaaagaaagaaaggaaattcaaataggaagaaaggaagtcagattgtctctgtttgcagatgacatgattgtatatttagaaaaccccatcatctcaaccaaaaatctccttaagctgataagcaacttgagcaaagtctcaggatacaaagtcagtgtgcaaagatcacaagcattctcatacaccaataatagagagctaaatcatgagtgaactcccattcacaattgctacaaagataataaaatacctagtaggaataccacttacaatggatatgaaggagctcttcaaggagaactataaaccactgtgaggacacaaacaaatggaaaaacattccatgctcatggataggaagaatcaatatcgtgaaaattgctgtacggcccaaagtaatttatggattcaatgctattcctatcaagctaccattgactttcatcacagaattagaaaaaactactttaaatttcatatggaaccaaaaaagagcctgtatagccaagacaatcctaagtaaaaagaataaagccggaggcatcacactacctgacttcaaactatactacaaggctacagttaacaaaacagcttggtactggtaccaaaacagatacatagaccaatggaacataacagaggaccccttccctacaccttatacaaaaattactcaagatggattaaagacttaacataagacctaaaaccataaaaaccctagaagaaaacctaggcaataccatgcaggacataggcatgggcaaagacttcatgactaaaacaccaaaagcaatggcaacaaaagccaaaattcacaaatgtgatctaattaaagagcttctgcatggcaaaagaaactatcgtcagagtgaagaggcaaactacagaatgggagacaagttttgcaatctatccatctgacaaagggctaatacccagaatctacaaagaacttaaacaaatttacaagacaaaaaaaaaaaatccaaaaagtgagcaaaggatgtgaacagacacttctcaaaagaagacatttatgtggccaaaaaacatatgaaaaactcataatcactggtcattagagaaatgcaaatcaaaaccacaatgagataccatctcacaccagttagaatagcagtcattaagtcaggaaacaacagatgctggagaggatgtggagaaaaaggaacacttttacactattggtgggagtgtaaactagttcaaccattgtggaagacagtgtgaagattcctcaaggatctagaaccagaaataccatttgacctagcaatcccattactgagtatatacccaattaattataaatcattctataaagacacatgcacatgtatgtttatcgcagcactgttcatgatagcaaagacttggaaccaacccaaatgtccattaatgatagactggataaagaaaatgtggcacatatacaccatggaatactatgccaccataaaaaaggagttcatgtcctctgcagggacatggatgaagctggaaaccatcattctcagcaaactaacacaggaagagaaaaaccaaacactgcatgttctcataagtgggacttgaacaatgagaacacatggacacagggaggggaacatcacacaccagagcctgtcagggggtaggggagtaggggagggatagcattaggagaaatacctaatgtatgtgacgagttgatgggtgcagcaaaccaccatggcacatgtgtagctatataacaaacctgcacattctgcacgtgtatcccagaacttaaagtataataaaaaaataggatgaataaaaactactacttcatagcacaaccagctgactatagtcaacaataatttattgtacattttaaaatcactaaaatagtataattggaatatttgtaacacaaagaaatgataaatgcttgaggtaaaggatactgtgtttaccctgatgtgattgttatgcattacatgcctgtatcaaaatatctcatgtatcccataaatatacacacctactgtggtacccacaaaaattaagttttttaaaaagtgacaaaatgaaagcaacttgtacatttatattctctaatgttctccttgatttctcaatgatacaaccttgccctcacaagtgttaaagcagtaactttactatgctcaagtaaggtgtggcaggtgaattctaacagtgcctccatgatctctgttccctggtcttatgtctgtgactaggttacattatacggcaaagatgatggatttggttacattttatggcaatggtgaatgaattttgaaaatgcagttaaggtcccaaagcagctgaatttactcaaaaaggagatgatcctgagtgggcctcatttcatcatgtaagttctttgaaagcgagtctagatgtgagagacaatcttctactggcctcaaatcagaaaacagccacattatgttctgagtatggagaggggtggcctctgggaggtgagggcctcagcctcaaaaccacaggaggtgaattctgccaagaagcatatgagcttgaaagaggaccccaaagcctcagaagatacagtaaccccatctgacaccttggttacaacctgtgagatctcaaagagaggacccagctcatctgtgcacagacttctaacccatggaaactgtgaaataagaaatactgtgttttgagctgttaaattggtggcaatttgttacacagccacagacaactagtacgtaaagttatatccaatgcactataaaacttgtcaatttatgtagaaattatatacacatacacatgtaatttatacatatttgcacatacacacccccctccgtagttcagcagtagcatcactaacttagagttttaattgcaaaactttcattgaagctgtggagccactctacaaaagttatgagagaacatatttttaagaaaattgcccccctgccctccaacccccatcactacaaaaaaaaaaaaaaattagccaagcatggtggcacacagctgtagtcccagctactcaggagcctgaagcaggagaatcgcttgagcccaggaggcagaggttgcagtgagcctagattgcaccactacactccagcagcctgggtgacagagcaaggctctgtctcaaaaaaaaaaaaaaaaaaaaaaaaaaaaaaaaaaaaaccaaaaacaaaaaactaaactaatgattaataatttcagggggaaaattggcattaacttcaatgtttagtgtttatttgtcaaaagcaagacagaagagtttaagtgaaaattggcctaagggatctgtaaaatataaataatatggtgtaatgttaatatttcaacattctgcctaaaaaattttgtagatataacttttaactatcctaacattttcccatcaaattttaatatacaaaacaaacttgcataatagaaacaaatttctcaagtggcactgtataagacaaatacataaaatacccatagtaatttgtgttaagtttataagatttcataagtagccatgtatgattcctaagtccctgtcactttacagatgaataaaatctatatttttcagtctcttgagaacattgtataaaggcaaagaaacctagtgaatcaggccttcagagttttgaagtagcacatacacaatattgctacatggtttatgcaatttcaacatattacccaaatggaattatgatttctaattcagtttgtccttaaggtttcatttctccatcagtgatatattggaaaactcctctaggcaataaatatacacaggatgagttgtaattttccatttctaaagtaatatgtttggtaactgtcaatgtccccagatcaatgtggatgtccatagggaaagtacttatttgcacattaaacataaataacctacattatatgcatgctctttagatttccttatgaaggatgttgaagtaaatattactgaaccattgtcgctttctctctaaagatcatttctttggtttgagttgtaagctgatggtcctcgttgggcccttcatttaatatggacctttgagttgatcataaatcatttatttcagcttcaaaaggacagaagtcatacctgcagcaagaggtggctaggaagatcagatgtgaatgaaggagtttcccaactatgagcccacacataaaccagagttgtcttttactttattataatacataacaaacatatatttttccccctgggaactacattttagcaatatatttttcattattttctattcttctggacattatacactgattgcctttaagatcccttttgtgaagctttccttgctccgatcgctcttcttcccatcccaactttttataaaaaaaagcatgccatctttaggtcaatagtgtaccatagacctatataactttatgctggtacttaactatacatatttgtttatttctgtctcctttactagactgtccacttttcagagcaggaacagtgtctggtacatgatttgttttgttaaaatccagcagagcacataatgagtaactatcattcaataaagtgattttgatgttatcctttgaaaagaaatctatgaatgcatgagtgaataatgaaaattttagcagtcagattttagcagcaaggattatatagacacatctgctttcatatatctctttccaaaagaaatattgttatgaaaacaacaaagtgctcttaagaggtacatgagaaaaaaattgaaacatgtagctactttagaaaggctaagattttcttctgaggtaaagagaaatggctggatattttagcagtagaggtagggttaatatcatttcttaagcctgacctcaggtttaacttgtgattctaatgttaatcattattacatcttataagacgtaagcttcacacctcataaatttagtcagcttgtttctactatccagagccatgttaaagaactgttttacaaagcatacatttctagagttctttctgtgccttttttcaaattgtttcttgtccttctagctaattttcatgtggtacctgccacaaaaccctagaaaataataatgcagatgtttgagtcataagtggtccatctctctttcggtcaacctattacgtaaataaaattgtacccttcctttcacctatttgtacaataattagatcatggtatcaattcaaacaaagaaattgatgtcctgggaactggttatacaaatacattatttcttctctttgaaatgagtagaaggaaagggaactaataataaaatatcacattattgcctacccactaaaggcagcctgaaattttacaaaacagtcttcctggggtcgtctcgatggtgagatataactgcctttcataatactagaagtacagacatcctcatatttttaaaaaatgcttaataagatcttcatctgttgtatttttcagttgagatcttttatgctttatattgtatctaataggcctattcacaaatgaagagtatatgagggaaaagatgaatatcacttcataacaagacattgaaataaactatcctaaattatgaaagcttcccaatgcatgtggcttttttcttcacggcttttctattcaaatatcaaagtgcttcaagtggctttgatgacatacttatgaattcatgaaagtgtttttcataatctgctcacctttggtgcttagaggttacgccgattgcttttatttgcttggctggaaaagaagagctctgagtgggatgcagatacataacacttcaaaacagttccttacattgtcttagctacttttcagaaacttgctggaactctctacccaaacttcaggcaatgataagaataagtgtcaaatattattagttctggagtataactactaatttttgtttcaactgcatagtacgtataaaaaccttggaatatttccagttatcttcactgtcatttagtccttaaaacccagaacagacatttaaaatgaaaaaaaaaaaaaaaagctaccattatattgaggctgcagatgcaagttggcatcgtcagaagatgaatgcttgtagccttcactggcaacctgaccagacatattctatataattaaataacgagcagtttaaaaaataaaattacaacatcttgggcaatcctttgtgaataatggagtaagcaggagagagagaaaaattccaaatgtgattagcagttgctcttcatgagaaattttctccacctctaatatgacttttctgaaaggctttaatgaatactttcctcagttagactgttgttttaaatatcactgtggactctttgcagtgttattaccatatgaagatgacacgtcggtgaactttatcaaatgccatgcagctcttggcatgccatgtctatgtaactcattcgagcccttcttgtccgagttgcagtactcttttgcataaatgttaaggttaccacaattccaaaaagaaacgaattttcagagacctgctttatgaagaaaacggcttttggagaaagcaggaaatactagtacatcaaacaaagtgaaagacaaagtagtttaacttgttggtttgtttgctgaaactcaaaagtaaatatactgtagctcaaagtgttccatttttatctgcctcctgcagtaatggctgtgttacttcggggcttctacttcaataattgatcagggtttgtatagcaccggctaagagcaaaaataagagtgttgctttgaacaaactgctgcaatgttatagcattaggcacagaaacaagattcgggaaatatagatatagaagaaacaggaaaaagatggatacattgggtggtaaacattgcttcaggctagaaagtaatgagaatttttccgtggagagttttgacctgctattcaaaaattgtttcttgtcttaataaaatcctaaaagtgtaatttacttgcaagagggaaagaacaaaggcaccaaaattcttttgataacaacacttgttaaggttgataagttgggtttcaaatgtgtgaagaaaaatgtgtgacaatttgttttaaggtgacaccctaagtgttcagatacttccatcttacactacttatcaagcaggatcctagttgaagcttccccttgtacatttgcagtatagaccatactgaaatggtaggaactgaattaatctagaaaatatagttatatttattagaaaaccaacaatcacagatctctctaatttttcttaagctggtaaaaataagagtacttttttttgtttggttctaatttgttttgcagtctaaataagaagcaccaatacttatagaaaataccttttttctcaacatggagtgttcaaaaagagaatagctatgatataccttatttttttctagacttaatcttacatgactcacaaaggtatccattgttagatgccaactgttgcacacacatatgtgtccatttttttctattttaaagttaaatttcatctaaatttcagattcatgccattaaaatactataacctgctgctgcggtgtgccaatggtgataagatgtaaagcatgattgcaaaactttaataatagtgtgggaggaaactgcagtgaaaaataatcaatgtgatttttttcctgttatgtagcatattccaaagaggttgtttattttatgcctaatcaccataaagaagaaaatcaagcactcaaatatttcatactaaagaataagcaaagaagcatctaaaatatttgttcatatttatatatgcccttcaaaataaaattggtaactaaatgtatcccaaataactgcttcaacagccaggcgtggtggctcatgcctgtgacccagcactatgggaggccaaggtggttggatcatctgaggtcgggagttcgagatcaaataattgcttcagatctcgactttgctatgcacatactactgtaagtaaaaggcaaacactgggatgagaatgtggtgaccaagactagctttttccatagtgagtttttataatgtcatcaaactcacgatcaaaggaatttgggaaatgttgagcataacaaagataaatagatgtcttgactggagaatttctcagggcatttaatatgttaaggacctggaattcagtgttcccaaacatatctgatcatggacacttttattgagaatcccaagggaccagtgagtcctggaacatactttgagaaatactgatcttgacctatagccagcaccaactctgattagctgtgcagtgagaaaatcactttcctccttcaactttctaaattaaaaatgtccttataattcccagtatatttcacaataatggaaaatcctcttaaattattatagtgatacaatactgttttaagtaaaaatgtgaaaaccgttttagatgctgagtcagagcggctgattagactaatcagctaaagggtgtctgtgggtagtagtcccccttcttgcatagttttgtttgggattctgcaaatttctgtatggcacacgctttggggaatttcataaggaggtgaaattataaatattaaatgtttaaatgccaaggaaatgttaaaacttattggaactcttctattcattcagtatatacttatgccaagcaataacccaggaaggaagggcatgaagctgaatctgtgtttagggatataactacctaggcagaaaagacagacaaaaaagcaagtctctcagtgttttaagctgtcagatgaaaccgtagagtcccataggtgcatgtggtaggagtctgagtaaattacccagactgggaaaagccaatgttcacatttgaggtggttcatgaaggacttgaagggattattcaggcagaggaaatgcactccaagaagacaggcacaggtgtggagaaaatcatggtatgtttcatgattccaatagaaagctccaggggagaggaaggaagctggaatagtaaatgaaaatgatgatagtttttatttattattattattttgtagtttattttttttgagacacggttctcaccatgtcacccaggctagactgcagtggtgtgatcaatgctcacggcagcctcgacctcccaggctcaagcgatcctcctgcctcagtatcccaagtagctgagactacaggagcacagcagcacaccgccacacctggctaatttttgtattttttgtagagacaagatttcgccatgttgcccagcctccagcttgtaaatgttatgccacaaacttggatgtttttccctgggcaatagaggaaaccactgaagggcatacctctataaggggagaggcagatgagtgatagagaaacagccagagatgaatactgaaatctgtgttttctgatgtgcttgaatgtataagaacatgaccagtttagaaatagtttggggagttgaaaaattatgtcaactagcaaaattgacggagggcagttcatcctcactatgacattgaaagacaaaataattattagatggttttattctaataactgattttcaaattatttttagccttggaatcctttgcccatggattctgcagtttaaaaaaaagtgcagtgataaagcaggcatggctgtgtttaattggtgatgatgtgggtatgaaaggccccagggaactaccctgtagttctctttccacttagctcccttctttcccaggcccaggtatgccctaggagaggaggcagagtatgaaaatcattcttaatagtgagaagtcatatatttagtcagacatgctaactggactattttgtgtttgaagaagactttctgctttctttttgaattattgtcacatttcagttttatttatttactctataatatttattgagagcatgctttgtgccaggccctaggctggagactgggaaaacagtggtgatcatggataagattcctatcaccaaggagtttacaggctgtaaggaagagggccctagataggtatgaagctgccaatgtgcagtgtttcaggaggtggaagggggtgggagagaaacctccaagacatgcaggtaatctggtcaaggaggacagagggagggagttttcggtgaggtggaaagggcagaaggtggagcttggataggtggggaggtaaggggttgaaagtgaactccagactgagtgaagagagtgtgcaaaagtgctgtgaagatggtccatttgaggacttcccaacttgctggtctagctggagagaaagagcagaagaaggtagcagaagataggaggctagggaggtgggaggaaggggccagattgcagttttgatggctgagttaaagatttcatatttatttgaagttcaatgggaagccatgaaatgactcaaggcagtgcagcatgatgttgtttttttggcatgtggtattgtttctataggctgtatatgacaaatatgtcaaattttgcattacgttctggattcagggattttgcctacctaggtttctgcattacattcaggaaagagctacttaaatggaaacatataaagtcattactctgaaggtctctctactgttaccaattttgatatgaaattagctgtacaataccttcttttcagggatttttaggaatttaacaccttctggagttctcttttaggttttcgtacttttgggatcacagtatttattttcagaataactccaggtcaactaaattcagcaatgactggcaaaatatcaaacataaaaaaaaagtggaaggtgtgctgcttattcgatagcaaaatcctaccaaaacactggaaggtagaatgccattggcctatgataattaaattgaaggggagaacacagcattaaattaattgctcagctggaaattatttagtaattctctgacttttaaatccccaaggttttcttcttgatatagtactgttagacatcttaaaatgtaaatttttgaaggcattactcctccctttcacttctagttctcaaatgtacctttaatgtgtctagtaacaataataaacacttactgagcccttaagatatggtgagcattaatctaactcttatatgttctatctcattttccccttacaattacttccatgaagtaggagtgctattattattctttgagagcctttagaagagataacttacttaggagtataccagtgagtaagtggctgagtagaggtttaacccaagaagtccaatcaagagcagagtgattaagtactgtagtaacctgccttgaaagtaaatagaaataaacatagagctgtatatttcatggtagctaacaaatttctaacatgtggacagaagaagaaaaagactagtaccttcaactcacgtggatcagattcaatggttctttgtattgtaaggaaaattattgtcaaggagcaaaactatttatctcagagactagaatttgttagtgcaagcctatgtgacattaaaatacaatgtgtgaaaggcatccacaatctctccaacaaatagaatcaggatcctctatttgattactcgatgggaagtaggagatgaaaagaaggcattgtacagctaatttagtatcaaattgttaaataataagagtagagagactgtcagaataatgactttatatatttccatttaagtagctttttcttgcaaactctttaaggtaaaatcaaccaaaccaaaacttcactgtaaggcatgacttttgacccagatgtctatcagggaaaagaaagatcacaaaacctgtgcaccaatgccctggagtcagactgcctggttcaaattcttcttcagttccttgataggttgcttaccctttacaagctattcaacctttctaaatttcaatttgtttataaaattagaactaatagtacctccctcactgtgttgataaaaattctgggttccaaaattcaagttctttccactatgtcattctagataatagaaaaccaagaaagaatgccataacaagcaataagtatgaggtaatgtgttctttgttggggatagctatccattttttttcataaatattgattgaatgcccattatatgtcagacttgattctaaaggatatgccccttaaatgtcatgccaacttctaatatttaattaaagagcaggaaagggcctgttgtttttgttgctgtggttgttgactgtagcggagtgttgggtagtgaaaaagatgactgaactaggatgtgtgaccttggtggcaggcacagacctcccaggttggagcctttgggcaagtctcttttctctactcctgagtactcaatttcttatctctaaaaggaaagactaggtaacacactgagccagatattattcacaaatagggtcagattcacaaacttttgatagtcagatacaggatacagcaatgaattataatgggatagcaaagatgaattataggaagagtgggtaatacttctcatcagaaacatcaagcaaacctacaaaaagagatgctgtgactatgaagacagattatgttatattccagacaatcttgggtgcctggaaaggagtctggaattactctattggcagcgaggccaccaaaagaagtcagttcctacctatttctcccatgtcatcaaatgtgaaacccagacctctgtccattttattaaaattatcctagattccatcttgcttctccacggtgcctatggttttgtctactgacaatctatgactaagattctcaagttatactttatgtgtgttcacataaaatagcacactatactttaaaatgtagccagctattcagcatcatcactgtaatttgtatttatagtattgaagctaatcctgtgtctcacttactatgtgaaactctctgaagaatattttgggtgttctcatacaactttgtagatggcccataaatcaataaggaccttctttcaacaaaccagtcattttattccttcttgatttctaaacgtctcagactcacataacccaacattagtgttctttctttctctttgaaaactacaatcagtatgtttaaaacatactgctcatatatacagaagcaatacgtatatgaaaaagacaaaaaaataggactatttcatttaagagagggacattttgtcgtttgggcagatacctgccagtctaggctttctatacttttattttacttattggaataacggtttaagctgcagaaccaaagagaaccaagacaggttggaaacttttcagggtgaaagtgaccagtaataaaccaggcaaagcaagaggaaagagactggaagaaaaaaaggcctgtgggtgctgttttatgggatagtgttgagaaattttgacggaatgaacaaggtaattttaacatgtgctccactgtgtaagatattgagacagagctggggaaagattttgaaggttttctctgtcttagtgatgtaattttcatttgctgtctattatagctgattttatcctaaatttttaatggcagattttttctctttttttttttaataaattttaaaagaaaacaattactttttatgggcaagcagtgtgcaagcacctttgttcaagctgttcataaaccacaaatctggcaacttctaaattggaaaactcagggtgtcattaagagcagagattgccggaatgctgattctcataacaaaggccaccaataggctcacttttctgaaagaaggcaactttggtggcaagatttgctcctctgttcatatgatgaaaccctagcactagtggaaaggttggtggcacacaatggaaaagtacgcttactgaaaaaatatttttctttttctgtttttctgacctttgacttggcaatgctaaattaaaaacggctaagtggaaaactatacttggaaaaaatagaagttgatctaataaatcagaatactgaaatgttcactatcatttggccaacgtaagacaggtagctttttgtttttaccgttttgggagtatttattcattcatttgacttagttttgtccattgatgatttgttctctaaaaacatgcagagaagtcccttcctctcttctctgtgaacacatagaagccagcgggtcctgcttttgtggtcctgtcacatcatccattagatatggcatttatctacctctccggcatcccttcttttggaatttcattgaggggatgaaccacatcccctttttctttcgtattcattatcttagaatagcccctgaaccatagcctactcatcaaatcactctttaagacactgtcatatttgaattgagatctttcacattatccactgctgttgtgaaaatattaggatttcactgatataacaactttataggtgaagctaacagattcctcagaagtttctggcaatgtgtgaggtttcctctaggacgaataacacctttaaatccactcccaatgcattttctgaagttaatttaaaataatatacaatctgtttgtcccagcttcagattccccatgtcctcttctttccttttcggttttggttatgcttagtctaaagtcacatgtgcatttgaaagcaacagaacaaggaattctacaccaaatttcatctcgccaaaccatttttttcccctactcatgtaagttcctaaaatttcttgcttactctgcattaatgctaaattacaacatatagaatgtctcccaatgatttccaaccaaagacatagtacatattggtttccctttctgcttatttaataaagttagtagacccacattgccctgatcagtcacagaactattattaaaattatgcaaaatgtagaatttcacaaaatactgattattcttaactctcagcaattctgctgcttaaatgtttcaaaatataacttgctttcagttagatgatataaaaagttatatagtttcaaacttaagaaatagttttaatcattaaaaatacatataaaccctattttgtatttagcttatccaatattcttcacaatgcccatgcattaatggtagaattggagacaactccatatttgttttcaaataccacaagacttattgtgagctaaatgtctattgagcagaattttacccattgtacataacgacatgatagaaaattatgatgatttggagattcataaaagttgaaagctatatcctaagcatcaacagatactatctgggcttttcatgggaatcatgggtattgctagtgttttctcaaaaagaaagaacactcataagggaagtttatatgtctagaaatgtaggacagaccagtctttagagggaaaaaatactcatctagcagtataatatttcataagaaaaagaagtgtctcgaataggaaagatgatttactttttgtgctattaataaagccttaataaagggatttttaatgtgaatatgccatgatcattctctcctgtatggcgatagagtaatttggctacttatagggtattcatccagacacatgattcttcagtgttattgtataagtaattgcattttaaaggctgtaagctttacacagggtcttatgtctagcactgaagttccaaaaggctaaaataaattataacatcccacctgttgctctgacaacctttaagtttgtgtagaattatttctttgttaagtctgtgtgtcagaaactatgctgggttctggatgaggcaaaattgtataacagcttcatagcatgagtcccatcatacatataagacccattgtgaatatatgatcactagataccttttcttaaaatctctctccttagtgagctgttccctaacaataatattgacaatattaatcacctcttccaataccacacactttccttccttgttttaatctttttttgtaagaacttaacactacctaaccgcatatatgtgtgtgtgtgtaaattagtattttttgttgtattattttgcaagttgagaataaaatttcatgagattagaaaattttatctatttttgttcagtgatatgttctcagttcctacaacctacaacaagcttcataagtatttagagagtgatgaagacagtataattagtagtagggtagatttttatgatgatgtgatagcacgaatgataaaccccgcactggttaaagtttttacaggaaaatcatatttaatctgagttttcatggataagtaggagctcaccatgtggacaagggagcatggagagaggctaattcaggaagagagaagagcatctacagagcatgaggacgcatgttgaaaaacggcagtcagttctgggatagagaataaaggcaacaggtgtcaagggaatttggcagggggtggggtggtcagaaagggtcagagaaaaaagttactgaaaggatcagaaaacaggtagagattggactaagaatgttttatatctttgttagaagtttaaatttcaggcttacagcaatgagaaatctttgaagggctttctgcagggcagtggaaagatcagatttgcccttgaaagatcactgtgttggcagtgtggggggatggatagaaactcgatatttgttgcgttaatgaatgatttctcaacgttactttagaccttacaatttggtgattcttcaagctttactataaatattgacagattgagaaaataaataactgagtgatggagcagctctagtgaggaagacaagattgcacccaatttttcagggcattaaaattggggagctttctctaagcctcttactatttctgcaactattcctaccattacactaatctaggttactcctattaataatctcttttctctgaaaatctttaactgtcttaaacagaagctttctactttaaaaacaaaaacaatttttgacttttgctgtctgccaaaattgatttgctacaaatcaggtttagctatgtacttcttattcattatggaaagtagttaatgcaaatttaaatatcagcactccccaccacagataaaaacaaacttacataaaaaacagattgccaggcaggctttgaggagtctctgatgtacacacattcagaacgattacttgttccaaattccctttcaataacacaccttttattctctcatctactccaatacgttgggaattagttttctcagatggttgtttgaaagtggttagcgtctttaaccctgagtagaaaagtagtataggcaatttggtattctttctttcaaagcctgatataactaatgcatttatcaagagcagaaattaagtatagattgtctctaaactgctatttgtatgtaaatatcaacaagttttttaagatgtaagaattggcttaattttaacaatgcttttgacctaagcctttagttatgtaattatttactcaagtaaaagtttaggtagcagtatagtagagtgtgtattaaggaagtactgagctaattttcttcaattaaataaaacctctctctggccagattatataaatcagctttggcaccatgtgaaaaaagaattcatttgtcattaatgaaatgatattttgtgaaaacttcggcataaattatttacaaatttatactaggttagtaaattctgaccattccgtggaaaagttgagaatattatgcagaccatggcttgaaaagaacactgtatcacatttattcattttgcacattttttactgggtgtcttatagatgtcaggcagagaggagtgaagaccagcaagatcccttctgtgacagcacttacacttcagtaaaaagaggagaaaggcaataaacaaataaacaagtaaactacaaggaatatcacatagtcaaaagggctttgctgaaaatataactaatgaggaaggctgcagggctgctctgcagggctcttaagcggtcggaaaatcattgctgagaacacaagacttgaagttgatctctgattttctcagaaggcctctcttacttcaacaaggtgtgattcaacaataacatcaacaaatcacaccagcagttcagaggttagggttgatcatttaccacattttttaactttatactgttagcattttaaagtcacccagcattattattagcaagtggatttattttcaatttcatttcctagtaatgtgatttaaaactatctcaaaaaatggaaattatggtttcagtagttaaaattattttatgggtttggagcatatgaaatcaaagagctacaattagcctaagccagtatcagttcaagcttcccccacatggttttactaatacccttcaaattctgacttctgccattccagccatatgtctctttaagcagatacactgtgtagtgccaaagtgtgtcaaggacatcactaggttaccaaaatcatttttatgtgcaacttcttgcaatattccaaagtactcttccacctgaaccccaccccaacccctaaaatataattttaataacacacattaaaatgtcatgctgataataaactcagagataaattacagggaatctgtctgtatttttttttaacgcttttggcactaacataatggtgtaagcacatggactcacacacattgcctaaattcagtttctttcatttttttgcaggctttgggtacagagtagtgcaaaaatttataattgttattcagtgcatacattttaagaaagagctagaatgctaggcatatgaatttgtgtttgcaaggtgtatactaagagaatagaattgtacatatatgtgatgtggctttttagtttctgattgcagttttatcaccatattatcttgtgttgctgctggggaaagcaacaaacagtggcttttgccatctcagtgaacggagatctctggaaattgcacctgttcattatatgagaaatccttctgtgggcagagaggagggattcagttttattctcaaactgttgcctaattcttataacttgtgcatatttttttgagtcatgattgtacaatctgctacccattttgggataaaaacactattgaaattgagcatactaactttaaccaagctgcattttttatgaatcaggttgtaaagttgactgccacgatacagtcatgtcctgtacaaatgagcacacacacacacacacactctctctctcacacacacactctctctctcacacacacactctctctcacacacactctctctcacacacacacactcacacacacacacacacacacacactcacaaacacaccagggagaggattacattgaacactcggaagctcattattcttccaaaataaagagttaattttttccctactggtctttccatctttgaaacaccatgagtcacggtgtttcccatttcacaaacaccacggattctttattgtctgtgaggcttccatgtactgcagtaattttgaattggatatgttatgtccaaattgacagtagtgattaagccaaaaataagtgcattttcctttaaatgttagctgcagcatcaagtaacattccctacattatgctatactgaaacaagtcagtcggcaccgaccaaaatgttgatggatatacagcagatcaaaaagaggagaatcattttgaagtgctcgctatctgtctgagacgataggcttctgaatttgtacctctttgcaaaaagagacttcacattattttgtcagtttgtttcaatttgagaggtgttgaaaattggtattcatttttttgatataacccttaaattgtacaatttaagaaaactgactgaaagagataaattaaatgggtagaaatattttcaaatcaaagaccaactgacacatataaaaatgatgtatgtttcttacatggtccacagggagaattctgcaggcttgctatgatctctacaatttgcttcagggcaaactagattctgggatattctattatccctttggtctgtttatcatggaaactgatgtacaaatcgagaggtctttttggtctctttctttctatatggttggaactggtaagaattcacttatctcatgtcctcaccttcggtaaagtgctacagaagagttcagtgaccagtaatcaattattattgagaagcaatcaattgctaatttccataattatgcacatctaaacactatgaacaagaaagagaaacaaagctgcactcccagcattgccttgttagcagtattttgttaacacaggctctaaaaaaagctgccgcagctggtaccacaaatgtgtttccagtattcaggccatcaacgtgattcgtcgctaaatgtatagaatcagcttcttgctaaaaactacaattacaggtgatatacagattgaaatcacagggctggtttgtcgaagaaaattgtcctaatgatgggttttcggatggggaatgcagctcttttctttctctgtgatgggttgtgaaggcagctgcacctgcctctatgctgtattctgccgcacttaatgatatctgatgatatcattaggcaaagtgttcataaacagatgttgagcctgtgcctaaatgctgtcagatgagcggttgctggcctgaaacagtattatttatatagaacatttacgtttgttatgttaataaccccactattagctctctggatgttgcgttaggaatgtaaatgtagttaatatgaataacaacctctttactctttgtgctgcagttgagtataacttttaggctttgggagagaaacaaagatacccccaccaagtccttttgacttcgtgatttttttttttttttttggcaccatttgaaattttgatcagaagataaatggtaagaatcctaagacagatgttaaatattagaatttgattttcctcacggttcataattttgagagattttgatatctgtaagttattttgtgtgagcccagtttgttaccctaataaatcagagtgatgatcatggacactcaattgacaaagtatccatttcaactagaatgtcctaaacatactgtcagatatggacccatttttgttccagctcttttgctgacatgatcatattttttccccagtaacctattggggcactaaggtcatatgtcacagtcatttttgtcatatttgtgttggtgatttaggcaataccttgatgtcatactcacaatgcctcaaaatgtcacatgacaattactgcgtgtgtgtttaagccaaagttgaattttatgcctcatagttaattcatgcagagtaagttatgtaaattctgacagtcatcaaatgtgcgctatttctctgaaataatgttctactctgatagccacactatttttttcgaaagtgcctttgtcattctttatgatattttaactctttcttaaatttccagtactgaaaaattgcacttgcctattttcaggattaaaaaaaaactgttattttcaattgttaatgaagaataaaaccaaacagtgttaaactggtgcttcattacaaccataattagaggttagagtgctttctgaagtgtcagcttcatctcaattaatgcttatgaagtcattcacgttgctaaaagtggtaaaggtgtccatgtatgttggtctgtaggtgtgagcagcaaactagaggtacacgtttacatgtgcgactattctcattccatcttacacctaaggatagtctgaattatttgtgattttaaataatcattataaaatttcaatggtgatagtttttcccatgcctccactacctgtcatttcaatactgatcttctagaaaatgctgaaaatgccagatcctttttatatggagatttacctccaatcttccaaataaggaaatgggaaaagtaaattaagtcagaaggtgttccattctctatgaatcgcctcctgattatgatgtttatgtggagtagatttttaaaaatctgtaactgttcgataagagaaatgtgggtactggaaggaatgaaataactcctaacatcctgaacaacacatacaaatataacatgtcaaaggactcttaagattatcaagttatttagaccctccaaagtttcttttattgacattgttggaagttgttcagaagaaacttgaagattgcatttttatttgttcatctagtcaacacttaggaaagctagccaataaaaatgttcattctgaacttggaaatttagatcgatttgagtgagaggataaaagggactgctgaaaacatcaactattgttgaaaaaagatcaattcatcaaagtctatttaacaggcatgggagcctaccactgtctccaagaagtcttcagttcctgtcttttcctcagtggcagtaattctgatcagttccttaggatgagtgcctatccatggcatatattaattcaccttcattcttaaagatggaaagtaatgcagtcatttagcttgtaattttctaaaataattcagtttcttatgttgaaattgagtgagggtcactttgcatgtgaagatatctctgctgaagccaattaatgcattctattttttgatatttgtatttacctacataactagactttcatgtaaatctcttaatgtataataaatatcttttgtattagtatgatgacattgttaacctatgtgcagggattgtagcttttcctgtgtttcacaacaaactccagagtccgagtgtaaagcaatgaataaatctgaaatctagcaatgtgaattttagcctcagctaagctaatttctatgtatggttgagcaagtgcattacctttctaggcctcaatttctctgctataatatatttatgctaccttactctcttgtttcttggaaggatatgcatatggatgataagatattaagatctgtagaagaagaatggtttgagtccaccatttcaatttaaacttagtggcagttagttgaaatataataggcctttttgacaacacattaaaataagcacttattataaaatatctccttgcaataatattatcgtagttttatttttattttcttaatttttgtttataccctaaaaatggagagagtatataaaaatatattttaccatcacaaaacagatttttggactatcttccctcagtgaaaactactttaagtcaatatctattcatgtttataattagtttaattttcagcatattttttaaaaagcatatctttgattcactgatactgcattttgtgcctcctgtatgtattctaactggaatgaccagggatttttatcatttgcctgagtttcaacatctgtaatagttaggagagttcatgtagaactctacactcatgaacataagaaaactgtttgcctttttaaaagtaaggctagtatcttcagaatggaccataactagtttcatatcaaagaaaagttggaaactgcctagaggatgctaatccattagttattttattttatcatttatttttccaatgtatgaaattatatattttgtgggctgggtgtggtggctcacgcatgtaatcccagcactttgggaggccgaggggggtggatcacgaggtcaggagatcgagaccatcctggctaacacagtgaaaccccgtctctattaaaaattaaaaaaaaaaaaaaaagaaagaaaaaattagccaggcgtggtggtgggcatctgtagtcccaactactcagaaggctgaggcaggagaatggcgtgaacccaggaggtggagtgtgcagtgagccgagatcgcgccactgcactccagtctcgatgacagagcgagactcagtctcaaaaaaaaaaaaaaaaaaaaaaaagaaattatatattttgtggtaagatggcctcaaggagcaaataggaaatattcagccaattgtctcggttctctttatgtatcttactggtctttattaaaatatctattatagtatgtaagtaaagccagtttcaaagtctggggcttatatagtacccagaaggtcatttaggtctttatgagagaaaactggagttgtaaagacaatagacatgctgtagctgtgaaggtcaaaagtttaagaatggatgccgtatgcacaaagtatgcttctgacaataactgcaaaaagttacgtgcattaatatgaactcttgattgttatttagcatgtataaggactactagtctattcttaccattttgtgttggtcttttagtctaaaacagccgtaagcaatcaactaatatattttaaaggttcatcatgattgatatatgtttttgataaggcacattcttctactgggtgctttaatatcatcagggaattgtccagcaaataactgaagacctcaaagctgattttcacctggaaaggaagagaagggggaaaaggggagggagagagtgagactactgaatttctggatataacactataatcaaattccaccttcattaagcaaaatgcttcaatggacaaagtatatttgccatgatgagcagaatttgccctaggtggtcagagtcaccagtttcttgggtccatttcttctacaaggaatggctttttaacctggcgggataggcgatgtctatggtagtggcccgaatttgggcatctgtaattatgttagcttgcaattaagctgacttgtggtgggaggattaatgtcagaagattccccatttttcaatcttgtgtctacatcagtaagatcgaactaattgctaattggcatttagaaaatgaactactctggtaccctggagctttgctgtgatatggcatggaattaggaatatgatatttctctctttgataaaagagaatggtatttactccaggaagtaacatagattctcattatacttttcttatctaaaatataaataaaaggatcagttcactatttatagaacatatttatttacaagatgtggatttcctagataccattatcttggactaaatcataagaaacagacatcattcatcaagaattaagacaaagcttcaccctgaataacctttattgtcctcaactttcgaacaacattacaattctttgtagtttgatttacattgtattgcagtattttaaatgtgcccctctgccccccattgcttttggcaaagaataccctaacatatttagtgatttttagttttttatgatatattttccggggaaatttatagtttggaaaacatttgtttaaagagctttctttatgtactactgccatctaaataaataaatattgttaagaagctactaccagaaaattatgttaagattcatttaatagacttttaaaaaatagatttgcctttctctaccttctagagtcattgaaataaaataatgatctttaaaatgtggttgccttcaaaacacctaaatatttggggtttcatttcaatcactctgattagcatttttttagactagtattttctaaaatgtggcccatactttccatgatgatctatggaaaaattatcaatggtcaaataagtttgagggaatttgcatgtgctataatattttctacctggagagccacaatacaaattaacatcaaggctgtgagaagtcctgaataaaaatatttctttgcttaactcagaatttaaaatatttctgtaactatggaatatccttttatctttggattaaatactgcagagctgatggtcaacccagctcacattgaccaacattttacaaattattttgcatgaaaggcataggcagattatttccacataaataaactgtcaccttaacaaattctaatttcttccacatcctttgcgaattgaatagctaaaatgttactgagttgtaaataaatctttcttaaaaagtgtacaatctttgaaagttccattgcatcatcattatcaaaaccattatttataattttactttaataagtacatgaaattttctgatttagggtttctcctactgttgaaatgacatataacattgaactagaataacactttataaacaatttaaagaaactttttttttcaggaaaagaatagatgtgtaatacattttaaaaaaaattagaaggcacataagcaagaaatgattgacaagctgggcctggtggcacatgtttgtagttccagctacaccggaggctgagtctgaggattgtagggcccaagagtttgaggctgcattgagctatgatcacaccacttcactccagcctggacaacaatgtgagatcctgtctctaaaaaaattaaataataaaagattgacattgaatgtaaggacaaccaagattagtccagccctttaagagaaacttcttgtgctataaagggttttggtgcttttttagcaaagtgggaaaatgcaactgtatacttatgtcttgctggttaatatcccactggtctctacactctttagttaggttaaatacatggtgtgaaggtggttttgcattgctaaagatctttttatttttaattttttttagaatctcaaaatttttactcattcagttagataaatgaacctgtgtccgaattacatgagacaggagatacacagaaataacgcctatcattcttcaacctgaaaccgacaaatgaaagcttcttctcattccagggttctaaaattgtgagatggttgcagcccgatttcataatttccatgtatttgttgattgactgggaaactaaggaaccataacttagaaactgttttagaatgtgccaagattatcctgcagtgtcttaggcatggatttttgtttataaatattttctcagaacatcaataattgtcttttcagttcaaacatattaaaaatgctacggtaacaaattatcattgaagtttgttgccccaaagttgtcatgatggagcaagattttaaggctctagaatgatgttgtctacagagcaattttacctgttcaggtattttttttttttcttcaaacaagaacctctcccttgcattggtggcctcagtaaaacagagatggccctctgaattccttcctgataaatggattccgaacaggaatgacaattatcccacattcatagtttagaatgagaaattcacatcatctccaagtctcttcacactttcagagggaactggtaagctctgaggttcagtatgagaggcagttttgaaactgcagctcctccctccaaggaaccgcgttcacctcagtcggaatgaataagtagaaatctgtgacacaatgatagtggtgacattcgtgcaaacaagtgtctcattgaaagcaaagaagcacattgcttggtaggatccctaagagccctaaaagtatggctgtctacgagcacactcatacacacagtagtatttcagtactgttggcttagctagcaaacaaaacatggttcaaatggtttaacagtcctagaaacggaaggcaccagtttaatgaggtctcctctgcttgaaattaaagtggaaggagttttacggagaacagtattcaataacaaaatattaaatgataaacacagattgcttaaaatcagacgggccattttaagaaaagcattttagctcatcatgatatgtagcaccttatttaaattaggaggtgttaattcgtagcttgaataatatattaatataatatgtaaagtgaatggcattgttaatcacagtcgcgcctggaacgactttgcttctgtgcactgaatgttaattttgcaaaacattaatttcaaagattttgcagcagtgcttttgtaattaaatattaatgtcacatgttattgcagtagcatgtttatgaaagccggcaacacttcaagtcaactcatttgtttttatatttattcttgtacatctgcaatcccttccatttcacaatttcaaagtgaaggccattttgaatagtcaatatgtgaacatttttcattgtaagcgttttttaacatccaacagggtaaatatttaatgttgtgtttttagctggtataatttttgagaaaattggctataacttttaacaactcaaaggtacctaaactgtctccagttttggcttaagtaatctgaaaataaactagcaataaatgtgatgaagctgtgtaaaaatatttaagaattagaaggctttatataaaagtttgaaattagaattgcaattccatacacaggatatatcagcagttaccaattctccatatatttttattatggcactgtattatctcaagaaaactgaaaagacagcctagactttcggttaacttttttcaagttccataactagacaaagaatagaaaaatgtttcttgtcggtgatgtgatttacacttattacatgttctgaagttatacatttgcatgaaaggaaaatcctttttatgttcaccatcttattccaagtatagacagtatacaggtcattatatttggtttgcccacgactattctgaccaaatcactacagctagtaatcttgtccatgatattaccaatcagttaattacagttagcctaacaattaagttatccccatttttgaaccttgacaagaaataacattcaaggaattatattttaaagctgttattttatccatctagtaaagttgtctttacaatcaaatccctagatacattttgtcttttgaaatatggaatgagttatccatagtaccaaaaaaatcaggaaaaatcaagatatattatgtttggttatgggcacatttaacagttaaaaattatatctgcacctgatgttgcatgttaacagctaatgccatttgacagtgatgaaattaaaggatgaagaagagatacaaactacattttacaagcatgatgggtctccaacaatgccatttaaatattatttgtcactatttaaaatgaacctttcccctttaagctatgccattacgctcatttgtcctgtcaccactgacaggctatatgactcacacacaaaaatggtcattaggtactgcatcttcatcttattaaaaaaaaaagagagagagagagaaagaaagaaagcattctgatgcctctaaaagcctgtaattattttcatccgaagagatagtgttgctcggaaggtaatttaataaccttttgcatgtacctggggaatgcctctccagggaaccaaggtgccgacatgccattcagtcgtcaaaacatgacctttaatggttgcttggagagaagttagcgtggaatgttgtacacactgcaatgctaattctgctttctaatatatgcaaaatttagttcttgagcaatgatctttgtaagatgaattaatataggtactgctccaggaaacaaaagaaattgcaacatgaaggcaccaccccccttcccccaccatgatcttttatacttcaaactgaagtagctaacaacttgcacaatttgtattaaaaatagtgcgaaacactccagaagtctttgcttcctttccccctttaagttggttgatgaattctattctatatactatggaaatgtaaaacaggattaaagggattttctttgataagtttatttcccaaaataaagcattggccccaactccctgaagaagaaaaagaaacgcttacctttaatataccctctctgttttataacacaatttatgtggctcgttgaaattactaatgcagttactgagttaattttaaaaaaatccttcatggattttcatgttgaaatatgatattttgaacacttgcatatacaaaaagatgcacaggctgtttcctgtgacaaccaggttcagaaactccttattttggtagtctgatattagatcccgccttagttagaaatgctaggatttcaactcctacccctgacacgccatccgtcaatttattagcacgctggtgcagtaagccactgaacaggctatatcaattcgtttagtttttttctttaaaatgtctgtaatcctcagctctgctttctcaaccggtcagcattaaagatttatgttgcactttttttcatcaccacacctgaatatggattacttaaatgggctgtaaataatttatatctgggaataagtttccattactgaccaatgttgtaatttaatatactgtattatgggttatacaattttagattgttttctgtgtgcattctgcagtcaggcagacaacagtttaagtaaaaagggtgagatgtttgttcagcttattttcatgttcactctgtgtgctcaaatcagcaacagggctaaaggaagcagaaagctactttcaactacatgtttttctgctatttatggaaatctttttttttttaggcacttgacctgaagcaaaatacaaaaacacataatagctattattgataaatacaaaaaaagaaaatgtgctaatgtaggtggctagaaatcttaattcttgagaactgaaaaatattcttgattcctgaacccaaaggttaactttcctctttaatgcttggttcttctgtgcagaaaaatgcacataataaaattataatttatttgacaggtttgaatgaggctactggatcaaatatgtaaaatgttaaagtacaagctatttttaaagcataggcaagtgtttactcttaaagctttaaacaatttaagattaagttgagtatagtaaaaattaataatagattaatacatgaaaatctatgaagacacataagataatgatttaaaaaggaataatttaaaaagatgaattaaaaagtcgaatcagaaaagaaggccagcataaactagggaaaaacatgctgtgaataaagtctgttagatcttgaaataggagaactgctaaataatgcatagttttatttttctatcatttgcataaaccttaagagagtatttatttgtgtaaaacttgatgtatcgagtaaggagaatgaaaaaaatggcattcattttgttttcattttggtatttaggaaaaatattctgttacatatggactacttagacctaatcatctgactgaatgtgatgtgtgccttgagccaggttggaaagggctggctgcagaacagtgccctggtcttgctgcaggcgatgcaggttggcccatgctctgctggggagcagatggtgagccaatgcttgtagtcacacttaccttccttgctaaatccataatccctcactggacacggagccaaggcaggctttggaggcagaaaggaggttacaatctggacttgggtagtgactgccagaactgagaaaacagctcagaaatttcaaatgcttaacaagttatctgtcttgtccctaagccagtgcagcatttttaaaagtaattaagacatgattgaaaatgtgtatgccatctaaatacaaaaatcttcaaaaatcaccaaaaccaatcattaaaagccacatttaatatgacattatgcaaaaatatatttaaaataaaatatatttttgtgattgaaagaaaatatgtaaagtaaaaaaaaaagaggaagcatttattttttaggaaaaggcacttattttctttacaaacctggaccttatagaaggaaaatatttcatacatgtctataaatatgctgcatggatgaaatattttccttctataaggaaatagatagctatgcaacatatctatactaacagattcttctatataagtttttctttcaaaatattaaatgattatagttgatttttctatataggatacttatgtatgtatatgtatgtttttatatgtgtgaatggagttcatcatcaacacagacattataaatcagaaagacaaaataaaaatattgagtgggtagccaaattctaatcatttataataaaagggatagtaagtaccatctgtttaatgtaaaaaaaaaaaccaactgataaaatgcatacatatctagtaaattaaaatcatggagtaattcatataaaacaaaatatgtataaaatgtcaacatattccattagggtgcgattgatttaaacatgtactatctacataatagtatgatatgagaaatagaaaaatcttttgattatgtttggtgctacaccacaattttttaaaatgtttttctattaagtggtaggaacaaaattccttagttttctccactgaatttttgagtcctcattatcttaggcaatacttttttcttgcaaatgattcttaggcatactttcattgaagttcattgactttgagggaatttcttataaccttccttactccatcttgcaacatctacatttctcaagctgacaaaatgctaccaataccctatttgtgtttatgaataacttgagctctccagtctaggactatcatcaacacctttcataatttccccctttttctattgcctctttttttgaaaaatattgtcactcttaggaaaatgttcttaatttcttctctttgtgactcttcttcagaattcatttcttgccagtgccttcatccctcaatatgtccttttctggttatactgttttcttccaaaatcgatgcaaagaaataaagaaaaatgtagaagcttctttctctgcctcacccaaaaattcaagaaatgtgccttgataggagatatgtgcaggtcagtatttataaaaggagatataagaacaaaaatgtttatcataatacatttgggaaatattatgcttagtttttattcacacaataatgtgcctgttggttttaacttttattttaatttagtttacattagaaaacggaacccttgactacaattatatttacagaaagtaatgttttcatgatttcggtaggaaaattttactatagggtgacatcataaagtagtttatcacttcattcccaaacctaaaatgaggaaatatgatatttacaaacacttttttcttttaaaaagggctaattacatagagtttcaaaaaggcctggaaagattgagttaatgtgatttttgttctcaggtgagaaaagaaagtgagaaaatttcaatggttattttgacaatgcaagtttcctataaaatcacatttcagaaggccagactggtggctcatgcctgtaatcccagaactttgggagaccatggtaggaggactgctagaggcctggagttaggaaccagcctgatcaaaatagacaccatctctacaaggaattaaaaaaaaaaaaaaaatagcacattatggtggtgctcggctgtagtcccaagctacttaggaggctgaggagggaggattgctttagcccaagagtttgaggttgcagtgagccgtgattgtgccactgcaatcgcgcctgggtggtggagaaagacctcatctcaaaaataaaaaagaactttgaaaatcacattgctcttaataaatatcaaaagattattctaggacattgtaggcatcaacaacttaaaagcaacaagtcaacacgatataaattttagcaaaaaaaaaaatgatctttaatattagatatatttcctctgtccaagagttttaagcaaagacattggacttgaaaacaggaaacctgagtttgcattccagttctgcctctgaccaactaagaaatataagaagtatttatatctctggaccttagtttcctcacctgtataattacagcatttttctaatgatttctagcattttgattgcttacaaaacagtctgtgactatgtgaaggtggaagagttaagtactaataaatagcacaatacaggtgatatctccaagcaacacatgcttaattatcaaataagagattcaggcaattcttgaaactagttaacaaagtaaacatttatatgggttcttaatgttttatgttctaaatttctcattgcataatttttgatacataaattggaacacattttggccaatttagttgacattaacaatgggaaatgtctctatgtagatctctgaacaaaattttgtaacaccgtccatgtctcagaacattaccaccagaaatgccattggcacgttccacgcatgagttccacatttttagggaatctaaggttccagaattgcagagagagaagctatatctatagacactagggagaaagtgagtagcagaagtgatctacacaagcaaaaaaaaattttttttaaatgtactcaagattgaattagaaatccaatttatcaaaatccttggagatggcttctgatctccagttgaatcttcagccctttgatatgtcacctattagccacccaagaggcacgtgccaattctcatgtagtatataaagtctccaaataattattatcttaactatcaacattattacaaacattattaattaagagagacctctgtatttccgtaaaagggaagagcactcttatggaaaaggacgtattaaagaattggaattgtcagaagttgcatctcttggatgaagcataaagcagagatcttgatgttaatggtcacagaagattctgtgttgccatctgtcaggaattatttaccagtttttgctgaccaaattccaaattaaggagctccatttattggctcaaacctaccctctgtcttaattaaaaatagtgtccatctttactatttatgacctattatgagacacatggactttgggatttaaaaaaaaaaattctgcttcctcttctttagttcaggttctcatcatctattaattgaatttctaccataggttcataaacaatattcacatcagacttcttgacccactctaagccattctcctggggctggctgccagagagattattccaaaatgcaaacagtttttctagttgttcactgttaataatttctctatgaatcccaatagcctttaggaaaaacagttcaaactctttactataactttcaaagttctccgtgatctggctactgcttatctctctagtgttatatcctatgctgaatcgaagttctatccatcctggaagcctacctacaagttaccaaagtttaagttggttttccagatttcttttttaaccaggaatgctgttctacctagccacatttcctcatttttcctccaaaaggccattcctaatcgctttccccaacccccaagtctggttggatgtatcctttttacgtgctcctataataccctgaattatcacaattatacatcagcgtaaaattgtctgtttccctgtgtctcccattagaatacgaacttcaggttcaggggccaggttatattacttttcatatttccaaggcctaggctattctgtggcaaaaagcagtatttggcacagttgtgctctgtcctaaaataccttcttctctgggcttctttggcatcagccagtcaaggaatgtttcttctgcctctttgggaattctgcgtcctcctcttcacctcttatttgtggagattcccagggattgatcttcaacccctttatttccttaatatctgcaatagtctagatgattttattcgggatgaaaatctctacagttagtcttgaccatagatcttcagacctatacatccaactgtttctttgatgtctttatttggatgtttaatatgcatcttaaactaacaagactaaacaagaatacttattttccttcccactcaaaatctgtttctctcttgttatttcctaccataataaatgaactactctaactacttggttgtacaaggtaaaaatctaggattcattcgtgactcctatctgaacacaccccagtctaaataatcactgtgacctctcagccctgtgttaaagccacctgaacacatctgcttttttctgtctccattaagcaatcatggtccatgtcaccattatcattctctggactactatagtaagcttccagttggtcaccatacttatgttctaactctcctatcctacctttttcaagagttgccagaatgatcttttaaatgtgtaaatgaagtcaagccattttcctattcaaaactttataataattttcattctatttagaaaaaaatctgccatctaatcctggtttaatattctctgcatcattcaacctcctccaacattctagctccatctcatcccattcccttcttttcactttgctgtggccacactggtcttcattcatttttttggaacatgttaactcagttttgtcctaaaggttttgtccctactgtttcttctgtctagaaaactcttgcccaggtggggtggcttatgcctctaatcccagcacttttggaggccaaggaggaggatcacttgaggccaggagtatgagaccagccttgctaacatggtgaaaccctgtctctactaaaaatacaaaaaattaattgggcttggagttgcttgaacccgggaggtggagtttacagtgagccgagattgagccactgcactctggcctggataacagagcaagactctgtcttcagaaaagaaaaaaagaatgaaaaatagaacactcttgctactgttctttatatagttttcttctttctgtcattcaaattttacctgcttgccaaggctttccttaagggctatttcaaaaagtagccacttagtcatttgctgtcacaatattctatataccacctatcattatcacatatttctctgcatatcacctatcattttaatactctgcacaacacctatcatcacctctatatgtttgtcaatcaattttgatttatcgtctccaaactcaccaaaatactaacttcatcagatcatgggacttgcctgtcttcttcactgcagtattcccaacacctagaactgggttccaaacaatagaaactcaaaaataattgtcagataaaggaaatagcaattgcatgggaaatcaagtttgaacagtgaaacttatttgaggattactactaatagatggagagtggaagaagttacatgtcttcttctcaaattttaaaatgtttagtaagatcaacgagcaagattaaaaagttcctttaacaaagacaccaatttctagagtagagaaagaccttataaagtatttgatgttgtcttaagaggtaccggggaagccaaatctctttcaactatttttccccatcgcaataagccaaaaatcagagaggaaacagtagcaaaaaaacaaacaacaacaacaaaaaaaaaaaaaaaacattcaatcatccattacataaactaacagatatcatctgaataatattgtaggcacagattcaccttactcttgtgctattatataacagaaatttaattttttccttccttggagttttacttggaaattattttgttctctcacagaagtagtttaggattcatttaggagtgggagtgagaagtgggagggacagcatttcattatttaagaaatatttattaaacactttctaaggagcttacaatctaataaaaatataaaacctgagcatgatacttataatatgtgctagacaattacaagtatgatattataagtaccaagtaaatgctgggaaactttagaagagagaaaaattatgccccaatgaagaatcagtagggttcatgtattggaaaaatcaagaaagcttggttttgaagtacgcacagaattttaccatgttgcagataggggaagaaagatatttcaaggaaaaaggactctcacagagtacatgtactaatttaagtagttccaggccaggcacggtggctcaggcctgtaattcccagcactttgggaggccaaggcaggcggatcacttgaggccaggatttccagaaaaccctgtctcttaaaaatacaacaattatccaggcatggtagcaggtgcctgtaatcccagctacgcagaaggctgaggcacgagaattgcttgaaaccaggaggcggaggttgcagtgagcaaagactgggccgctgcactccagccttggcaacagagcgagactctgtgtgggaaataaaataaataaataaataaataaatagtttcattctaacaagacacaggaaaggaaggtggaacagtagtcttagttcttataatatagaggatgtagtacacccgaataaggaaaagaaatgttctaaagttctctgtagcatgtaaaacaactgaccacccaatttgtgttaaaaccttatgaccctatctcctatactttgtcttatcttgtgcctttttctgttttcatctttggcttctcttctccagtcctaaggagtaaaataaataagaagctaacctgagccatctattaggacaggatattcagcaaatgctttggcacaagactctgttgctttaggtcttagggaaatctggcaatcatcctttcagatcaaaatctctagattcctgattcagtttcctgctgctaactttctggtggatagtttgtgtgacaatgctgatccctctatttgcacattgccgtaattgtcaggcatatcagacatactttgccttttaagcactcgaaaatgtgcaccatgatctagcaccaaccatcacctccactttgaaatctcactcggatcttctatgtatacaccacacaaatcaccagcaagaaattacagagcctggattataaacatagaacttcccgaaattgaatcttgccttctcacttaggtcatacaggaccttagacaagttttttaacatcgctaattctaaatcgatttatatgtaaaatagcaataatcatacccacctttgaaagaaccaactctgtgaagttacaaccacaactatttttgcttcaatgcacaaatattccgaagatcaatgacagaaggtgtgtaaaacaccaggtacatactaagaacttaatagagattagcacctccttgttttgggtttttcgattcttctagaaagcttacttcacatttccagctgtctaatttttactcttatttttatattcagctcctatatattctaaaatattttttgaatgaccaattgaaaagaagttttattaccactaatttctccattttccaaattccctaagcattttatcagaaactctttaatcgtagttttccttctctgccttggttatggtagcacagatagatagtctctctcttattatgtgttgaggtccaattttaattttgtatcctcacagcattaaatatgctattttttcaagtaacagatcctgtatctacacatgctgaatcactttttttggatgattctttctgatgttaaaccgttgtcaaataatgtagattgtggaaaatctgtaaaattatatctagtaatttacctaataaggtctatactttgctatggacagctagatattacactaataatacatgaattttcttagtttctagttaacaaatttatatcaaactgcctaaaatctattcaagatcaccaattcaaaagaataataatttgcacatttgataaaaattccatgaggaaaacaaataatattttgctcctaggtcaaagttatagtgttgataataaacaaaatactaaaaattgtgcattttggtatcgactttttgtgaattttctttagggaatttgattaatgccttctagactaattctataaaaatctatatgtttcagtttattatttgaagatttatttaatagggttaaagaaatgattcaagtaaacttagaagcaaaataaaatcacacacaaaaatctattggctctttaattcttaaaatccaacttagaaaaaacaatctttaaaaaatttcagttggaaaaatcgtagttatgtaattattcattcctcctgaaatttaaaataaaatacataaagggtggtctgggtatttctctgtctgtggcaacatcttttaacttgactctgctatcttagtgtttacttgatttatcttaaagatatttttcaaagtgtcctgtatcataattggcaggtccatgacacttgcaattggctctaaaaatgtttatagtagccaagatgcagtagtagcattgtttaattttacttttgttttaaatagaatgaaacatgtaaaagaaaacttcttcaattgattagacattacataacaatcttaatttccttcaacagttttttcctattctttgggtaatgtatgtctgtgtttgcttcatcaacctctccactatttgtggacaatgaagatcccccaaaattaattttatcatcacctctacctttgctgtcaataagttatctcttccatctctgagggttctgacctcttgcccttcctacagttgaaaaatgttgttttatttatcttcatcatcctcacaattttctctttatttgccatctttcctttatcatgttgtactcccttgacttcattttataatcctccccatcctgttttgagtctcacacaacttatcctgcatattgctcttccttattcctgattatttttgtattttcttgttcatactaattggctccatttttatttccagtatatttataactaaatggcattcattgcctttgggcatacattaatttatctttcaggattttccatttactctctgcatcttttctttatatatttcttcttgtaacctccatttcacttcatttttctcatatgttttggtgtattatttttgttgttgctttttaaatatcccttcatatctgtaattcatgcttcatgtgttattaggagggtttataaaataaaccactgtgtatttgtcacaaacagcattaatttgaatagtctaaaaataggtttggattcattgtactgcaattttccggccaccttctttacagccatactatagggcttaactaaataaataattagaagctaattttacaaattaaaagaactacagatattttaatttatttacctgaggtcagaaaagggtagtttattgaaagatcaatggacaaaggcaaaacttatttcaagagagagatgtttagacctttggaggtaattaactgataagaaagtggtgcatatatgctaacatcattaatcttcatacttttctatgccttcatgcatataataaaggacacatttaaagccagatatcccttcttcaagaaaatccttgaaaagcacaaatttgaggcaaataaaaatgtaccaaataaactacagtgcaatgtggaaaatattacatgttaaataacagtatatttagtgtgtgattggagtaaagaaatatgaagagcgtcttagacgactttctagagcaaataacatttcagctaagtatcaaagaatcatacacacattgccacctggagatgaggaacagtgttcagagatgttgttccacattataattgaaagggagacttaacagggagagaggcacgaaagaaaaataaaatatcagcatatcttttactaagacatttggaattttcctacagttcagtgggagtcattggagagtttaagcaaagaagtgacatgatcagatttgattttggaatgagaactccagtagacatgaagaaactggacagcaacaccacagccacttagagtggtaaaataataatatcaatgagacagaatgaggacacaaactaaagcagaatctgaaggaataattagaagatatgtgagagtcattaaaaggttcagtcaagagaacttgaggacacttaggcgtgggggcagaagaaagcaagtgagaagcaagtggaaagcaatttttccataggattcaaagccacccacttaatttcaattagaaaaatagagctgtgaaatggctattaagtttaatttcatccagatagattctccagtttgcattgatgattagatcactactaccttatgacagtgattacctaccttatgacttatgattaacagttgaataaattaaatgtatagtcaacagagaaaataaaaataacaatattagaatgatactttctttattgcataaatgaatagtgacacattcagacttcccaatgtgcagcaagggagcccaaaaaacaataaaaaatattgcacagacattcatgcaaaatgaaccctgatggtagtaaattctaaaaatggcagaatttagttttaaatgcaatttccacatttgcatactatgtaagaaggcatcttataactatgttcatagtatattgttcatctcatttccataatctaattcagtgatacttatgctcttcaaatagtattcactgatcatattttatctcttttttatcttaaattatggttctgtgaattacagaccacatcagggaaagattgtaaatatcataaatataatgccaattttcctttaaaatggcaaattatataaaatatattttctgctttttcttacaaggaccaaaagtagacaaacctttgagcttagaagtggattagaataccttttaattacatagcatataatttttttaattcctcagtttattaaaagattataattttgaaaaggtaatcctgagtaatgtagagctgttgattttaaacagacttcaatttagtcaaactttcttatccaaacttccaaagtttccaatataattgcaggttgaatttgccatagataatgcaggcatttgggccatacatataatatactatctatttaagctatataatccattgttatatactgagaccattttagtgcaaggtattctaccaggcactttgcagagaatattttatgtaatacaacaacttttcagagaacgcagtattctttttcttcttcttcttttcctcctactttttcttcctcctcctattattattatatcaatttatttactgaaaattgaatttccaggaagttatataatttgcccaatatttctcccccgtagatgtaaatcctgaattgggattcatatctgttttattctaaaacgcatgctcacttccactgaattatgctgtcataaggtagcaacatcacaatcattttgggacagtaagaagtagataaggagtaggtcttaaaacagttcttctttggtgcaaaagaactacatcattttatgtaataaaaaactgaactgtaagaaccctaaggaatgataacacaaaccttaacaaacaggacttatgcaagcataccaatttcccccagagatgtttagctcatggtgtttctttaataacaaaactcaaaaaacagtgaatttcatcaattacatacttaagatccttggcatgtcttgctttttcatttctccagcccatgtcaatagtactgagggggaatatcacactctggggactgttgtggggtgggggaaggggggagggatagcactgggagatatacctaatgctagatgacgagttagtgggtgcagcgcaccagcatggcacatgtatacatatgtaactaacctgcacattgtgcacatgtaccctaaaacttaaagtataataataaaaaagtagtactattgtatcaagtcatactgattatattgtatatacttacagcttttgtaattatttaatatatatttgatgccttatgaggaaattatctaattagaaggcaacatcttctacatcgtttctaaaattattttattatatttgttcaacaatagttagaattcttaactctgacaagcatctaccaagcaggatttgagtctgttctatgtggactagtatacttcatgatactcaaagcaacttcagattccttttcccagtggtgatgtgtggtatttgagacaagcacacttcctttcatttacttctttctctactatggtatcttgtaaacccatgttaaaagtttaatgtttagtttttttccatgtttcaaatgattatgaaagacaagataccttgtttgcttaatcatgactttttttctcctttgagaccacttggaccaaagtgactatcaaaatagttgtacaatgtgccctgataaattggggggaataggttgttggggaattttatttgtttttatttattgttgtttgttgtggtcattgttttgactgtagacacctatttgaggtctacttttgaaaaagaatattattggatatagaaagtaattcaaatattattggcaagataaatttattttactttaagttccgggatacatgtgcagaacgtgcaggtttgttacataggtatacgtgtgccatgggggtttgctgcacctattaacctgtcatctaggttttaagccctgcatgcattaggtagataaatttctgcaagaagtataatgagaaggacaaattgatgaggacatcttctctaacaatgaagaaagagttttatatattatttggcaatctctagagtttctacatgagactccaagatggcatattgtccgtctttctatctccctacctacctatttatccatctatctgtctgcctgcctgtctatctatccgtcttcgtctcctctccccacccccaacacaaatatgacagaaatgaatacattcagattatatacatacagattcagtttcatctggtttgatttggtttggtaataatccatacactgagctaagtgctccaattttctttttcttttttctttttcgaggctagcttgttcccctgttttggaaaatttcctccttactgaaacatcacattacaaccaatattatactttgccaaatattttgttgtaaattctgatggcccactcttaagcaatcatttatatgtgtacttctagtacataagacttcattgagttttcagtttgtgcattccattatcatgaatgtactgagaagcaacttaatgatttattccttaacccaaacacttaattttactcctttgacttttacaaaaatatcattagtctttcaagaataggaaatcttacaaatcaacactaaagaacttactcatgtaaccaaatactacctgttccccacgagcctatggaaataaataaataaataaataaataaataaataaataggactagtcagctgggcacagtgactcacacctgtaatcacagcactttgggaggctgaggcaggaggatcacttgagcccaggatttcgagaccaatctggcaacatagtgaaaccccatctctacgaaaaatagagaaaaaaatagccaggcatggtgacacgtgcctgtaatcccaggtactcggaaggaagaggtgggaggatcacctgagcctgaggaggtcgaggctgcagtgagccgtgatggtgtctctgcattccagcctggcgacaaaaaataaaatggagtagtcgatttaaaaaaaaaaaaaaaaaaaaaaggacccagagactccaagagttctatttcaccaatgataccatagcttcttaatctactcatgtacatgtgactgtgcttatataaatttgaattttaaaattgcttgtagacaaattaagatagaaaaagaaataagatatcacattaatgaatgggtattcataaatttatatataaacttcatattgtatattccaaagggatctggaaatttttatatttttatgggagttaggaagattctttctttaccactttcattacattatttcattaaggaatctgatgaaagatatggatacttgccttagaaaaaatttcacataaacaatgtcaaattgtggaattcctgaagctcattcacaggcctccctggagtctttgatttcagtgttatgtcagttaacatgtattaaattcctgtcatatgctaagcaattttaagaaggcttgaaaagtttgggcacaaaaatgatatgttctagatgataaagataaagtatgtgcacctcatttcactgatgagtagtgagtggacaccttttaaaagcctatgacagtgcctgtacataaaaagagattaataaatgttaaccatcctctctcctcttaaaaaaaaaaaaaaaaaatctagtgagggagatacacatttaagcaattatattcaaaaaatagatgagacagataaagagaaaatagcacataattacacagtacttacaatttcatagtcccttttatattggacaactttataaccccttttgtatatttactcatctgaatctcaggtcattattagtcaggtactgttattcccattttatagatgaaaatatcaaggactagagaggtaatgaaacttgctcaagattgcacaagtattggcagaaccaggactaaaagccaggtaatgtgttccaagaatccatgtgcttaaccgtcacatttgctatctcataaaaatacaacaaaggccaggcacggtggctcacgcctgtaatccgagcactttgggaggccgaggcaggtggatcacgaggtcaggagatcgagaccatcctggctaacacgatgaaacatcatctctactaaaaatacaaaaaattagctgggagtggtggagggtgcctgtagtcccagctgcttgggaggctgaggcaggagaatggcatgagctggggaggcggagcttgcagtgagccaagatagcaccactgcactccagcctgggtgagagagccagactctatctcaaaaaaaaaaaaaaaaaaaaaaaaaaaaaaacacagaaatgtctcaagcaatatggaatggcaagatgaaagagcaattacttttgttggtagtctaggaaaagtctcagagaagcacatcaaatttgtgttaggcattgaaagagtagaggagacatatagtacctagggtgggatgtcttattaaatataaatatgacttaacatacttagtgtaatattaataaagttctatgtctcctaatgaaagaataaaacataattattgagttactcatgaacaagaaatcccaaatacatgaaacatcctgtggacctagcaaacctgcaaaaccattttcctgaggctaaactgttttcagaaatatgttagctcttaaaaacaggtctataacaacaaatcccaaatattgtgtatctgtgaggtacaattattctgttactcacatataactgatttgtacttttgttatttctcaaagaattggcaaagggtgccgcaacgtaagtggatgaaagccattataatgggtgaaataaaatccggtggctaagaaagaacagatttctaaaggggaaaatattattcagttcctagttttaaaaaatgggatatagaatattataggtggattatgggatattgtcactggaatgtaccactttcacctggagccacactatttggtgtcattagtagctgcttattctcgccattttccccaccccatttctttcccactgctaccccaccctgccatatcctgcacagagacaatccattctttgattcttctttggacaataagagtaatttttacatgtcagcactcgtaaatccaccctatgaccatagtaggttgttttttgggggggtttctgtttgcttttttgagatagtgtcttgctctgtcactcaggctgaattgcagtgatgtgatcttggctcactgcagcctcaactccctggactcaaaattctcctgcctcagccccctaagtagctgtgaccacaggcatgcaccaccacacctggctaatttttgtattttttgtagagatagggtctcactgtgttgtccaggctggtctcaacctcctgggcttaagcaatcctcctgccttggcttcccaaagttctgggattacaggcatgagctactgctcctggccataggtacttctggaaagagttgttctaccccaccagactaatgactcctccaggacaggtatgtataatccttttcccattttataatctcagaatttaatgctgttaatacatgtgtgccaaaatgattgattataaaagggaaaataaatgaatatatgatcatcacagattcactatgagggtgaatcaacagtgggatccatatttgtaaaataaaacaatgaaaaaataagaggttagaaagaaaggaaatttggctagatatgttaatcacagatgtggacattaaaatgtagtctaagtcatcttatgacaaaataggtactgatatatgacagtttatatttttaaaaagcaaatgtttatttaatttcaaggttaacattagtgatgttatgctaaaatgtgtgtgttcctagtaataattgcattactaacatctatctagatgagagctctctactataatcaatagaaatgtcattggcctcccctcctctcttcacctctcattctgccatttctccctagagcactattaaatgtaaatttcccaaattcttttctgtgacttttatggcctgaaagtaagtaatctgattggtgatgaaaattcagaacaacatagcccaagtaccctgggaatcacagttctgccaagcacttatgaactaagaaaaatatactctcttgcacatgtggaatgtcagaggaggaactgtgcggctcactcagctcactaggtgttagaacaacagtgcaagggtatccagtggtgacatacataaagacatggcctccctgggagctccagtgatttagaaatgaaatcttagactgccctgtgaaagttgaagatcctgttgctttacaaaggaatggatattgcataacttgaagataaagagagcaaacccactgataatactgccatggttaagtgttcttactgaaaacttctatcaacactatggctctaaagagttcattccggcagccaagaacagggaaatgccagctgagaccccaactactccaaatgctcattaaatagattttacttttttcggtgatggttgtttgaaaataggagtgtttatgagaagcgcaagctctctttaaagaaaaagtagaaaatgacaacagaacaagctcacattgtaaaatgcactatgcaaagagaaaaacaaacaaatacacacgcatgtggcattctttgtcatctctgacatcttcaacttccgcgtttcccattggttgcaatcagagctggtgtttagaataatgactgctaggttctgtaagattctcaacattacagatatatttcattatgcaaccctttagtattctaaaagtggaaggagaaatgaactaagccattttaagatagatttaaattacaaagatagaaaagcagagagatttttattcattctgagctaaccaggaaaatcaattaactaaaattcctgattgccagagcatgctatgtaatttgtatgatattaactttggttttacttaccttcaattgtttatagcctgtcaatgaaaatatttcctgaacaatgttcaagtattaacattcattgatagaatcaattcactgcagcctactctgtctggcttgcgtaaggttggtgtagaaaacgaagcttccaaaatcaggatccggaccagaaggaaagctttgtatattatgagctaagaacatttatttttatcaatttcagatatgtatatggtaagacttagaacacatagaataaaattcagaaagtaacatgtaccgtggaagctaacactaagcattagaaaatttgatcttaattagatttattttaaagggtatgccatataaaatctatcattaatattataataatttaatatttaatttaaattcatactttaatttactcccactttcttctggctttctgtttctcaattttatatttctttttgagcctataataaaacataaacctggtctcagctcagtttaatattttgagatgtcgaatatttaatttcacaaaacatactttttccactcctcaaatgcattccttttttgctttttagattgcacatatactgtgttttgtattattggtaatggtaaatactttcctgtaatgccttttaaatattttgctcagtaagtaataaacaagaacttcaattcatttgcctggcattaaaatgagactttgctcccttattgaggaagtacaagttttggatttcgtttacaaatggcatatatggactgctttccccaacatttagtagggttttcaatgacaggctaataaaatgtatcttaaaacatttgggtaaaattgtaatcctataaagaataaatactttaaaaaaaatccagccaatacttaccaaatgaagttatatactgtacaagagaatttttaagtaggaagaaactttagtgatcatttattctagtttcttgttctaattaacatactttttaaaaacctctttctacaaaattgaagaataaaaaattgctagcacattttcagtatttttttcttttcattattagaaaaagtgttttgtaatacataattatttcagaaaaattgaaaaaataaaataataatgcccaaagtgtctattattaaatatattacataagagttacatatttttctgcctttatttacctttacatatacattgttattttataaattgggatctgaagctagttttgtttcctattttttttcactaaatttagagtgtgaaagttacaagtcactaaatacttttcgaaagacaatttaatttctatgaagtttataataaatgtaatacaacaaatacagtgttaaaaaggtttgagttggagttttgtaattaatttacagcaataaattaacaaagtagcaaacaaaatattatagaacatatgcctttgcatcagaacttttttgttcctgattgagtatacatcagtttaagacatttcagtcttctcaatgtattgctcaaaagcgaattctttgaatgatgtttataaataggctttttttatatgtactttacatctctctctgatttaaatagtcccttttcccctcacaacaaatataccaaaatatagtctccagttaaacattaataattaatttaatacactcagaatgtcataacacttaatgagtagaatactttggctttagaaacagcctttggagataaatgcagaaaggaaaataaacataatgtttactgaaattaactagaatggtgaagggtccccctcaccaatgccttggatgcatgactttgggagatatgtttcaattcagcaaagcaggtgatctagtaatagtggctaatgtgattagcacttgtgaaaataaggtcataaagcacaatttctaagatcttttagaaataacttgtaggtggttagaaattcaaagccattcttgagtctggagatacgaaacagtttattaaacagatattaaagtacttctaaaactttaagaaataaagacacttttctatcagtctcatctggtattaaggctaatgttatgtatccatgttacctcttggcatattggggtcaattcccagttatctatccaaaatagtaatatactggatcaaacccaatatctttcctgttctgaattctctctctgataacagcggtagtttataaaagagctgtagtcactcttaatgccttagagaaagaatatacttccaaaacaaaaatcaatgggaactttgaatcactcaagagtatcattttagccagttttttccaacatcttcctaagcaccatcctctaccagttctgctaaaagtagaaacattgattgatgtgttttatctccttccccctccactgccatcctctagcagagattctagaaagagaagaaatgccctaaagacaggttgcttgaggaaaatggagaagtcaaagatttgaattatatccacaaactggataatcaatctctaaagtattgaaagttgactgtacacaaaaagtgcagtagataaatattacagtttgtaagttgaagcatgtaaaatattgaagggaatgggtggaatctttgatgttacatgtgataaaccttggaaccaataaggttttttttaattatttttttattttttatttatttattttttaagttttaaaggtttgaaccatgaagttttaaatgggaatttcaaaaatttgcaagttaagcatccccgatgacttgttttagaacttcaaatttccacatatgcactcattaaaagcagagatgattaatcaattgtctcaagtgcatgcatacatgccttccatgtacatgactaaactaaaaatgggagtgaaggttgagaactcagtctgtgcaccacatgagtaaatcaccatccaagcatccaagcataaatttgcctgttgttgctgatcagtgcttgaattcatagtaaaatgacccacactgatcatttaacaaggtggttttttaggcatatatatatatatatgtgtgtgtgtatacatttgcctgttggtgccgatcagtgcttgaattcatagtaaaatgacccacactgaccattcatagtaaaatgacccacactgaccattaacaaggtggtttttaggcatatatatgtgtgtgtgtgtgtgtgtgtgtgtgtgtgtgtgtgtgtgtgtgtatgagagagagagaatcagcttcatcatggtatagtttacacaattctctctttagtttcctgaaaaagaatctgaagtttctaatgtgaactttcattgtttttgtcttctacaaagatgtattgtcaactatagagaaaagtgaacaaccaaaagttgtcataaaaattaaattgaaaataaaggaatctgaaataattattaataaatttccctttttcaagtaaatatacttcaaaatttaagtaggaaaaataatgactatttttttcaaagaaaaagtaaaggaaacaaatacacaaataggtaaattttaaagacgttcttactcaacatccattaaacaaatattttattgtgccaggaactagattctcattttcaatcctcaaaatttgcagtggaacagagcaaaaagaacaaaattacccatttttgtatgtatctactttgtgtaaagcagtatagtaggtactttccaaagaaaatgatgaaggaagggataaaaagaaatacatcaggactgtggttatagccctcaagcagatctaatctaattggagaattgagtaggcaactgatagtgtaaacaaaacagataaagcagattaatgagttctaatgtaatatgttagtactctgcttcttattagtctcctacttaatctactatttgaagtaataatgtagtatagtaggaagaacgttactctgtggtttccattcctggctctgttactaacatttgggctgaccatgggcaaatgacttaataacaggaatagctaccattgatttgattgcctgggtgctttgcatgcattgttttgttcaatcctcacgtcaaccatatggtatcattctgactataaaagtgactgtaagtccagtttgttagagatagtcctgcttttgccctattgtccaagtacacttgttaccagtgtcagtgtctccttttaccctcaagagtgctccagtttggatgatataataaattttctccatttgatgagaaacttgataattgcaatctaacaagtagtagaaacagatttgatccaaggctgttgatgcctaaagcccatatacatagccactctatatatgttcattctggttaaatagttgctgcgcttccttgtatatacataaaatgaagcctttaaagtaaatgatctccaggattccttccatctctgaaccctaggactccaagtacagacagacacatatgtgtgggctcatgatactgggatataaactttacatcaggcttagcgaacagaattaggaaacaatgatgaaaagaaggctagacagaatgggacatttaacacattatagaattcataatacaggtgcggctctgaatacttaacagaaagaaactagcatccccgggcaatgtgaatgagagatgaccctggactgttagttaagcgaagctgtatcttggtgtgtgaatgacacgttaagaacatggtataatgtggcatcctggttcttgtattttgaaaatacttgaatattgtttagagtcatttgcatctatttaaaacaagactaattgtattaaaacaagtctagttgcgtgtatttaaaacaagtctagtcgagtgaagtcttcattcaaattctctttttgctgaatattatatggcctacaaagagttgtttggctttgctgtgattttaaggtgcacttcagatttatattctccccagatgattatattttcctggggaatgttgatgcattcccgccagctttgacttctcatattcccttctttaccctcatcttattggatgtctgccatcaatattaaattgtcttaatcctgatttttctacctattgctgcttttgcagttggcactgattcttatgccccttgaaaggtacttgtgtggcaaaagattgaaaaaaaaattggcagttgttgtcagggttaatgtagaaaaataaatctcttatattgccagtttggatttacttttcatttttaatggccccaacagatgttggaggaatcctctacttcctgcacacttccatttttacagctggtactgcttgactggttcttgactttgggggagcagttcctgggtgtttacacagtgatttacaggcaccctctcactatagactatgaccatcctcttgtgtcttttttcccttgcgatttttcttgaaactgatgtaactctcaatgcagcacctcacaaagtttttctaacccagtgtttcctgagcaatagattctttccctactgtgcagcattctgaaatgtgtggtatgttagattttttaaaaaaagcataaaggggaggaggtacaaataagaggtgattttcaaacttagcaaatcaggcaatctatcctttttgatatctctctttgtatctttttcttatgttttcccaaagtattcatcacaattttcatctaggtggttcacttctcttgatgcttttgctttttcctaaaaccaccctcccttctttcctttcttgcttctttccttccttccttccttcctttccttccttcctccctccctttccttccttcctccctccctcctcccttcctttctttcttcctcccttccttccaccagcctcagtgtcactagcttccaaaaactgtactaatatcctaaggctactgtaacaaagtaccacacaaacaggaggcttaaaacaacagtaacctcttgtctcactgttttggaggctagacatctgaaatcaaggtgtcttcagggcacgctcccactgaaacctggaggaatcatgccttgcctctctggtttctggtggacagctgccaatctttgacagtccttggtgtgcagctggatcatccaagcctctgcctttgctgtcacatggtgttctccttgtgtgtcttcacattctctgtgcatgtatgtctcagagtccaaatttcccttttggtaaggacaccaatcatattgaattagggtccccttaatgacctcattttaacttgattagctctgcaaagaccctgtatccaaatccggtcaccttctgaggtactgggggttaggactttaacatatcttttcttgagggggacacaattcaacccataacaccaactaagaacagaattttcctcacacttgcttccgaaagaaatgttgacagcttttagcaattgggaagatcccgtgaggctgaaagtgccatcgccggctgctgtcttgtctgcgacttttctgtgctgttcacttgctctcttggtttgagagttcccgtagcagaaaaggcagagtcagacacaaaactctcataaaaagcatttgcttaagtgacagattcgaaccacagcctttcaagaagctctttagtgaactgtataaaatttgcttggtaaacatcctgacttgagaaaagaaaaactatcaagcattgtgagaaagaaaattatcaagtaccagtaacactagccatagttttattttcttcccaaattcttacgtagacgtgtgtcaaggttgcagaggataccaaaaaagcttatcaaccctcaactgtgatgccctgtttcagtaattaataaagccatttaaaaagtcttttaaattatactagggataggaaaaaaacacattagaaatgacatttcagaactattgcacaatttgcctaagaaggcttcaaagttttcttctaataacaaataatgtataattgtcattgtcacttctattggaaaatggaggaaaatagaacacttttctcaagcagatttcttggctcacttatataaggttagcaaggcaatacttttatttgaatgtatctttaagaattagaaatagccatgaatattcttgattactaataaaattgttttaatgtcaaaagaattatatttacaaatcctctattgttaataatgctgctataaacctatgtggaatccaaatcgtctctctcggaagtgctttactgaaagtaattatgccaaatatggaaagtatacacaataatttgtataacattctcgatattaagccagatcctcgcagttctcaaacaattcttcagtatgttaatttgatttaaatttttaaaaagttgattcaggaaactgtagaaaaacaaaatagttaagccacttgttcagtcaaaaccagtaattatgtgcctaaagtattttgtctcctaattcatttgctttgacatcacatagacctagtcttatatatggtagcttatactagaccataaaaggtgttacgcagtgaaatactaaacaagtcacattggacaaatctgataaaatcaatattctaggggcaggatttacaagatggggtcttagagtctatgatgaaatatttacagcaataaagaaacaggtattggagagaaaactaaaattgacagtcacctgcatgatcttctggggccaccctggaaagtccttgccatcctcctcagacaagagaaaagtcatcattaggctcccgagggtaattcaaccttgcagatgactattcctctacttggaaatagtttgactatacgtaagtgaaaaagactcttaagaattttattttaaaattttattttaaaaatctcaggacatttaaacgtatgcctgttgattttttttttcttttcgttgatttttcatggagttgatggagataaaaagatcagcctggcagcttgctggcatggaactggagtgtttagggtttgttttgcctttttgcaagattggtccacaagaactttaaaaggagaaaaagacgatgcaaattaaatacgttagaaacgtatgtcccatctgtttttatttcatttttagaataaggttttcataccttcttttatttttatattctatgataccacactataatgttggccacctcggagactaactaaattagctatcctgaccatatggaaaggaaaagctttaccagctaaagaaataaatttaactcaggcaaaaaggcctatgtgttttagagttaaaaaaaaaaaaaaatgttgctaagtacatagtaggggaatgtaacccacctgcataagtaaaatttgaaaagagatttggatattcaaaatagctgtctcttttcttggcgtcattcaggaatcacccatatttgaagtgtccttctgttgtgctatcatctggatgtatttgtaagtaaactcacaatcagagacatgaaggctccttgaaaggccatctatttctgcctctgcctctgagaaaaattaatcctaacctgtccggggataccttaccttaccccattatgggggttggggggaggaaaaaagcttcagtgcattcagagaaaaaaacttttcccctaatatctttactttggaacactgaataagacattcctttatagaaagatactttgtttcattctacaaaagcccatactgtcaagcacttgatagaagccctaggctaccattttattttacctagagagaagcttctcataaattcaccatgtaaaattgatgactgcttcagtaatctaccaatcttaggtttttatataaaccacagtgagggaatagagcttgcagaagtcaagcatatgttttgtagccacgcaaagagtaaaggagtgtctgcctgatctaggaccacttttgagttgacacatgcagttatttacaatgattgagaacgttgtagttcatgtacaactcatgaagacaagataaatagatgggtagagaagcttaaactaaaaaaaggtcaaccgaagtgttttctgtcacttgactgtaactctcagcacaggaccactcaacttttagagtgctgaagttaaaattctctttatttcaacagaataatagctaaacttataagtgaaggcatatgttttgagaatttttctgtatacattggaaagcctttttttctggacactcttaccagcaggcatttcaccaaagttcataccaactactaaaattacctgaatgtattcaagatgtgtctccatatattttttctgtactaaggaaggtggaattatagtagtaattccttttcccaaatcatgggacactcagtgtaaccattatctagcctgtaatataactttccaactctcagatatcaagctagtaggatggctttgaagtaccatattgttctccgaaactaaagccgtttgtttgtattagatgaaacaaactaatcaagcaaaagtattttttctttagaaaatgtagatgtcttagataaacattgatctagattttttaggttctttgattcatatctgtattaatattaagataaccagaagagacagaactataagaccagttaaaaggccatctcagactctagcagttgtgtttgatagtggaacacagtgttgatgctctgaactacataaataaatacttcctctctgtcgtttcttaggacatcttaactttcatattcaactctaatcattgtcatagtccagtttatggccaagcataaagaatgaatagtttccttaaaacctacatgatgtaattcacattatcaatagagggaggaaacgcagatgaattccacttgaggtatattacagcctgataccactcagccaccaacacagagctgatatatcatttgtgtattctcaggttggatgttataaactagacaaaaatggccatgggtttttccaaggaaaaaaatgttaaaaatctaaatagatatggccaaatatgcaattttccactatgagttagtaaaatgagccatatatcaaaaaatagaattttctttaatttagagcttgttttgtagttaaggaatacaatttttgcaaatgccagtggggggaaaaaacgagaaagcacaacttgtcttggattaaaaggagaaaaatcaatgcctactgaagactcatgcttgagaaagtaacatgtaaataaatactaggctcttcaggtaaagcaaaattcaaaaatattagtgagaaatagactgaagttagaataccttttttcactcacataataaagggccaacagcacacacatgtacacatacaatgctagagtgtctacttctgtgcatatttatcttcaaaatggccagcttataatattgtataaaggttacctgtttcacagtacaaatatacacaacagagtacaagcatgcacaacaacctcactactttgccatgtaatattttaccacaaatagttataaaacattaattcctttttggtttcttttgttgttgttgttggttgtttattttttttttggtgggaacatggatggagctgggggccattatccttagcaaactaatgcaggaacagaaaaccaaatactgcatgttctcacttttaagtgggagctaagtgataagaactcatggatacaaagagaaacaacagacactgaggcctacttgagggtggaggctgggaggagggaaaggagaaaaaataactattgggtactaggcttagtacctggatgatgaaataatctgtacaacaaactgccgtgacacaagtttacttgtgtaacaaacttgcacatgcacccctgaacctaaactaaaagttaaaaaaatcattaattcctagggaaaaaagatgaaaaagagttcagatagtgattgcacattttgtaatggtggaagttccttttgtaaaggaatttaggaacattgatgaatgttgaatgaaagtaatttttatctgatgtcctgataccactgataataagtgacaatgattttgaaaattaaacagaatgtaagagtcccaactcaggaatctccttcacatttgtcattatatcttatctttgatgagtgaactctttaaaaaaataaagattagctgccaataatactgataatataaataccaattattgagcacccattgtgagccaggccctgttgtatactcttttcaattattagtcaacagattcacaaaatgaattggcattgtattgacattttacagatgaagaaacagatacacagagcaggtagagaacttgcctatgcacatgtagctagtccactgttaattaccaggtatgaaccaggccatagagatgaaaatgaatagaatgtattattgaatcttcccaaaatagaaaaaaaaaaacacagctactgatctttattacaaaaagtgggaaaaaacagagttcttaactgctactccagaacccttgtcagtacccttatctgaaggtgaaagaatacacatacacacacacgcatgcaagcacacacacacgcatggacgcacatacacatacacgcatgcgtgcacatacacatacacgcatgcctgcacacacacacacacacacgcatgcatgcacatacacacacaagcaaatgatatttagaagatctcttaaacaggcccactgaaatgcctcaaagactacctaatgctttcccttttctttctaaaatgttattaactcatatcaacactactaaatactgctaatattccactttttggtatgcctatgttactgtgcacctgacagttaagtgaggtacttaaaaagaaaactatttgtttccaaaattattcacgttatttgtaattaatatacaaatacatcatttaattaaatattacatgaacttatgaaataacagtgttcaaagaagctgtcatttgtatgaaaaccaaaggtgaatgctttgcaagacttgataaataagttgctaaaagaatttttcccaaattagatatgagcaagacaactgtgaaaagctgcaaaagaaatcttaaaaatccagaaggattctgtacttggtttactttgtatgtatcactgaattggcactctaacgaaatcaaaagtagaaattatgtgatacactacagatgggtttatgggagagagacagcacaaacccccaaacttgggccttcagacaaagaaaggctttggccctacataagagtgttgccaactaaatatgtatttgctctaaacttaataggcttagggaggcatcgtgtatgtataaactatacatacatacatacatatgtgtttatacatacacaatgcctataatgattcttcacttaatttttcaaatttctcatcaagtattggtcttaattgttccttttaagagtgcttctgtaagtattaaatctaacttatatattccattaatttgtaatttaattgcgtgtccaatgtacagcagtaacaatcagaatcttcacaaaggccagtgccattttgtaaaatctttttaaaggattaattcagttatgttataattaagtataaacatcgatatgaatactttcaagtctccagttcatattactatatgtcaagtggagaattaatttttttttaatttggtaaactagtagtttagatagcttcagtgtaggtagtccctaaaaatatctgggtagactgtgaaattgtctcatatgccttgataatttcagtttttaaaaggagtagcttaatatttctattttctgttcttttactcagacattattattattattattattattattattttttattattattattttacaaattgtatttagtatgtgtttttgaaacacaaaactggcatgctggtgtatctggtgaatttactattaagcccaggtctgcaccagatgggcaggtgaaaatgtgattatgaggtgtgtggcgttatatccatctctgtaatacttgactctccaggtgacttgtacgtctgttacattcatgaattcactttacggttattcttacagatactgaaagaagcaaccttacaccacgcaaggtctatggaaaacaaaaacttccctcctttaacacaatcacaataaatgtttcataacaaccagataaatagaaacatgtcagcattttccccggcaggttcagaagtttgatgctgaaatactggtttgcacatctagaccaagactaaagtgagtttgctatttcaaaggaaaatgcaaattgaggcttaggctgcacctttctgtatcactgttttggtaagtccacatggggcagacaaagccaaacaccagctaggtggtagaattccccaaatattcatctgtgctgaaaccttcaaaagtcaggtgcctggagagctcatttaatgaaagggttatctctgccaaccagtcagtagttgatatttttttcaccagaagttgtgaaatattatttatgtatgtagaagacaggggcttcctgccgttgttgtttacttgtgtgtttgggcaagtttcctcctttccagaaagcaagttttccataaaagcaactttgcaatggccctactccttttgtttgataccccaggcaaaaagcttttcatggtattgaaataattttcatttaaaaacagggagctcagatgaaccagtcctttattaaaaaaaaaaaaaaaagcagtaaggtatccttggttaactttttagttatttaaaagtagcttgttgaagattgaatatttctatgtttcactagagcctttaaatataaaagagatatgagactatatctgacaccatcaggcatattatattaaaatttatgaacaacttcatcaaaaaccactttccctctcctgcatagagacagatttgctctgacataaacgttacatggctggttgcagcctcagattaatgcgaagaccctggcgattccttttagacgttattttatgaaataatacctgtcagctgctgcctgatcctagaaaagggggcaggttttccaggtcatcttaccatctgtcagctaaagctcatctgtccctccacattaccacctgatctgtgctaacaggcctcacggggaggcctgcttcattggcccagtgggaaccagggaaagagactgtgagaggacatcacctgtgatgctgagatttaattatcgctgaagtgatgaagatgtgcacacagattgaaatgcttttgaataaattcatggagcaggagatgctctgccccactctccgcttccccctcccttccttttctccctctttagccccaactcccagccaagtgtgcttcctagttccaacacaaagcttgcagatccccccaccgtggatatttccaagtacacccttggaaaacacatgcacacacacacacacacacacacacacacacacacgtgcaaagagagaaatacacttgctaaggtaccaacccaaagggagggaacaatccttgtactccggggaaaatttgcctccgctttttacagcaaccctgattattttctgccaaagttccttgttatcaaattttaaagccgtattgattgttgctggcttgaaaatcagatttcattgtgggaccagctttttacctagggttttactcagtttgtggtaacaccagcacagagttacctggggtctcctgtggagagttaatgtgaaagttcacagtggaggtggaagcgcggtagaatataaaaggtaaagaagggcatagaaagtccctggaaacccctgtgactgtgggctccctcacgttctctgaatcaataccctgcacaaaagttattacaggtccaggcctttttgctttcaaagctgcttaggcagtatgtggcattaattccctcctgtacaaaaatgtagttgataatcacctggctgaggaaaggatttaaggctagaacagcagatttcctcacagattacagaataaaacctagtttcttgggataaatcaggataattaactgtagtgaagtatgttacccttgttgattcatgtccatgtgatacctttgttagatgcaaccacagagaaacatttatgccattatgtgaggcgagatctgatttctaccaaagcatgctatgcagcacaatacaagtttttattttcttggttttggggagcctgccttcagtctggaggccagttattaagcaagcacttaactcaattgattcctaattataaagttacaagagaaaatgatacactaccaccagtcccctttcctgccaccttttgagcaaagttgcatggccctgaactgctcttgactctgtggctgtcagaagttacagaatttccttcccaccatcacttgcagagcaggatacccctttccctgagaaggaagacttggaacagccgaagaagacccaagggttttttctagcacagtggtaaactgaaattgtatatttcctttttctttttaagggaaatcatgagcaaacattgccttaattcacatttcaaaaatgattactacagatttcaagacatttatcatgttgtcattggaacctgggaaaggttattcttgtggtacttcaggtcacaaaaaagaacgtattattagaaactaacacataggctatccaagagattcctgaggggaaattagaggtccactggctttgacaaaaaaaacaaaaaaaggtgacaggaatgaattaggtaacagggacccacagaaacttatcatgctctgaatggtcagtttccaaagtaactccaatctattacatgatacagttcttgtgagaacacaccggaaatatacttacagtccctgttatacttttccaaatacttactacttttattctctgcaatggcatggatttttatgaagctgccattttccaataattttagagaaatgttaaatgtaaataagtatataatagaaaatattttaaaaagaaatattatcctgccaagtcttttgtcatttgatccacatcatcaactttcagaaatatattatttgtaaaaatatgtattgaaattatatcttctgaaagacttatatgtcatctattttttcaacagatgtagatttaaaatcctatacatacaattgagtgttaaatcctacctatatgatgtggcatgttcaagtaatgagtgtatctccacaatatatccccttagctcacagcaacacttacatatatactctactcatagaagacaaatgagatttattttggatagctttggatgagtgtggctgtttcagcagcttgaagtaatgctatgaaatcagcaagtgaagtagagatggatgaggtattgaagaaacataaacagaaaattaatgaatctgctgagagttttttgttttgggtttttgggagtatagaaaaaattctgtacagtacatatgtctctaatgatataatcttgacctttgggtgactggtctagttttcaacaaaagtcattatctttggagaattgttcagtaattagaaactttttttcaaactaactcattgtagatgtgcatctcaagacagaaatctccatagataaaaaaaacctcatagtcaatcttaaaaatacagagtatatgttaagtgtgtgtaaaggagaagaagagggagaggagaaggatgattttcagatacatcttagctttttcccctcttttataaaatacattgtttacaaagagatgatttaaagccttttattctaaaggtttctgtccctgttttcagttttggattgctgaaattgaagaaaaataaagttaaacctagacagctcaaagatctacccagccaaagctagcttcctctctcttttgcctagattataagatttagattattataaattttataatccagggactatcattgttaatattgcattttatgcattaagtgctaggtcttatatcaccaataataatttgtccactagatagacatcattattaatattattaagaagaatgctagttatccataatttatcttttagaaaatctctctagataatttacaagaaatcttatgttattacttaattgttacttaagaaatctaaagtgagctgggcacggtggctcatgcctgtaatcccaccactttgggaggcgaaggtgggtggatcatgaagtcaggagatcaagacgatcctgaccaacatggtgaaaccccatctctactaaaaacacaaaattagccaggcctggtgctgcgcacctgtatcccagctacttgggaggctgaggcaggagaatggcttgaagcttggaggcagagtttgcagtgagccgattgtgccactgcactccaacctgggtgacagagcgagactctgtctaaaaaaaaaaaaaaaaaaaaaaaaaaaagtgaaatttggaggaaggacattaaggtgtctttcacaggactgtcttccccgttgggacataattaaaacagaaacacttcaaattgctattaccgtacagccgatctgactgtaggaagagcaatctactgaaaatatctactcggcaagcaatacttctcagtaaacatttgtcagcattggcattcttatgagctggaggatggaacccccaacagggccatgtccatcctgcttctgtggtttaggaagacagcaaatattaagtgtttttctaaaaactccacccttttctaaagcaaggctattaattattggtgcatatacacagtgatcactaaataagcctacaatacatacaatgacaacttaattagggcttttcaaatggacttctttgctcatccagtgcgacacacacttaacttccatacaactttaagctacaacctcattaccattctgcataaactaattgactcttagcgatgaaagcagccacaaatatgctagtctgtgaaagagagggagatgtccaaggtgactcaagagctagtgacagccaagacaagaacacaaatgactctctcccttgttggaaagttgtaaaaaaagaagactgcaaaattgtggacataagaaagactaatgagaccatggcaagaataattgttaacagtgcaagcatggtttccaagagaccttgactctacattacagatgccttataccctctgtaagtcaccaacccagagggatcttttaatggtgataatgataaagagaaattctgtcaacctctcacattccaaatggccactttaatgactagtactgtcttctacctgcggaaaacaacagaaattaaaatatgaagactttcccaggttagggaagccatgtttcaggaataggcatctttttttaaatcctagttgaggacttatggtaaagtacaaagaatcatcccatacacttcaatgtcagttgtatttcacattttgaaatgcttgttagagttaaggagactggagaaatcctaggttacatgataaaatgagttttcagagagcaatgagacagtttattgatcagctgattatcttgctatgtcttatgaggaggagaaaaaagattccaagactccagcctgtatcatattttcaagaaaaaaatttgaaagtggtcgaaatttaccattcagaggatacagtgaagaaggcaaggagcaagaaagattgctatgcttagtctgaaagacactgtctttctggatcacctactaccacatttagcaaccaaaccaaacataaataataaaaattcaaagcacatagattataaaacgtgaataatataataattttaaaaatgatagttgtttacattaaaggagcttaaaatttattgaggaacagtcattactatataagaatatcaaagaggaattaaatcagattgtgggaggggagcatttcagcttgactttaaataattgagtagatattcaacaagcaaggaggtgagagagatttcaagtgagaatgagtgatgtcccaagtcaatagaaatgttccagcccctcttatatttctgacctagaactaagaattctctggtgaataaaacaaagtcgatgacttcatggtgtttgtggtctaaatcaaaagaaggatactaagcaaataattaaatattcacacatttgcagagagctgttcaagaagagtacaaagtacaatgggaacacacacatagttacctatagaagatgttcttgtgatataaaaagcaaaggaacataattagtgttaaaggctgtctccagcagtatctagtctagagggtgaaggaagactctcctaaggaagagacttttaggaaaaggagaacaagtaaccatgcatgagtgaaaagagaatctaaaaggtttacagatagaaaaagtatctcattcagtggccctgtggcaggagaaagcatggcatatttgaagagctagaagaggtctggaaaaagagaatgagaaagacagaaaggcataaggcctgtgaggtagacagaaacgtaatacaggtccctgtcagctatactaaacatgtttcacttttatctatgaacagtgagatgctattgatggttttggcaagcagagacaaggtgagttggtcctggtgtgcagggtacagaagtcaggtgtactggcagatgaagatgatgctagtcaaaatcagaaccagaactcaaaaatcccaggaaacacaagtacttccttcatactgcattaatcgatattgtggaactgttggtctttgtcactacaccctagacactgtcagcttctgagcaaatttctctcttaaaattttaccacaaatcaagatactttactgatgttctcatcaaaaacgaggtaaaaggattctgtgtttttagttttttttctgagtctattttattccgctgtgtttgggagcaacagaaagaaactaaacatttatattattgcttctgtacttccagaaaattcttccatttcaacagagtaagaacgttattagtaatatcagaatttcatgaagcaaaccatagcatcttctctgtgccataactacattttcaataacataccaaagagtgtaaactgatggccagcttaactcaggaatacagcatcacctgttaagggttttaataagcaatgagtcccccagtcaagtggtccccagagaccaacaatttaatgatgctatgacagaccaagtaaagtgtttggttcaataataaggagcttattgtgtgcgtgtgtgttttttaagtacgctccatataaatattccaaagaaaaagggatttaagtttttttttttttttaatctaaacgggtatctccagcttcctgaatggtttcatgaacttcatgctaaggaaaactatcctaggaaataactatccattggaatatctgtcgctcatctagatgcacattgaggtccaaatggctcaagcatattcagtcaaggagatgaagcatctcaatacccaggacctttcccaggagcacactggagtgcatttaacaattgtgattgtaggaatatgtatatagctctttgaagtctgtgaagattatttatatgaattatctcaatatttctaacctgcaacagtaaaggcgatgaggtatagtgaggcaatgactcacctaaagttagagatggaggaagaggaagaattctggaaaagtctttgacatttctttttgaaaatagagttctcctcctccacattatttcctaatttttcagtgctgcaaagagaaaaagtccacagactcctctttgccagttcaagggcaacctatgtacagatggaagtagatccagattcatggcaagagaatacaactggggtcagaagacataaatccctaaacatagtttggatgattatttcatctcaatgaagtagttgtgaagatcactgatttatgtgaacaataatgataaataagaatgacaagaaagacaaatatggacaataataatatgagatatgtatgtgtgtgtgtgtgtgtgtgtgtgtgtgtgtatatatatatctccaaccttagtttcatgtgataaatgtgtgactagtacttacatttctggtcatttgttttgcatgaacaattttttatgtaattttaaaaattgcttattaaaaaattgctaaatctcttagattctaaaggaagagaatataaagttgatgtattagagatactgtgtggaaacaattaatatgttaaaatattggcaaaaaaaaacgaagaagaaataaaatataaccctagcatttttacttgcagtcttctcatttttgcttaacttttttcataaatagcaatttaacaaaacctaacactttaatgtgacaaaaccaaacactttaagaaaaactgagctctacagtgtactatacctgataaggtgctggatgtcaccaacatcattaatttccactgagctgaaatttctctaacatgcaggtctatctcacaatgtttcatcttcatttagaatatttggagtagtcctctttaattatttgaaatgtatatagatagattcatatcttcaatgaattgattataaaaattctcaaagaaagcaagaaattatttttctgagtaactggatgaaatctgtaacctgagtgtagactctcatcattaactcctctctgccttgaaatgttttctttctgcttttactgaactcttaaatctgctttttaaaagtttcactattgtacaaaagtcccataactatgagtcatctttatttcatcctcccacttagcaaatgtaagagcaagaatcagatttcatactcctcagcctaagcagttagactccaaggtggactcaagaggtgctggggaaggcaattctgttttgtgatttaggcaaagttaatgtaccacctcagttatgggttaaatgtcaattgccataaactctaagagaattaaagtttcctagaattttgtatcctctaccattgcttaaactcagcagcccagctggggttttggaagctttcagctttgagcttttgtagttgctaactccgcttgttgtaaatgcaaacctgtatttccatctgcagtgttgttgatttcctccagaaaacactgaggcacactcagttcataggcacagatgactgggttaagagcttcctccaagcataatgctgtatatgattgaatgtaaacgaccaactctgatcatcacccacacagtggaatggaaataagagttgccgaatgatcctgaattttctggttcataaacaaacagaaaataacaaacctaatatattgagttttatgtgcagtttggccatgaaacaaactttcttccccttgcaatgtttaatgagaagcatccctctcattgcactttcactttagatttaaacttccctatctcaaataatcaattgtttataataaatgaaaaaaatcctcatttttttttttgaaatggtttctggcatctaattacggaggatttttgacctggctagacagataatgttaacacagcttcaatactaaacaagcctgaacatgtgtgtgcttgacttttattaaactcctactgaagaaacagattaattggaggctgattcactggtgaacaggcgttaaagacagaaggaccttctcacattttgttctgttatccaggcttatgccatctcaggttggcaaggagatcccaactgtagtgttttgaaatataactgaaagaaattgtagaataacaggtgcaaaaaaaatgcaaaccacttataaaaagttgatctcattcctttctttttctgttgccaactggccacctgacactttatggactgaggtactgcccagataacatttcacataataatataatgtggaggctgactatggaggtttgcagctgtcgtaattatcccttatacaattattacttttttttttatcctttgagacattttttctttagaagaagaggggtacaagctgtaagtaaaccatttcacttaggctcaaagagcactgaggcaaaaaaataaaaaaaaatgcccttcttggcagctttgcttctatctaaaaaagctggaattttattccctgaggtttcttttgttgtttaatggtttatgttccataagataagcaaagcaaaataataataataacgataatgataaagcaacaaggaactaagttgctggtgagttggaaaagggccttgtaatgtatttgtggagaacattacgatttacagggttttcccacgtattatctcattcataatatctctgtgaaataggtgccaccagatttttacagctgggaaaaaagcctcttaaaaaggttaagagacttcctacagtcgttcacagagtaagttaggcaaccagaactccaacccagaccatctgactccgggtctgcctagggcttttctaggaatgtgcccctctggaaagcccctcaagccttctggatctgatccttttcctctatcagataaggacattggtgggaagatgatcttgaaatctccttccaacttcaaaatgtgatgttgaaatgtgattataaactactacaattataaaaataagcaacagattagtcaacaaatatctgttgcaatttgactccaggcaagggtgatctgttcagatcctcaaagtcacatcagcacacacccaagtctagttcatatcactaggtggttctgtgaactggttgttttttgacaaagctccattagtatcatcattttcttctgtgtaaatacatctctgcaagccattaatataaacaatgagatgaatgtctgagtttaaggatttcagtgttatatttttttaagtctcaactgttagaaattaaatgttacaatagaaatttgggtgggttacagattttatcatattttaaggaatttaggcttaaaataaggagaaaatacaatttgttgaaagtgaatgattgaacttttaggtggtggctctacaggaggagtttgcacttcaaactactttatttgtaaatagggtaaaattcatttactttaaagaagcaagaaagaagagttatctagttgtttgtttactgagaccctgtatcttttcaccagagttttgaggtagtctataacttacatttttgtaattaagtgccctgagatcacctggtgaattatgagctatcacataaaaatatgcaagtgccatgcaaatcctcatatccattcacttcaaggtaggatacacatgcaaaattgaaatggacctatactagatatacagataaccaaatacgaagggaggcctttattttcagtaattacctttaggaaatacgttgactgtgctgtctacctttaacttatggatagggtgttccgtccttcttatttaaattttatgctggatgacaaatagttaagatgacatatagtagagaaaattgcagggtattgtttagtctcaattctccccctataggggagttgagtagacttttctatatatgttttcaacagctgattggggacttattgatttttgagtacatttcagtgtagaatgaaagtccgagaactcagtgaactttttcatctctccacattccaagcctggtaaaaccattccgcctgctaaatgatgttataaatatcaagattagtttcttctgaaatcaccagcgccaggtgcattccatttctcatgtcatataatattctgttaccagtgttcacagtttaagatttaaagaatgtgtagacaaaaaaaagagtaaggacacataaatgtgacaactatttacatatcctatataagatatgctggaaagcaggattaataatttctttttagttttgtctttgttttgtttaggtggggtaggatgaatggaggtagaaataaatatttataaattagctattatctctatcataaatagatagaaaaatttaaatatattacttgcaaaaccaatgttattgtattttgttagctgcacttccaatgcataaaaatctcagcactcaagatgtccccataaaatctttcactaaacctttgttttaaagtatttgaaaggacatcattccatgtgggaatattacatacagccactgattcaacagtaactgagaacttatgtacaaaacattctttacatattgacaaatatttctaaaaaatgaattggtattttttgttgttgagtgtttcatgagtgacctttacctctgtagacatatgcagttttcagttttttgggtgagactttcaaaatatttttttagagtgttcaatgttagcagtgacatttttacagtgatttcagagccttgtagtttagaatattctatttgctttatttctaattacttataccatcctcgttttaaatcctgtgcagatgtaattgacagtgatgatatacaatatgtatgaaatgagctttttcctatcggtggtgtgtgtcatgcaagactccattgcaatatttacagttaaactaaactttttagaacgagcaaaattgcatttgttttgcagatttgctcatcattaaatgtgaaacatttcacatttgtctttttgagtaattggctttttaaaatgataaggtgctctgaacacttgttatgtggataggtctgacgttgtatcccagaaatccatatgccatacagacagaacagaagaaagatattcacaagcatgtcacagattggactaaagcaagccaaaaacccaagtgccatggcattaacaatagcaccagatttactgtcacgatcacaatctgtgctgcatcacagacagaaggagaacttttgataggtaacacctcagtgtttttttaatctttttggcaaattatcatttatcattatatttttgcctgccatataatattattacaatgatataaaaaatgcaggatacgtttattaagccccaacaaaagaactgacttattcagtcaggccatgtaggattaaagagagaatgagaggcacagatattctgttgttttattacagatcaaactaaagttggaaaaatagacaacagcaaaggtactagggaagatttagcttcttctgagttcgcaaaaggaaatggcttattagtgacagagaaaacaaaagaattaacctgcttgggaacttgaaaactctgatgtttccaaaatatgtggttccccaggataaaaactcacagctaattttattttctaaattggaagggggggtgggtggggactattttgagatgtgaaactgtccaatcctttctgctctgtgtgcgtttccccatgatgcagatatgaagagaccacaattcacaggatgtcccaataggtactaaaaaaagatttacaaaatcacagcttgagaaagagcctcatgttgggctgattgaaggaaaaaccccagaaacactgcacagagattcctggcatctaatagagtagagaaacatcagtcgattgtttttcttaattgaaggtcactttgggacttcgatgaaaattttttttcacctgttagctgtctacctggctaaggacatttctagaggacaacctatatttttcttatagaagaatatattcttaagtcatctggttttgttaatttcaaatattaaaacctagtttctcaaagatttaaaaggattcaagtaaaacctttaaaagtaattagtaaaatgctaagctatacaagtatagctatgtggaaacaaaggaatatcaatccataagttaattttaaattcagttggctgaaatattatatattctaaagtaaatctagtttatatcattttcaaaccatatttttccaccaaaattgtaattattttttattttttttctttttagccttgaaaccaataagaccgtttgatttctagtcttgtattaatttggagacctgggtatattattttctttcaacactccacttgccaatgcctgtcttccttaaagctctgaggatttatttactgtggaccacttccagttcacatgcctcactttcatgggacttaatatatttcttctaattttcaaactccatcaactcaatttaacttatttttcactaactcagagatagattaagtattgtgatggttagaaagaggcacataatagttactattttcaaaaatacatatgtattactagggatcaaattagaaaaaaaaatacaacccaaaacaaaaacacaaccaatttcttaaactgtttttaaaaattgcataatacataataatggagaaggcatgcccagcaatggaagaaatatatgcgtgagatatgaaaacagaccagaaaaagactggagtttcagcagtcaagggaagagtgcatgtgtatacgtgtatttttctgtgtgtgtgtaattttaaatacaattatttaaattttgtaaaataatcgttctataaaatcactcaatccctttgattgttgagtttctattatgagtatatgaagctaacataaacagcacttaaattttcaccagagacaactatccatgcaagactctcgggagctgcacacttggtaccaggatgtaattttttttttttaaagaaaaggaaggggagccacattactcaagacatattcaagtgagagtagattgcaatttctctagtttaaatggaaaatccccataatgttaatatttactggctttggagttgttgagaaacatgatgtagctatgatattaaagttattaaatattcagttgttaaaaggaagggagtccaaagacaacatggtggcaaattttggcatcagtaggggttagaatatactgatgattctgaaccttgaaggacaagggaaacataagtgatcatatactgcaggcaaaggagatggagaaaacaagaatgatagagttcaagaacaagaattggtaaagacaatgatagtggcaatgatagaattatgaaagtccggaaggcaaaacattctatggaagaaatttgtattgaagaagtaaaatttgatagagaccctaagatatgtatagaatataaatgaataaattgacagaaacagatgggatcaaattatagcctgaaaatgttgtatgtatcatttaatctaatacaaaaatttatattttttcaggagcatgtttatcacctaaagcatgggtacttctaatttaaaataagtatctgatactgcatgtgtgggtttcctttaggttagtattagttgattaatatttgatttaaacagtctttgttcagcttaaataagatgtaaactatgaagtcatgtttgatttagtcattcagcagcaaacacttatgaattcctaccaggtgcctgacacaagctctagggatggttctgagaagctctggcatagagcaaccaaaggaagatgagtgcctcatcaggcaacagcattaaggaaaattggtgaattgcattgagtttataaaataagaaaaagtaaataacgggactcgtgatcatgctcttaaaattaatgaaaattattattacttaggtagtggtgagaacttacacattaaaacagagacagatgatattggcatacgcagtatgatgtttctcaaagcctgcctgagatgaaacccatattatcaaaatttacaacttctacatgaaaacaatctgtaggttagatttttctctctttgcagtgattccaaagtatgaaaataataggtgaaaaatcaaggtgaactttacaatgacagagttaacccttgctaaataatttgtaatgcaaataaatctttttatcaaattctatatcaatttaatgtgtgataggagaaagcattttatgaagtatattaagtaagtttgatgttataatgtataccttcctatagcaaaacaaataaataaatgcttataagccaggtgttttttttttctgcttttgcttttgctttatttgttttgtatcgtggccttaatcaaattttgcttatcattttgtgttttttatttttttgatttcccctcttatgagaattcattattcttacggttatccttgtacattttagtacttgtttcatcaacttcagtaaaatttactccctttataaaacataaaaaatttgtgctccccttttcacattgtcataaactacatatagatttattagttatattttttgtcaagttgactatatattttcttctgtcactctaattctcagtaagttttagcttaaggagtgtccctcattttatataacaactttctcacttgaagatgtttttaactgttttgattattgattggttggaatcaaatgtattacgagactcacattgtccaaggccatctttttgggtgcctttgtgtgtgaacatacacttgactacatacaaagtgcttgggtaatgcttcatttctaccaggaccctagactttctccatcgtttcttgcataagaatattgacataaagaagtctgaagtcagcatgttttgctctaataagtgacttcatatttctgccttgaggtccacaggacttttttctttgtccataaagtctggtaatgctgcaagatcatattttaggattttaattctgtggcattttttcctagaacacttacatcttatctacttgtaaattcaggtttttctctatttcaggggagttttcatctgtcagatctttgaatatttttctgtttcattttatttcaattttctttttcaattgtaccaatgatgagcatcttacatgtcttttgttgttttctcatatctattggctttcataaatggatgtacctcagttaataattttttactagtttgtattttgatcgtagaattttcaccacatgcccatattttgtaagctaatgttgttcaattttaagagtttataattctagttttaaagtcttttttaccaaaatattctttagaagagtgtttgtttatatgctatgacttccaagagaatggattcttttcagctatactatttgcttttaatttctaattgtaggacatcatagttaagaggtgtggctttggtggatcattgatactgtctttgtgtcttaagctacagttaatattttaaaatattcttctttatgatatgtgtagacaattgtgtttacatcattgtgttctttaaatccccatgttcctactttgtcaatctgtcaatttaagtttgtcactttttccatttatttgtcaatatatgttcaaatttatccttgtatttctgaccatttttgctttatatactttatttaatcaggcattattttattttctcacataaaatgcattttaccaagatagactacttctatggtagcactaggcatcataatacatgaatttcatattctcagtgtcttagcacaaagtttatttcttgatcatatcatagttcattgagtgtgttctctgtaaggcaatgaacaccatggtcatttagggactcaggtttctcccatcttatggttccatcttctattagtttctgagagtcctctccattcagctaaaggaaaaggaaaggggatgaaagttgtacaggagaacatcaaagggccaggtctggaagtggtggatttactgtccgtattctgttaagcatacataactacaagggaggcttagaaatggagtctagctgagttcctacatggaggaaaaaaatctggtgaaaaatagaaatatttgggctaccatttattcatgcttatccctattatatcttttgttttctgaatattgaaagtttatttcacattttttataacatttcaggagtatacatttgcatccttcattttaagcttcattgttttcttagtttaatctcttgtgaatagtgtattgatagatatctctctctctcttaactcagcctcataagctctattcattaatgggaaaatataacccattcatattttttaagatgaagtgtttaatatttctgtgattttattttatgctaattgttaaaccgtaagtagtcatcatttcctttcctattttctacctttagaaaatgtaatgactttttgggatctattttcatctatgtagtggtttagaaatatcattcactgaatgaatcaagattctgagcatgctttttcactcctcagtggaaatgaaaacaacagcaacaacaacaaaccaaataccctgggatgttcttcatgtagatattggttttttgttgctttgatggaaatgtgacaggagagtaggactaatgtttgtgttcactctaccagtaggattaaatccaatattctcttcaaaatctttgatttcattttttttattttgtgtattttaccctacctgtcattgtacctattctatttcttgcatttttagtgtattttaatttttggtataatttttcttgtaatactgaattcttttgggctctcagtatgctcgttttatatttttgccaaattatcttttcctttaccatttgcatttattcttgtatatttgtttcagtaggtccaagttttcctagaaaaaattgtgtgtgacattttctcctgttttctggaataatttttcttctggtgtgggtttttaaagtctgacttctgtgtgtgtatatatatatatatatatatatatatatatatatatatatatatcctttttcctctcactcttttctgaggaagtaaaagcaagagttgtaatgtctgtgcctgtgcctgagccccacacagaatgctctctgttcattaatcttggtatagaaagggttgatttcaatttcaaactatttaatctgaagaaagttgtgaatttttctttggacagtctctctccctctctcccttcctcccttcttcctcctccttttcttctctcttttcatattcttaatctgcaaactacttttaatagattttttctataaaaatctataaaatttttatataatttttttatataaattttgtgcgcttttctatatctggacttcttttccttcctcactgaaactctggaccacactattaagatctcttccagctttaggctgcatatatctaagcctactactatctttgagaacatgttatgaaatattacaaattatttcacatctaaaagttgagattagattaagaatttcctaacatctgctgtcttagaactcccccactcattatgctaatagttctcatatcatttttgccaaaggtgatttcaaacagattaaaaactccacagacattacttatactcttgaaatacatcagtattgtgtatgtgttcaagtacttctattatgtaaataattgcaaaaaagtaaaatatcttctttaaatatagatgatatttgaagcatttgattagaatgtatacatatctaaaacattcattttttaattttcataaattagaaaatatcaaacttcagtataattaaattaatattttaaccattcagctaataaaattttctgtggtttgggaaggaagaatgatagcttaaattaattccctttgttattttgagattttttgttcatttgggactatagataaaagaagataatgttctcttcctttaaagcttggattgaagggtgtatcttacatgtattataaacaatataaaatattctgataatgacattgtttaattatgagtgtttgacatagaaagcaatgatctctgacactttttattttttcagaataaattgaaaatatattacctggctacctaaccaggtgccaccatgttaagcaattttattatagtttcagagaaaagctagcctatgtaaagcatgttctttgaagatacaagtctaacacattgacacatatatcatacacccacacctaccaatagaaaacaacaacaacacaacaacctcattaaaattaatgaggcaaatggtgctatttttgatgggacactaatgagagaatcttttttttttaaccaaatagaatcttattaatttatgtcagaaacagaagtggagacacagtcatattagaagtgttaattccgcaagggaatatctccaatggtcctttaactgggcttaaccacttatttaatcaaacttatttagcttcatgttaacgttacatgatttaagatcattcctatatcatagtataagctctctgaaaaaatgttattattcacctatatacccccagtacaaagaataatacagtcatgcactgcataacaatgttttgatcaatgacagctcatatatgtggtggcagttccgtaggaatataatacagtatttttaccataccatttctatgcttaaatatattgagatacacaaatacttaccattatgctacaattgcctgtagtgttcagtacagtaatatgctagactagtttatagcctacaagcaataggctataccatgtagcctaagtgtgtggtaggctataccatctaggtttgtgtaagtgtacactctatgatattcccacaatgacaaaattgtgtaatggtgcatttctcagaatgtatccctgtcattaagtgatgtgtgactgtactttgaatgctgtaggagcaccctttcttcccctattctaaaataaaaatatattttgtttcacttttatagtttttgaatgtaaaaaaaattaaataaaactgagatgttgatcttttaaattgaaccaaaaatctttctgaaaccagtgttggtacacatcattttgaagggtactatataaataaataaaaataaaatcaaattttaattaaattttattataccaacatattaaaagtaatggtgaattccattataaaatggtatattccttgtaatgtgaacatctgttatttgtcttgatgacaaataagatgtcatcatcacatcacatgaagatccatgtgatgtttcatcaactactgatgtggacacatgtgcatagtaacaaattcatctttgagatgaatgtaaaaaatgtgcttaatatgcttattaattgacaccaggctacgtgattgtctatcacaatacacccacttttatgtcagcattttctcatatttgagatagaatacctatagtctatcctggaggggaagaaagcatgcaaaaatgcatgaacattcattctgcaaatacttagttgagcgcctactttgcatcacagagtggtatacatatgtgtcgagcattaagatatgtactgagaaatagcagttaacatacagaaaaggactctgctcccatggagtttatatcctaatttaatgagactggaaatgggcagaaaaataaaatatgtagtgtatatgtgttgctatgacaacaagaaaattaaaacagagagcagatactggaaatttaaatagggtggccagagaaggcctcagaaaggtgacatttgagtaaaatctgaaggaggtgaaggttttttttttttttttgaaaaagtatagttaggttttgttgatgacagggatttatatgatcatgatagcttcaatcagagtaaaataaaaaacgaaaatatcgtaggaggccaggcgtgatggctcacgcctgtaatctcagcactttggaaggccaaggcagacggatcacctgaggtcaggagttcacgaaccagcctgaccaacatggaaaaaccctgtctttattaaaaatataaaaattagcagggcatgacggcaggcacctgtgatcccagctactcgggagactgaggcaggaaaatcacttgaacctcagaagcaggggctgcagtgggccaagatcatgccactgcactccagcctgggcgacagagcgagactatctcaaaaaaacaaaagaagaaagaaaatatagtaggaaagggtacattaagatacttataaaactatatattttaaagaccatagcaggattcatattttaggaaccatggcctttagttctgtatttaataaatttaacagaaaattattctctaaatataagcatttaaagtaatcattaacttgctgtttggagatatgcacattaatcaattacttttctatcaaaacaaacaaagtttacatcattgtgacatggactttgcttccgttaacttctctattatagttaccatattgattactagttatttgtgtgttttgttattattctatagctttattgaatataaggaccctatgtgttcatctttttcttgtgtacaaaagcagagtaacgcatggcactcagtaataacttttgaataaattgattcattcattcaataaataagtattgacatactactgttttaagaactggagatacattggtaactaaaacagaaaaaatatctggattcatgaagtctacatgttagtggaaaaagtcaataaatcaaataagcaaaaatacatgtcaattaaaatctattataagaaaaatcgagaaagtaatagcaagtagtgagaaagtatatactctcttaccttttatacctcccagaggcagtgatattgaagatgaatcagaaagagagggaataatttgagtcaaggggattcctgaaagaggaaaccagaagtccaaaagctcaggtcttgctcaaaggcacagagcaagaggctgaggtttgagaggagaggggtcaatatgataggcaaatggtcaggtcacataaacctgtaaactgtgatcgagtgtttcaatttgaaccagtagtgtgtttgggccagagaagtgacatgattctgtttatatcttttaatgattgctctgtcagcttggtaatgaaattgagtgtaaagggttaggaacggaggcaggtggaacagttcggaagctctatgtcgtgtttttaagaggtggtccctgtgttgatctagagtagtagaaacaagggtgattaagaacaaaacggaaatggattaaatataatagtacgaagggaagcgtcattgaaaatatctggttggacttttcaaatacatgatttcttgtaaatgtattgatatatataatggtgatatttgaattgtatcactatttggtagcttttaacaaaaatttcagctatcaaagtgaaatatttatcagaatcaacctcaaattgttattgaggatgagtgctatcttttcacaggtttcttgtgaaaattacttttaattgtagtattaactggtaatttattattgcttctttaaattaaaaatcacctttttggggagttcttctaagaatttcttggtctttagtttttgtatttacttatggtatagctaggacggattttttaaaaatttatttatcctggttgaggtttgtagtgatttttgaatctgtggcttaatgtgtttcagcagctttgaaaagttctcagccattaggtttaaatacagcttctcctctctctcctcttttactgagaccccagttatacatctcaaaaccttttcttatatcttatgctgttttcacaattttccattcttttgtttctctgtgctccaggtatgcatgttttattctgacctattcagtttatttttctatgtttaatctactatcaaatttctcttaatttcaactattttcaggtctaaatttttattttattggttatttccaattagctgccaaaacttttcatcttacttatattttgaaaatattgtatctatatctggatcatctagatttattatggatccaatttcatcaaattctctatttgttgtcaattgtttattaaaaatctttttgaatcaagtgtaagacattacatattaaaaagtacagagataatttaagaatctggaggatgatattttattccagaaagaatgtgtttcttttccattttttgcaggccctttaggttaggagcagatcaccttaatccgagtagagatgatgtttattcaataccgggtttctgcctttgtgagggatggtatatttctggtttgctcttctgtttaaggcatagtccttcaggatcccaactgaatgcctcagggcccctttaccttggtagaatataaacggcaattttgtttctcaagccctgtgaggctgccatcaactctgataagcttctcagcctatcacctatagcttttaattaatttttattgattgattcagacagtcaatcaataacagctgtaataatagctcaccgtaatcttgtgaactctttcacttaagtgatcctcccacctgaacctcttgaataggttggactacagctgtaagccaccacaaccaactaatttattttttatgttttgtaaagatggggtcttactatgttgcccaggctgattctgaactcctgggctcaagcgatcctcccaccttgacctcccaaagtgttggtattacaggcatgagccacttcaaccagcgtactcatagcttttcaatgcagaatgcctcaggagaagaagcaagaccaaactgtgagctcatctgtccaggattccattctcttcaaaatcttggctcacatgttttctatgtgttgttagctcttgagtgccctagatggaaggtaggtagttgtgtgtgtgtgtgtgtgtgtgtgtgtgtgtgtgtgtgtgcgcgctctctggcagaaagttaatctgaagctagtcagccattgcctgaaacgttttgcttgatggaaaaaaatgacagaatacaaaatatttttagaggactattaatcaccttattgcatatatttaggaaacaaaaaatatatatgtatatgtatacttatatatgtaattaaatatttaaaaggtataaaaatcaaaataaccccaaagaaaatgtactaaaaaatttaataaagataaaagccaaaaacgaaatgatgaggcagcaaactaaaaatgaagcagatttgatcaataaaactgaaaagctgttcccttaaaaagaaacagtagtaacattgaaaatatttgacaattatagccaaaaagagcgaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaattgagagagttacacaataaaaattaaaatgctacggacttttaacttgtctttgtttaaaaaatttgcctgcaaagtatcatgaccatgccaagtgatgaaaacaagtttgatagagaaaacattaattttttgtactaatctaaataattataatactggtcttctacaactataagtaggctatgttctcaaaatccaattgtaaattggttgcttagacctggtatgttttcacaaggaaaccatgtaccaagccacaaaagcacacttgaactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatggcttttgcttttgctaggattctggtgagccctgaaagtccccagtagtggcagggagggaatttaaagcctccgagccggaagaaataatagaaaaaggagagaattgaggactgggtaggcagcttttgtagcattaatgggaagtgagtccttagcaagacagatgttctttgtaaaaagtatgtgtaatgacagattaagtctggaattgtcccaaatataaacatttgatgaatctaggtggtgcataggcaagtgatcatgatcctattgtttcatttttttttgtatgtttgaaaagttctccagttaaaaattgaagtaaacgcacatacccacacaaaagtaggtatgtccatgtgcctaattcaataaaagaatatacatattttctgattatgacctgaacctttcaaagaaagatcaaattttctgaatataagttacattaagacctctttacatgaaacattgataactcattgttttcctattttcctccaaaaccaatatatttttttcctgtgaccattgagacctttctgggaactatgtaattaagaaaacttttaagatatttattattatccaaaattaaaaagtcacacgagtttcttggataaatatgtaattatcaattgttaaaacacatactgtgaagcctgttctggaggctcatataaatacatattttaaagttttttcttattaagaattttgtgtaaaacagtctaatcctgccaatgtatgaaaataataagatgaacaaaccatctgccaaggaaatgaaaacagtattaaaattgcacagataaaccatatctagttctgaagaaatggaagagctctttcctggaaaaacaaaaaagtcgtgacatttttgtagaatatcatgggttattatattatcaagaggacaaagttttctgatttgggtgagagggtcactcacccttttttttttttccccaaaataactagcgccactctggtaccagttttattcaaaaccctcttgagaaaaataaactattgagctaaaatgtggaaacaaatcacttcatattactatacttataagacagacaatatctaaagaatagttgagtgtcacttgtcttttcagttgtttttcacaggttgagagttacttatttcaaaatagttggtaaagaaaaaaattgaaaaattataaatgacatttatgttgttaaagctgcaagatgtaaacatcatgagaggaaaagagtaaaaattagacacatttgatagtcaagcatccacattaatttatcagaatagtattatgcatgaaggtcccaggcttcactatggccctgtgtgactctagccattgttctgacatatgttcccaagcagcagtacctactttttctgggacccgtagattgcactttcttcaaaacattcagttttcaatgaatcatttgataagaggacttcattatgagctgagcaaagaatgtcctgattaatctcttctttcccatctaaggggctgatctcgccctctgacctgtggatgtccattgtcgtgtatctcatagcatcagctactctgaaagtccacctaaccctctcagtgctcaagcactagatcaccctatcttccttctgaccctggcaataacaccatgagcatatttccccttagatgaactgcatttaatcaatttctgatttcattaggtcaaatggcatcttgctttcaataatagggcaaatccagagggctctttgctctaactctcaagcaatattttattggcattaatacactactgtgattgtaaacaaaagaaaaaaaaagatctttggtatcctcagaaagtgtccttttgtttattccatgactttaaaatgggcgtatattaatgttttcttataaagttaggcatataatcatcattcattgttgtcacagcagatttaaagaatctttgctaaagctgacatttaagcatttaaggtgtttgtacagtgaatccatgtgcagagcaaaacattattttgaatgcaaatgatcacctctttctgtatacaggatttatttggtcaattcctttttgtttctgaagtatggtaacttacgctactttccttcaaaattctaaagaagtaatttgctttttgatggatttatttggatgtcccaaataggcctaataacatgcttgggggaaaaaaaaaatccgttgttaacacatggaatctttgagattttcttgtaaaataagtttcttattactcatagtatagccctcactaaacaaaatcagatattgctttcacccaaaagtattagatgaacccagaaataccagatgttttcatcaaactttaataaagtgagatctgtaacattaggattcctagctttcttcaagaaatggctcatggatgacttgagaaacctaaagcaatctgccaatacatctttctttggttatttaagtagtacctgaaatcagttgttcctgctacccaattttcctaatgtaaataaatataccctatttgtatacaaaattaattggcctaaaaaggtagaggactagataggaaatgccataaccaagtagaaaatataggactgggattttgctgtcagataaggtcttctccaaaattgaagtcaaagattaagaacaattatttttttttttttttttttttttttgagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgacctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgccccttctccagttttttttcatcactccctgacccataatttatgttccaggtaaatagtccctataatacctgatgcacactgctacatgctgacttttaccttgaaatcagggttatctctttacaaagttaacatcctttaggactcagcccagatcatacttcccaatattcccatcatccattctaacaccctattttatttgaaagagttactgtgattcatagttattcttgcagctcttctgtgggctctgacttggaattttcaagtttctattggaggcaataaaagaaaaagaaactctgtaatatataacaaataattacagtaattttgattatttttataagactgagaatacttttctctagtgtcagcttatttgtaaaaatccagtttaacacaaaagttatcaaagtgttagccctcagaaccctgttcaaaaggttgtatgagattgtgtaagaaatttgagtctgagagtcagaaaatttgagtacagttcttaactccaagatatacagccatatgactttgacaagtttcttaagtttcttgaaattgagtttccagataaatataatatatattttatataattataaaatattataaatgtaaatgttgattatctaaaaagattatatatgtatttgatctagagaaaatgtatatagtggatctaaaatatatcaaataactttgtagattatatattatgttataaaatgatttccatctgggtaaattctgagtaaaataatcatgacttttgtttgtttactataaatctaccaatttagaaatatagcaagaatgtacttttgcaactgttgaaacagttgccaaaatgcagcataaacaaatgcgtaattttttgaaggcttaatttcttaatatcttcattattttattgactctggttaacatatatccttttaccttttgttttcttaagggatcctaagtgtcatggggaataaatgcttggttttgtcattcctgagtgtgagcctgacacgatggcaatctctagagattaaagtttgtcaagtgtctgttgccatttccattcttttttttttttatttaagttttagggtacatgtgcacaatgtgcaggttagttacatatgtatacatgtgccatgctggtgcgctgcaccccttaactcgtcatctagcattaggtatatctcccaatgctatccctcccccctccccccaccccacaacagtccccagactgtgatgttccccttcctgtgtccatgtgttctcattgttcagttcccacctatgagtgagaatatgcagtgtttgggtttttgttcttgcaatagtttgctgagaatgatgatttccaatttcatccatgtccctacaaaggacatgaactcctcatttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctttgggtatatacccagtaatgggctgggtaaaatggtatttctagttctagggccatttccattcttatagaaaatagtaaaataatacaagggtagaattttgacagagagttatgtaaattcacttaaaagcaaggaaagattttatttaattttaatgtttaaataatacatattagaatcaactcagtgtcatgaagcatctggtgataaaaagatgggttttgttgactaaagtaaacatattatacaaatcacatggatattgagccacttataaggagtaaactgaaaaccactgaaagtctggtctcaccaaactatagtgtattgatcagctggcaagggatgcccaccatgttcactgtatcaaaaggattgtgatatctgagttctggggagtaatcctagctgacctagcttcagtcattagcttaaaccaggaccactctattccattagactgcaagtgcctggaggtataagccaagaccttctgctaattacccctccctatccccatcactcagaacagagtctgaaacctagtggtgttcagaattattagcttggctcaaaagtaattgcagttttgccattttttaaacctcgtttacttttgcactgacgaataaatgtctgagtgagtgaggaaacaagtgaccgagagcatgagaggggaaccctgaagaaacccttacagattttatgcatgaggaatgaagggaaaggctgaactgtgaggcactgtcctgttgatgggtgttttggtttgggttcctccagaagcagtccctgagacaaagatttgatcacaggtaatatatttggaagtgatccctggacacacataggtaggggctggcagaagagagccagggaagagaacatacctatgaaggagaataaaaggtttatggagtttaatgctgctgtggaactctagcagtttttcagatggagaaacaaggaatgacagagaagagcatggatagacttttgtacaggaaggaaagaaccatagagcataaaatagttgaagagcacaatagattggtgaggctggaatgtgcaaaacattggggcaacaactggagatcaggttggaaatgaagagtgaaccattggcaaagggtctctcacggaatgctaaaaaattaggacttttcactataaataatgggagcctagtgaaagacttcaatgcaggcaagagacatgaacagatttgatttttagagtaataattttggggaaaatgtggagaatggcagagataggtagcacagagtgagagatcagaggtaagaagatgaattcagagatcagaggtaaggagatgaattcagagactattagaatagaccatgtaccatatgctgcaggtccaaactaggcagtaggaataggtgaagaagaaagattccagagatatctgacttgatattgataggttttcttgacatatattgtaagtcttggcagctcccaaatacccattgcctctgtggtttggaaaacaaccatcaggatgccaaggagctaagcagaatctcattctttcaggagcctactagattcttgttactctagatataatccatggaccaacaatgacaatatcacctaggagcttgttagtaaatatggcctctccagcccaaccccaaaccaactgaactgaatctgcattttaacaggtgattcccatgcacattaaaatttgaaaaaaacattaccatatgacataaataacttctttaaagaggtttttgaaagtccagagccaaagggtggcctttgggacttggacaaaagacctactcatataaaagagctatcttgtcggcctttgtgtaaaataaccctgcatatggttattatattggtcatgctatgacaatgcatgattttgaatggtggctatttaatctcatcaatcccttccaacccatgattacggactaaatgagaaagaaccaagacttacactgccttgtaacttttgcctgtgccacacctaagtcagaaattctgaactcccacatcaaaaagtcaacagtcccagccaaagaacagcaacaatatcaaaaaatgattctgagcctaaactaccctcaccaaaacagacaaacaagaaaccaaagctccaagcaattccctggaaattatccattaattccctggatagctcaatgtgcaaaatccatttgaaattctacttatcccttatcttccatttgactcttcttttcggaacacataatctcacatgtagcctctttttgttatttcccttctcaagcaagaataatagtatttgattgcttaaatttctttatttttatgttgttcttgagtacttgaattcatttcccattggcctttcaggttagatgttaaaattctggatgagcagcaacgtagctgttttactcgtagactaagtttatttgctgcacctgccaaaagaatcaaggcccaccaggctgcacttcagtcaagctgttttgaaaaattgcaaagaaaacaaaagtaggcccacaatttcacaatttagttatcaaaaaatagaggaaagattcaaaataaagtctgattaaccctcttagtagggtgagatttcacttactgggaagaactgataatgattatttctgaaataaaacctcattttttttcatgtctacctttttttaattataggaaatggaaaccaaaatgggcaaataatcattcttttctcagtaagaatctttctcataaatttgcccctaaaatgtccagtcttttaaaaatgttttggacagtaatgagacaggtctgaaagagatgccttaaaattttagtagtgcctagattcacttcacttatttacctttcttactttaagacagcttacataagaataattaatctttttttttttcctagtgagtacctgggtttgttattgaggtttcataattaatctttttttttttttcctagtaggtacctgggtttgttactgaggtttcatgcttttttttttttttttaaatcgggcataaccataattgatttccacggaagggtttggctgaagacccaaagaatttttgcttaactcatttttattgaacgaaatccagaattttagtcaagaagcattagatattaatcacatatgagtggggtcattaaaatttcctttaccttccagaactgcaggtcattatggaatcataagaagcagtgagctcacttaatctttacaattacataaaagtgattattttcttaagtcttacaagaagctcttaactattagttgaagagcatgttggaatattagaacatctgtgttgtgttattatagatgtgacttgtgaattaaaaaaaaattctctgactcaaaactcttagaagttaccctttccagcttgaatagttttaattctttaacacagtttgggagtatatattttttacctcgcaagtagagaccttgttgctgaaatataaattccagtatcatttcttaattattacactctcaactttatagaaaatcagaggaacttcacaggttctaaagattaggaaaaaaagaagaagaaaattagaggagaaatgcaattttttttactgcacttaagaataacagttggtgacaatttaaggtgagtcagtttagggaaaaactgagacaaatccatcctctaaattattgttgcctgtctccatctttttcttgtaaccacttctcatctttgactttgaaacccaacagtttaaacttggttcttatttcagtgggctaatcccctttcataaatcttgctcaagagctgaaataatttgcacatcatttaaagagtatttgctttgaaatattcacctcaagcccttttgtatatcctctctctctaaagatttgtagtatttgttttgttctctgaggtataaaagacctggataaactttattcctgttgtttcaagattagttaacgaaaatgcatattaattcagcagggacggaaataaacctcagtaaagatgatcatacattcgcctctcggggatagcaaagtacaaaatgtcagtcttcaaatctccttggacttgctcaaaagagcatttggggatttaaatttccagaatatgtctacaaatgtattttctttgttgtggagaacagaagctatactgattatttttccccagaaaattgattctaatttgtgtttgaacaaaaattaagccatctagaaagtagcacttcaagaagacagaggaaaactgccactgaaaaggtaaatttaacattaaaaattatattcttgataagccactaaatttttagtttatttgtcatcagatcccaaatcccaggatagtttcacagaatttctgtatttttttctatgaaaaaattagaattgaaaggacctcagaaaatcaaaagtagacatatttaaatagagttaaatgttcctctgcatttataagctcaaattttaaagtttgttggtcagctcagaaaaaaaatacaaatttctctagataatatatttgtttcatatgttaagatgtgccctgtgtttttcttaaactgaaaatgaccataaacttttggcacttaagtgcttatccggaaatgactaagtggattcaggagtaataaatcactcatatggatccagccacccacagtcttgttccacttctcttctttacaagtgtagtaatagacatttccacagtcctcagggtgccgaactttgcaccattaggaaaatctgcaagtagcttgatttatcttcctcactcagttagctaagacccaactaactaaaaatcagcaggaatgaacttgacttgttaaacttttttaatagggagatgcaacaattacaactttcctcctttgccacttcaatttacattggatgtgaagcccctggtgaaaaatattcagatgagaactcaaattataggtgcatggctggatgatgctgactctaggttttcattatacacagagaatcgtctgctgtttgcaattaatccagacacaatcctcttggtactttgggaggaatgcggaagaaatagccattttataagttgtaaactcctaaattaccctaaattagagacactattaatcgaacactttgatataggtaggatctgcttattgtgtaggctcatcttcccctgatggagcaatcaattaaatatttaggatgtggaataccttccgggttggataatgcatttcatttaaattatggccctccaacccgaaacattaaaggggatcttaacggatggaagcacattactgtctcttggattgggcgcattaacactttaaaaatgaatgtgcttcccaggatttcctatttgttccaccagctgcctgtggatgtgccagataaacagtttaaggataagtatgtaaaagatgcatgtgtaactttttgtgtgctgaggtgcacccttgtagcaagagtcctcaactgtggcccctttggatttttttttttttttttgtctcaatgctgtagcagtctaaaatgagagtgctcatttgatcatgggagagtaggagggaaagccaacaaaagatgtaattagacttctgacaaaggttctgtctgtgtttaatcttttatcatttctacctataatttatcctaataaatagtgattattactagaaaatattgggatgatatagtagaattcaaaataagcataagctttcccattctaaaaatatttggcataaaggaaattatttaatttttacccaaggacaattactatgtcaaatttatgaacagtattgtaagaacagagttgttatgtctcccataccacggaagcatggtatagatatggtaaatactttagagagcttaccaggctgtaggcagcattctaagcactttaatctactctcattgaatcctgtcaaccctatgcagctcagtgacattattatcatccccattttatctattaagtgactgaggcactgaaaggttaatcaatttacacaaagttatataattaagaagtagctgagttagaatttgaaaccaagcagtctaacttcacagcctggaaccacaaaccactgtgtagcatccggcttctggagtgaggttgatggtttctgcaatttactagctctacaaactttgagccagtcacttaacctcactaagctactgttttataatcttaaaaatgtcaataataatagtatctacctcacagagttgattggaagcataaattagattaagtaatgtaacgtttatagcattgtttgggagaatgtaagtactcaataaatgttaatcataacgttagtacaagtattttcttttcttccatagtatttggaaaagttctcctaatttggttaagaaaatgttatcttaaagataaatgattgaaattcctagagattaatgtattttccaaaatgtctttggacttacaggggaaaaatagtatattgagtgccttacagaaggctataaacttcctgaaccatgagtctgttttcattcattttccatttataaaagtcttgattcactattaacataatacataaatatatcatattagcttactgagtgaaaacaaatttatccaatcggaaaaaaaaaaaaagatgttaaagataggggtcaatttctttgtttcccagagacaggcttttcatatcaaatctgatagaacacatgcttcagaagggagcagaaaactcagctaactggtataattatgtaactcaaatggtcatattgagagggttaaactttggcaatagaatgtggaaatacaaagttcaatgaagttgtaggaatttaactgaaaagaaattacttatcagcattttgatggggaataaacaaacaaaagaaacaaattggtcctttcaaagttgggtggaaagaatgttcctgaagccttccttagtaatcaccgtcattgagaggccctgaggactcgtatctgtagtaattgatacctagtcctcatgctcaaggaggaagacaactggtatttatgggcttgtcaagaaaggaattagttggaattcctttttctactccatctttcactagtctttattgagccaagtttattgtaagttaggggtgaatcatacagatacctttactctttcaatatgctaagaaaacaattgggatgaaaagagaatctgatattttaaacaccaagcaatgtgttttatttggctgggaatacagtcttatgggcaatcactgtatatttatctgtttgcttgtttatttggaagtcctaccagtggagtaaagctcctcatctattgagctctgatcttcttccactgaacagatagaaaggaaaggccttagacagaattataataaaggtgtatgaggcaactcaggctcaaccagaaagatcagccaatcaactctgaaaaccaacaaagatgcaagttgcacagagcaatactcctcctaatatttttcttacgttcataatatgggtggattaataatttttctgtgttgtaatatattcataatacaagcggattaactcagattaaaatgctctatatctggtgaatgagggaagacaaaataggccctaaaaatgggaatgcttatttagggaacaaacaaagatgacgtaaactctaaaaagctggagtactcagagcaagaactcagttcacacattcacatcacagacatttgtaggggagttgctttgtgcatgcactgttttaagcactggagttaaagagactccaaatgttatcaattccacattaacaaagagagtttgttactggaaggggctcccaatccagaccccaagacagggttcttggacctcgcgcaagaaagaatctgaggtgagtccacagagtaaagcaaaagcaagattattaaggaagtaaaggaataaaagaatagctactccatagagccgttctgagggctgctggttggctatttttattgtcgtttcttgattatatgctaaacaaggtgtggcttattcattagttttcaaggaaagaggtgagcaattcccggaactttttagaacatgctaaaggacatactaaaagacatttagcatgctgatgcattatagttagtgtataaggagcagtaaggacgaccaaaggtcactttcattgccatcttggttttggtgggatttggctggcttctttaccacatccttttatcagcaaggtctttgtgacctataccttgtactgacctcctatctcatcctgtgactaagaatatcttaaactcttgggattgcagccccagaggttttatccttattttacccagccgctattcaagatggagttgctctggttcaaacacctctgacatttatggtcaaattttaggtagctatttcccattctctaacaagttgatttaatttaaagatgattatacacatgatgaaatactgttaaaatattcctgcttgattttattaacaaaacgaatatagtattttgatctaatttacatgtctagctcatattgaattttttaagaaatttcgcatttacattaggtccaaactctcatctatggagtattaagtagcgccatgaccacagtccaccaaagtgtttaaaaggaaaaaagtttaataaatcaaaatgctccaatcttgagtcctggtgtctttttttaaaatcccaaatggtctggaggctgacattatttcctggctggccctaggagggaggatctgtcacttgttagtaatagacacagagttaaatgacctggagacctgccattaggaagcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttccaaaaagaaaaaaattgtaatcaatctatatatattagtatcagtatgaattaaaaaaataaaattttgtattcaccatgagctgttctaagcatgtagcatgtattttctcatcttcaagacagttatatgttaataattttatattcatttacagaggaggaaacacagatatttagttttggagtctagattataacttcagcagtctaaatcagaacacattctattataccttttataggctttgtataattttccttttgtaacttgcctttaagttttatttgttattatatataagtaattatgttattaaattgtgtacatgtgttttgaaagacagatttgtgcagatataatgcatgtatgtctatagtatataaaaataaattttaaggggcatattgacagatggaaaaagcataaatgtcaaagaaagttgatttagaaattaatatataataaaaattaaactagcatttattaatttaacagatggtgagttaaaaagtaaaaacaaaatctcgaatcgtaacttgatttttacaattagtgtgattatttcacaaacttattcaaaagtttgctattttcttgttctatttaaaagaaaaaagctcccatctcaaagtttccaccaaataatttactactttcatttaacagattctgttcagaaatctgcatatgtacaaatgagcaccagaatataaaatttaatcatagaccaacatccaaaaaattatagtggatgtaggtgaggcatgctagctcatgcctgtaaccccagcactttaggagatagagactagaggatcacttgaggccaaaagttaaagaccagcctagccaacatagtaagacccagtctccacaaaaaataaaatacaaaacaattagctggacatggtagcatgcacctgtagtcccaggaggctgagggaacttacttgagcccaggagtttgaggttacagtgattatgccactgcactccagcctgggcaacagagtgaaaccctgtgttgtttttttttaatatatatatatttatgatgtaaaactatattttacatatttatattgttgactaatatatattataatttatactataaatacaaatattggacattgtttttaaatacccacagtatttattattaactatatactaaatccacaaaattatacatgcaaaaattattttaaaatgtgatctgtgtaagatataaaaaattgataacaagaaattaacaaaataccccaagtaccttattaatttaaaaattttctgtcaattgcttttgtcttaaggataaatccaatatcaaatttaatagtatgcaaccaaaataatattcagaggcaaatgcatagtattaaatgtttttaatattaaagaagtaaaacaattacataagaaatattttaggttaactaaacataactaaagaaatctgaggttagaaatgataaaataaagaaaaatcaatcacatgtaaaacaaaaaaatattattgcactaaaagttatttggaaagtagtctcttaggaatgaaataaaaataactctgaaaatctaattttagagaacataaagaaactagaaggacataagaaaaactagaatatttgaacatacatcttcaaaatctccctcaaaaaggtcccaggtctaaagatttactagtgaatgatgttaatcttctaactggtaattttcatgtcatttgaaagcacacaaataatcagtgagtaaaattttcaaatactcaagtaatgatcaaggaactgaaaaataaagcaacagacacatgccaacaccgctgtgtctgcagctatagtgaacggcatcaggatggtctgaaggcacttgaaatctaagtaggaccagagctttgacccttgttttccaggaaattccttcagggagacagttactgagacctgcgcaatgactctgcgcactacctgcagtgtgttcagagaccatttaaagggaaggagattcctgctgaagggccggtgatcatgggccagaggaaagaaaaatctgaaagttcttcgtgtccttgacatttgaaaatggactcttcaaatggggaacttgagaactctggctcttgtcaattaagatcattaagatagacatcattcggatgaatagtttagtgaggagaaaatttattccctcctttataatgttttcctctcctttgctaatgaaccattacattttgctttgaagttatgactcagctgttttgacattttcatagtgaccaaatatgccaaaatagagcaatttttttggaagaaaatatttgcaatacttggattgtgatcagcttgaggtaatatatgtaaaaaatggtaaacttgtcataatgcttagggtcacctgacctcttaaatgtagctgtttggtacatgatactaattttttttcttcttaatttaagcaactgactagaacttctttagtctcagtgaggtcatgctctcaaaaggcatattgccagctggtctcaatgcttggaggcatagttgtaaatttttatacagcaccttaagagtttttaaggttgctagtggcttcaattaaagaccacatttaatagattaacaagggatgccagattaagacttgaaaactttaagcaagtcacagtgaatttaagaaagttgcagtggggtataggaaatagaatgatttgagtagctaatgaaaaagagttgcaaagatttgtttttgccagcatccaatccaagttttaggatcaaggtaccactatctgattaaaatgccaaaatggtgcatctggttaaatggggggtggggggaaggatgctttatttgccttgtttcccatccttctcagtaacatttctaatcacaaagatgattagctctatcatttaaaaataaaactaaagtaagaaagtggcatattaatagttttcataaatcttatcaactactatatttcattgcatcataatcatgtagatataaaagcatgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatgaagtattaaagcagaggcctggtctgcttggccagagatgcatccctgcataaagtaagggctcattaaatatctgttaaataagtgaatgagtataggatgtaaaagaaaaatagcaacagcaactctaagtaatacagtgatcatgggtttactttgttttcttctctagtctccctccctaagtcttctaaattttccataataaatgtttgtttccaatatcagaaatagtataaaatatagcacaattgtgatggatgatgagcaagattattagtggaaatatatctcacaaagtgtgtactatgttttgcccatgaatatttggctcttctcttctgaaattcaaaactctgaggtttgctcacacgaatttttttccccacacttcaccagcccttgacatgtgactacaatatgtattttttgctactagttttattcatttcattttatcctctgcattcttgaaggcatgaatgacagacatctggaaaatatatatatatctagacactgaaaacataatttcttatcaaagagctggaatataaacatctagaagacaaagtatctgaataatgttaaattagaatctttattttatactaaccagatctcaaatatgaagcacaaattgtggtttattgcttgatatgtaattgcattagggttatcattctttttaatatcattttttccctcagttggattttatccaagaagtgatataatgtgctaggaagactttacctaaactttgatgcttttaaacaacatgtatgtgggactcctcctctctttgataagaagaaaatgggaaaatgaagagaaagctgaaacattaccattttaggggaaacttaggaaaggaacccagagtgggcagcttccaggggcagtttcaccattcttgtcagaagggaacagacacatagaatgtaaataacatacccaatattgactatgggaatagaggccccttctgccttccttttatttgaagtaaaatgtttgccccttcctcaggcttcaaattgcttagagcatctagaagacttggctgggcatggtggcgcacgcctgtaatcccaacactttgagaggccaaagcagatggatcgcctcgggtcaggagtttgagaccagcctggccaacatggtgaaaccctgtctgtactaaaaatataaaaattagccaggcacggtggcgcacacctgtaatcccagctactcgggatgctgaggcaggagaatcgcttgaatccaggagacagaagttgcagtcgcaccactgcattctagcctgggctacagaatgagactctgtctctcaaaaaaaaaaaaaaaaaaaaaaaaacagaactcaagcccacctttacattaaaatccttaaacaatttcttttgatgtggcgtattctattagactactcttatacgttgaacacaactgtggggtagtgaagttgtgatgtagaaactctgtttccttgaacttagtgctaactttagggagcacagatattaacatttcttcatttgggctaaatgttataagaacaatataaacactagaggattttagcttcaccaccattcgagaaaattggttttactcccaccattaaaaggaagcaatctaaagtaaaggaatcgatctataagtgtaagaacaacagcaaatttatcaggaaaatgtttaaacagacaaattaaccatttttcagtgtccattttcttcattatgaccaaggatatccttgactgtaaagaaaaattcaattatttgccaaaccgtaggtgctaatcctgtttctgcagttgtctgtaaatagaattcccctttgcagtgccgttttctgcatggtaccttaaacaaataggtcttagcaatagttccaataggattggaggttcaccattaaaaatagacttatcggcctgctgctgtggctcatgcctgtaatcccagcactttgggaggcagagtaaggctgatcgcttgagcagcctgggcaacatggcaaaaccccatctctacaaaaaatacaaaaattagccgggaatggtggtgcgcagctactcggagtagttccagctactcaggaggctgaggtgggaggatgacttgagcctgggaggcggaggttacagtgagtcaaggtcatgcctctgcactccagcctgggcaatagagccagaacttgtctcaataaaataaaatagacttattaccaggtgcacatgatatgtaaagttggttgtgtaaagtaaataaagtaaactataattgataggccatctccattctgctgggaattgttgtgttcacttgtttctaaaattttatttttgtggtggaagtttgcctctacaaaaatgacagcttacagttttaaactattggggaaaaaaaataaaactaaaagactacaaagaagaaatgattcctgaccattaagtcttctgcaatgccatgatagcaaaaaaaaggcacaaagttttactgaaggttagatacacctcacattcccagtagatatttacagaatctcatacatctattcattcaataagtgtgacactgtcctatgcactggagatacaataaacaaaatagatgagcgtccttctccaaaaatgtctcacatatgagggaatgctaaccttaaaatcaaagccatgtgcattgagtgttgaaaggtaaccaagactatacctaaccaacctacttttacaaaagacaaaagttagaccaaacagtcattgtagaatcactctgggttcaacagagaagcagtactactactagtaagatgtagtaagatggatggatggatggatggatggatggacagacggacagacagacagacaaaaagatttttccagttgcaggagcttgctatgcaagtctgaagttcataaagaaacagttagaaagggaagacacaaagtaggctggaactcccaaggcagaggctatttggggtctctgagcttagggaatatctaaaccaggcttgcttgtccaacctgcagcccctagtcctcctgtggcccaggatggctttgaatgcagcccaacacaaattcataaactttcttgaaacatgagatatttttgtgatttttttatttttagctcatcaactattgttagtgttagtgtattttatgtgtggcccaagacaattattcttcttccagtgtggcccagggagccaaatatactggaaaactctgataagcccactcctaggtagctcacctggcctagtctgatatatccataatatatatatattataggccgggtgcggtggctcacgcctgtaatcccagcactttgggaggccaaggcgggtggatcacttgaggtcaaaagtttgggactagcctggccaacatggggaaaccctgtctctactaaaaatagaaaaattagccaggtgtagtggcgggcacctgtaatcctatctactcaggaggctgaaacaggaaaatcactaaccctggaggcagaagttgtagtgagctgggatcatgccattgcattccaacctcgtaatcaagagcgaaactccatcttggggggtggggggggaagatgtcttatagataggggtgtctataataaatcagaacaggccagttgcaacctttttatctaaccatccatccagctatcctacatcttactggtagtggtactgcttctctgttgaacccaggatgattatacaatgcctttttggtctaaattttgccttttgtaaaataatataccttctgattaacttaaagtctgattattagagactttaatttcctctaaaaatttcttcacagcaccacctaaattggtgtgtgattgaatgactaggctatatagttcaccctagctaggttgacatattaaaaagccattacaggcacattcacttgcccagtgtcacacagctgtcaagtggctggaactaaaactgactcatttcctccccagttcattctgtgatgggcatacctatccaacattcacaccctccattctcctgttcttgaagacatctccattcaacagtaaaatgttgctttcaactacctcttaccctcttttcaaagaacaagattataaaatgacctgtaatagttggcatgtctataaatttaattatattttagtcaaaaccactcatttagctttgaattggtaaggctgatgacaaagccagtttggctagaacttctagagtctcggaaaaaataggctatttttctataagaaataaggtaacctatttattaaattgatagagaatcaaggtcaataattctttattccattttatttattttaatagtgacctagtaaagtagatataacttgatagaaataaagaatagactgaaaatataatcttatggaaaacaggtgtctagccttggagaaacagaacaaattacattagcgatttaagacatacaacaacatatcctaaaaagaattcttattaacatggcaaacattgccttaaaaagcataaataaataaataaatcctctgtatattcatgtaaatttggaaaactatgcttagtcttgccagacaagttatttatattactaaatataaatgacagaaatttctatgacaaattctagtcaagacaaacttctgttgcagtgaaaatgatgtaatcaagccgttttgcctctttacttgctgatagtcaaaacatctcaagaagtttgtgttggaggataatgacatttccagagatttctattataggctgtaccctcataatttttttgttctaattttgtctttatcataggtaatcatgatattaaaattctatcactattctttggattcctacattcccttaaagctttttattggaaaattttgctttatcttacataaaaatctttttcatcttatataaggcaattacgtcgtttttcacaatcaaatatttattataacaagttttattttttaaacttaaaaaacacccttcttttaaaatagttcctcacatgaataaaattgtttcactctttaagtgttgagactgaaagcctttctcccatcagtctctcaaaatgtttctattattcctcccttttaacccattgctattttctttccttcttccttaggtctccttaacctcctcctgttttttattttctctggttttccattaacattttaaaatacactttaatgagcctcagccaaaggctctaagatgaacaaaagcctggagaagagaatcaagagagggaggacaagaaggaaaagaggaatagtgggcactgctctcagttttaaacgaatttctgtggctggctctcacttttatagctggacctgaatgctacagcacttactaaggccactaaatcatagcaaagtaagggtctggctattaagaattggaccgtccttaaatcagggattattactgtaatctttacatttaaatattacatatatgggctattgaaaatgtagcaaatctgctcactgaaggcctttactctgttgatatctgcattttcagggtataactggcagtccttttaaatatctgttgtatttattttagcataaaggtaatgctttgtatttttttccagtttagaaatccaaatgctaatatatacatgcatatattacatgaaaaaagcataaaatacttgaaaacataattaccttttagatgctaataaagcaagaaaaataagttttttttttcttttcatcactactttttgacatgtcggccaataaaaatcaactaaagtttaccttctgttatattagcatcagtgactttctaatttgcttcactttctccatttgtgcttaggtatgacactttttgcaattccaaattcacatcacctctctagttcctctcttccaaaaagacaaaaagtcccttgcatgggttggatactctatgtctctgtttagggattcatttaacagataccccagcactgccagtaaacaaacggatgccttgaacagtgatggtttacaatggagactgacttctttctttatttccctgcattccaaaattttttttttttattttctttgtagtttgcctttgtcacattggcatgcagggtgagctcgggtcccagcaaatatccccaggatggtaaaattagtccagaagagaagttttattttgattggctattgtattttcagtctgtcatggttctctacttctatataggaggacaaattatttgggccaaacaatacaatgtggtttggaaacaattggcttttatgggcacaatcttattctttccatatccatttttttaaaaattgtgaaaatcaagccaatttttttttcagaactatgcaatttcccaagactcatggaaaagacagcttgggttgaattttttttttcaatttctgcttatggggaaaaagagttggttgtataaatcagcatatatatttgtccaagcattcatacattgtgtttggagtattagtggaaaagagtattttacataatgggctttgtcttctggtttagttcttcaagttcctgactcctagtccaatactcataaatcaagcatattcaggcaaaaagcaggtaattgagaggagctattctctgggtaattccatcctcttttttgtgcacacatttgcaaatgtaagtggttttcatctgtgcagacacccttgaggggctcgtctatcctcacatcatttttagacatccaagaagtttctttgtaaaactcttattctgtgatgccagatggttgatgccaccctacaagaccatattttgagtaaaaaggaccagtttagcaggtagatgaaacaacacccattacaattattgttgcatctcctgattcagtaatggcaaaatgtacttctcatcacatgttcattccaaacacaaaaatgagtaaaattcatatggttttccttttactctaagaattgggcacagctgctcccttacaagcattaaaaggaaaaaataaaggaaaaacgtctttaatttctcgtgtttttcagcatctcttcgaaaaatatcttagtgatacatggctcaacagcctgaaaatacctactcttgctatactcttaagcatagttttccttcacattatagtatgacagagggaagatttctaatatatagactggggaatctaaggaggagaaaatgaaaacttgaaataatgcttagtcatgctattcaattactccatggcctttttttttttttttttttttttgcagtcttttgtttgattcctgatctatgcagtctctgaaatgagtgtacaattcatttaccttgtctgaaaaaaaagttagtagttacatatgtggcaaatattgagtaaagatgaacattttaagtacttgttagactttcaattatttgggtttttccagaaaattaaaatgcattgatcacaaatgtaacagtacttggtttggggttgtataatcttcaggaaattatatgtgcaataaattaatgcatcaatataaccaataagcatttgttactgatttaaaaaatactaaaataaacccaggtacccaaaactattgtctgcttccatcataaggattgactagaaatttcccgaagaatatctttagatgacaacatagatataatacataattcaagttattaacttctccatttaggcttatagatcttatagacacaactgttttaaaagaagaacaagattttcatgcaaaaatatgaattatacagtagttttactgagtctattgctaatgcacatggagttcagaaccataatgacgatattgggcacttaagtcattagcctgtcatattacagcaaaattatttgtactatataatcattgtttccttttttatattgcacagatctaagcttagttcatctatctttgccatagcagtaccactttattgttgtaaatacctattttttaacaatgatttgagtatgttcgttgtagtttaagttcatgtttattagacctttgcttccttaaagctggaaaacatgaagtttacaatctgccatagggtgccttgtttgattgtgtattacttcatagcatcaattactgtatagtttatattttaagtacttgtatacacactaaaaatttcaaggggaatgggaacaagttttttctggttttttttttctagcaacatttccatcttattcatcatatttaagacatgctcttattcttaatattaaaatggaattctgtttgtagtcaactttttttcctttagggacttttaaagatgaacatgtataagtgatctctgatgactattttcaataagaacaaaatcatttgtggaaaaaaaagctgaaactgaaagcttcagctgcaactcatttgtgaacataaggtgaatatggctgtggttttcagaactggttccagggtttcataaaccttttagaaatggatattgattattactattcaactaataaaactgctttctcagaatctgttttgcttgtatttgatgccataaaggattgtttgccctataattaaatcctagagattatagcacaatataactcacctagcccataggttgctatgggtttctttgtgagagagagagagagagagagagagagagagtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgcactgtaaccagacaatgcctatccagcctttcctatattaaaaaatagatcatctggaactgaccctttatgagaatttatatttttttactttgccatgagttttcaagaataaaatattgtgtaataagagaaaggatcagataagcattgccactttagaagctttataactgtctcaagcacagactataaacttcaaatacccaggacccctgagaacctgtagtcgacccattcacacctgacagatatattttaaagtctgggtataaatataattatggagagatgactagcatgagtgaaatttcacaggtagcatgctagaataaagcagcgcttgaaaatgggcatactaaaattcagaaacctaatgattgcagataaaagaatgaaatgcaacttgtacaacctgctctaccgatgtgagatacaaatacattttaaaactttttcttcttatacacccctgcccactgccatagtgagcctatcgctgagtcaggccactgtgccaactgtagcaatgccccacacgcgagctccagtgggccagttctttgtattgacacatacgcaagttcggacatgacacccagaggcttgctccagacctacaccatccaataagaatgttactagcctcatgcaaacactgagcatttgaaacgtggctagactgaattgagatccactttaggtatgacttacacacaagatttcagagacttagtacaatgaaaaggatatgagatatctcattaacaaattttatattgcttccatggggaaatgataatactttggatagattgagtgaaatatatttttaaaattaatactatttctttttaatgtggctaccagaaaatttaaagttatatatgtgccccacattgtatttctatatggaaagtgctggtctaggggtctgagacctcagccacatgctggactaccctttccaagaacctcaatctgactctctcactctctctctttttttttctctctctctctctccataattgtcagatacagagaattctctttatcatcctcatcctatttattgtcattagtcacacaggactcttatctttacaatgttttcctttgtcttccattcaccttgccaatgataaagatgacttagaatgatttcagtatatccatggatgtataagtatccttaaaaaaaatttaactttttttattttaatgtattctatttttctttaagaaagagctcaacatgatttggcactagtatctgtgaataggtcaataaggagaaaaatactacaactctttctaggtgttcaaggttttggaaaaaaaaaaaaaaagggaactgagagcctggatctcctctaagacctgttgtgtatataaactcaaactgtcatttagtgataattaccaatcatcagttcccttcttcataaaacattaggtggtttattttcttagagcatagggcttttccataaatgtttaaatgttagaaacaagagattaagagttttcatttttctaaaaaaggaattcataatattcttttgttttatatatatatatatatttcattctgggaaatagcataaaagtagtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgttgcctgggtaagcatccaaacctgtagatggaggtgattggttacacttcttgtcagtcattcatcctactccaaacaggttggcatatatatatatatcctgctccaaacagtttcgcatatatatatatacacacacacgtatatttatgtgtgtgtgtatatatatacacgtatatttatgtgtgtatatatatacacgtatgtgtatatgtgtatatatgtgtgtatatacacacatgtgtatcatatgtgtgtacatacacacgtgtatcatatacatgtgtgtatagataaagaagatatgaatatgtgtgtatatatgcacacacacatgtgtgcatatatacacatatgatacacatgtataaatgtatatgatacacatgtgtatatatacacacatatacacatacatgtatacacacatgtgtgtgtatagatacagaaagaggatatgaatatgtgtgtgtatatatacacacatatatgtgtgtatatatacacacacatgtgtatgtgtatatgtgtatatatacacacatatatatatacacatagagagcatgcatttatttttgtttgtgtatatatgcacacacatactgagcacttttttgcttaaagattatctgggaccagagtctctagaactgagactagagtctctacaaaactaagtaattaaaaaattggcaaaaatcctgctctgggaaagcctctctaatgggagagaagaaaaaagagatattattaaaagaagtaaaatacatattagatagtgatgtttagcaaagtaaaaacaaaaacaaaaacacagaaaagaaaggggatagagggctcctaagtggggaaaacttacaattttaagtagagaaagaacctaggagaggagggaatgtttggggacaggcctgaaggaagtgaggtatgttaccatgtggatgtctaagaaaagaatgttcaggtcagaggaagaagcatgtgcaaaggacctgaggcaggatgtgctcaagaaagagcaggaagaccaatctgtttggagtaggatgaatgactgataagaagtgtaaccaatcacctccatctacaggtttgaatgcttacccaggagacactcattttgaggacccatcttttactctgctgttcagagctaatctatctgaaaagtgacggaaattaccctatggcctgcagaagcaaagcaaagggtctcctgcctactaatctactcccttacccccaaccgtactcacagctcagttccttggatctttagattctccccagagctgacattccatctgcaattaatcaagtgttgtgttaaattttttttaatatgtaaaagatgtttcagctgtgattatcaaagtatacaattgtgtgtcctaaggctacatggcatgggatatacatctgatgcaattctgatcattatcatcactacataaggtaacattgttccacatttatcaaatcagacctcctgccatttctgtttgggtagacacggcataaattttaaattaaggtgtataaaataaaagatttctatatatttttttaaaattattattaggagaagtggtagtagtaacccacaccatgcattcaccagggagatttatactaccagtacatttattgctatcaagttgcaattaacaaacattcatgcagttggagaattgggtatgcaatgcgtcaaaagtgtgagaaaatgtactgtctcaacaggcgattcctagggctcttcctattcaatatgaacatgactttttaatgagagctagtattaatataagcttaatttaattttatatacttattccaagtttcttaaattattcatatcctctttctgtttagacgcatcagtattgtgaggtttaattgttagctcccaaagcctaaggactatctctatttaactcacttttcagctaagctagtgaaagctgtaaattatgatgatgatggggggaatgatgaagaggaggaggaagggaggggaggactgtaatctacttgagtatatataaagcactgtgatattgtacatcatagtatttaatccttgcaacatggcaccaagatctttttatccttattatgcagatgaggagactgggctccagggaagttaagtcacacacttgctaagtggtagacccaggactcaaaattagatctcttaatgcgcaagcctgtgtgctttccaccatacatcttgctctgatactattcaattattaaacatttttattgatcaccgctacatactaggcttgatgacagacagtgtaggaaccaccattaaactccaaactagaacgtgaagacccacctcaccccaccttcagcctcacctccagtttgcattccaacaacattttatttcttgtggccatgaaatgagaaaagaaatatttttgccaaaccatcacatgactcagagaaattctcagctggccattgacttgcaatggagcaataaatttccattttcctttgcaaaggcccacctaagctccatgtttctgtccccctctgctttccttagccattgcattccccagcacttgttcgtgttttcacactaacgttcacaggtggccttttcttttttctgctgtgccagagtgcaaacagctaaactttctttctgatgactaagtgaaggaaatatttcctggtggatatttcctaactgaactgcttgacaaaaatggggagggagtcagatcctgccagaatatttctcttttactcttggttctgctttgacagtttggaggattaagggacaacaatgacagtagttcttgttattagccatgtcttaccgtgtctttctcaccattcacagtgtccctgttggaataaatgctgatgactacatctgttgtgttatttaaagtagatctttaagtcaaaatgaggatgtgtgcgcactgcctcattttgagtttgcttaatgtttccagccatattttagaaataaatcccaaatgcttttttgctaagtgcattttcctttcgattttaaacctatgtgtattttaaaggtcatttaatctgtgcatttccaattcctccagtcttaaatcatcactgtgttattttatgtaagaggtacttaatgtctcaagaagcttttggaggcctttaaaacccaaagacttttcttttccaagaccagaagttccattttgtgaagagtaaacaagcctgaagaagaccgaaatctcagcccgttcaatagtccaaaagttcaagtttcagaggggttggaatttggcgaaatgaattttcccatccatagctcaatcctctatattccctcctagcttaggctgaaacacatggaaattatatccagcaggcactcttctcagtgacatctgcatctgtaggggtgtcctggcattcagcaacaaaatcctcttcccccagggaaaaggaagactcaaaaccccaaataataataatctattacagatttcaggttaccaaaagttaaagaaatggataaaagcaaaacacttagcattgctacatgtcaaaaggaaggctactgtaatcaccccccacccttgaggcatgtatttttcaggttattatgcataattatgcatacaaatttaaatatatttccatattatattcaaaactgcccaattcttaaaaaatgtaggataaaacaaaattaattgatggcaattactgcatttagatttaaatctaaaattcctggttactggaagaattgggccagtagtgggcacctcgaacaacagaactgtctcttctggaacattcttctggatttaggaacagtgtttctctaaaattaaatgtgagattagagaggcataaagaggtgctgacagaaaaccagaaatggtgattaagaaatttggattgaacctttatttcttactacgtggccttaaccaaatgatttaaacaatttgggcgtctttttcttcatctgaaaagctaggcgcattcactccatgctctctcaagttccctccagatttaatatttcatgtttctgagactccaacatgaactgtgcccaagaatggggttatctgacggtcaacaacagaaaaaagcttggcaatttgattacaattaactcatttaggaaagaagtaaaatatttgggataacactggagttttggcagtaagtaaatctcccatcacaatttttaaatggaaggaagagttaatccaaaagggtggctggaagcagaaagtagttccatttgtcacacacatggtgaccaccatcaccatacagcacccagagggatttcaaaatggacaacacataaaacaacctatatccagaccacatcaagtgtcagaatgatgtggatctttgtggggcttttcctagttttctctccttctttagaaatgtatgttatgaattatgattattgcaatagagccaagtattcaccgggctccagctagatctttgtttagtgagcataagctccctgccagctgcaaactgcagctgtctgtcagcatttgtgaggacaaaccaccccactatccctgatcacttagccgtagacgacatactgtgtcctcagatctgctcagagcaccccttgcatttttcaatacacttcctgtgggggagggcatcagtgcttcgcacgcacattttggagcaaatagcttaaatcttatgtcaaaatgatgcttttaatagagggttctgtcccaacaaaactattctgtgagagactcactgactctggcctgacatttccggatattcgatgtcctgaaaaaggcaagggaggctaccactctgacaaccaactgttcctcaagacacagtgggccctacagagggtgccaagagcatgggccccaggccaggaacctgtcttacagctggggaatgtgggggtaagaaggccatggcaaaggggtgaagccagaggaagggcatagcccagggtgcccagagcagccatcctcctgggccatagcttacagccagagacaagacccaaaggaatccttatttcaggagaaatcgttgtctagaacattcaagtaaacttggaactctgcagttttagaggggctttgagggatgatacatttttcttgactctcatttgccagcctcctatgcaatttattttcctttaaattgcaaggcatgctcagaatgggagagaaactggcagcaccacaccagatttaattaaagcattgttggagttaaccaagagtctcccctgtttttatcaaaagtgactcatgtgggtgagaaaaatcatttttagaggggtgccaatttcaggaataccctgagaattaccctcggaatttaggaatactctgctttttccaggcacttgtatacagtaaacttggggtttcttaaaggataaaaactattgctgaagtttctttgggctctggggtacttctgaaacactccaagaagcctgagctatggtcccctagtacttgtggaaaagacttctttgaaacatgtttaataataatattttcaagtaaaaaaaataaatctggaattcttcctactcatgggggtattgtgagaatgctctttgttatgtaagagtactgtttcagtaagaactgtgtccccttgggaagaaaggcacaatgcaaattcaaattaataataaaactgtacaatatgtagcatatgcccaaagttggcttaagtcacataatgaagaaaacattctaaggtttgggaaaagactcagccctatgcatatgtgtgtgtggagctgtatgtgtttatgggcaggagagcactgacccaacataaacactttctttcccacaacttaaacatatacacaatacttaaaatagtttctttcaggagtagaaaccatgagagtcacagggtcattaaacaatagcaaagctctgttagtccatgatctttccttattcaagaggattataaaataaaaacaaagattctgcaaggaatcaatattttgcaaacacatagcaatttacagtacaagagtatttggattgctaagtaccttcacttctgtgttgctgtttgctgcttcattgtgaaacctttttgctggatgtgttacatgcgatgagcttgggtgttataataaacagagaggaaggctgcaataatgtatttcagttaggaagaagcacttgaaagaaattgcttttgctatacacatgatgtgagccaatcaatagtggtttagtctgacaagccctgtcaatatccattgtcacagttcagaaagtcgttaatggatagttcttcaaaacccaatgattttaacacatgttcaaagtcttgaaatacactctacctggcagaaattaatcacaggtaactcttgggaaagtatacaagcatttttttaatgagagccaaatcatttacacacacacacacatgctcgcacacacacacacacactcgcgcacacacacacacatatacagcagctaagggtctaatctaataacaacagatgcatagtgaatgctcagtaaatgttgaaaaagtgagagacactgggatggaggctgagaagggtcctttttatacacctgttctgtaaatttaatgattattacagtggtgatgatgatgcaggatgcctatcatattttaattattaatcatattttaatcattaatattaatctattaagattaataattgcttctgttaactacatatgtattatacattagacattgagctggatgtttttcctatatcagaacatttaacatacacaaaaatccttggcatggatattattatccccatctaacagatgatacaatacaggcacaaaaaactggcatagcttgaataagatacaacgttaagtgacagagttggaattcaaaatccaaagcctatattattcaaaaaagaaagaatgggtaggagagaaaggaacacacttgaaaaaaaggaagaaagaaagaaaaaagaaagaaatggcattagcaattggaaggaagcatatcaatggttcttatctgcttttccccaagtcctgatcctgaactcttacactcagttcctgtgaagcaaccaggaacaaaacaagcctctgagctctggggttgggcatagagaagaatgggatttcccagtttggctgaaagaagaactaaggagtttgcagaagtaaatgtattcacttacactgttgtgggctaagtgtgtgtctgaaaaagattgtgtgagggcaggggtaaaactgaaagacacagctaggttgctagccatttttgcctgaaaggaacccccaattcccacctacatctctccttctgtgttcattgttgtcttgctgcatagagcaatctggagcatggtgagtgatttgtcttctgcccagtatgcatccttgcagcagaactcaattcatgtccatggtggttacagttctgtcctacccagatgtattcttcaactgttcttattggcaatccagagagtattcagccaccagctccactgttgtcccatgattcactcatcttacctaagatgactctttttctctctcagccgtacaatgatacacaccacatggatagtttcagtaatcagttcatggtaaagcagatgatttaagaccttaggttgcaagtacttgagtatggtgaggcaagggggtgggggacattaccatctctctatgtccttagacacggtgacagcattgccacacagatggacaggcagggccttagggcagggaatcagacaccacctgagttgtggttctgccactgatttgctacttggcttaacttctctgaacctcagatttctaatctgtaaaatggataataatggaacctaccatattgataaggattaaatgagatcaatgtgcttagtaaattccttattatatagcaaataacttcaaaatattagtcattattataaatatgacattagaataatccgattgtctagcaaaagtggaaattaagactattttagaagaattatgtataacttataatctaagaaacattttcccacttcttaactattgattatttggctttaagacatttctcaaactatctgcacatgtcatgtatgtttttctgtcctggctgaaaattttgtttggaaaattaaggatacattatagcatattctttactaaagatacattgtaacacacagtccaggaatttagagatttaaagaagaagcctcaaaattactatatgttactcccctctatacctgctgagaatgtatctttacaggcatttttacaaatgtgcaaacaaatacgtacatatgatatacagtggtagctctcactatgtatgtatacatggaaagagtatttaaatgccactcaactgaaatactgctaatgatggttcagaatctgagtccatacatcagtactgaaatatccaatattcttatatatgcatgtgttttattctccaacttgacttacttttttgcggaaatctaagtgttaatttcgtagaaggcagaggctatcacctctctggtggaattaccacgcctacaactctttttggggttttttttttttctcttttatggactgatgttcacatttatatttaaggctcttctcatttgatttggctgtggcctgttttctatcactagaagagaacccattcctgtatttaatatacaatctttcctcatggaaaacatatttctgcttcacagtgccctttgtgtggattgatgccctatgatattttcttcttttttttagtaattcagctttcaatatcagctactgccttagctcaataaccacttactttattagcaaatttatcaaagttttgaacagctctcaagtgacaaagttttactgacactatatcaagtcataagaagcccagttaaaatatataatcaatagaagaatgtctaaatgatctgaatctttacattttacactgtatctcattttgttttaaggaaaaaaaaaatgtcattgtgtttctctacatacaagataggttttgctgtttaggtatattttccctctttttattgtttttctgaaaatgtagtattttcataacctgtgacgcaaaaaaaaaaagtcattaaactctggcttataaaaggaaaccagataaatctatagtggaagggaaattaaacattgtgatggtatacttaatatttgcagtatgggattgaagttatcaatcatcattattaccattaaaagtactcactatgaaacccaaagctatgctaagtgctataacaaaaagagtttaaacaaaacaccctgccttacactatagaaatacattatcaatgtagatacacctaagatgtattacgagcaaaataaaaatactaagtctatacatgaaaagacagtgaagaatttacatcatagacaaatgcattagaagtagaagacatggatacataaattcctgagaaaagtagccatgaaattttcctatggctgaattgacagtagacgccagctgttcactgatatcaaaaatgcaaaaatgtggttagatttaactacttaaagttgataatgcagtctaaaagtaaacattttaattgtatgaattttcacttctccttaaatgggtagatagcatgaatattaatcatggaatagatgatgagtacacacccttctgttatgaatctaattgtctattttgtatttccacaatgtctaagtgggaattaagtggttaaaactgagcactgcagttaaagtgcccagcattccctctttcaattatttccagatttaatcatgatttgtgttttgagcaagtcacttaaagtttcaataacttagtttttcaggctgcaagttggggtttgaaattatgacttctatttacactgagcaagtgaaaaaaagagatattaaatgaccaacagtacattaagcccaaacttaccctttctgcccactctgacatagggagttatgtgcaaagttctgggagctctgaaaccacaggcgggggaaggcaaagcagtatttattacagccccatgaattagcacaagcgtgaatgccctggaaaggaataaacaggaggctggaaagaaatgtaataaacttgatttctttttttcaatcaatttgggataaggtgctcttatttatgtaatttggaaagtagttaagcagggtaattccaatacaagaagtttgtgttggaaaatgtgagtggagataattcagtactttgttatgtaatccctatgatggtgtgagaagagttttggaacctctggggattaagagcctgacaaaaccttattttgtcttttttttttctttgatttcctgctctgaatactgcagagtggtaagatgatggcactaaagctactgttgccagctttgcccttgatgtccttttggaattgaattgaaatgtttagagctcctagctgctaacaaaactatctacctacactgatgttgatctcaatgtcaaacctcaccgataaagtgagaacaagtagtgtagaaagctgtgtgtaatagcttttctgaagtataatgactccactttcctttagcaacatttctgaaatgttggctgtcccagcacttccaaatttcaaaaaaaaaataataacaacatgtaattgtaacatgggaataccgcgagaacagcagtttggcaggaaaagaaggtatttcaaaataaggtccccagaaagagatgttctggcagatgcacaattttggatcatattatccaaaccgttgaattctggaagatttgggggttttcttttttggttcccataccctaaatgggagtagatattcgtcgtccatccagagggcattgtttccccttcctgttactaaagtgagaaaataagtatactaagggcacccatttacagtaagcattcgtagctctagaggtgatttttaatagcacaatagctgtgtcaggtataacacttgtgttgggctaatgcctattctcatatgtaatactattaactgaagatcatcttagaaagcccactatcctaacatcttagaaagcccagaattctaactcccctctggtgagagcagttttagcaccaattaagtctctcaactggttaagaatggtatttaaagctaatgcctttggcctgtgtgttgagatttgaattgcctattgttattgaaaattctcagtctttgaaaagcattctatttgttcaggcttgacagaaaagatctccaatgggaaaagcagaggaaaacataaaggaaatataagtaaattctagaatacctggaaagctagtacatttcaggttaaggttaatgtttatggaggtaaaaatacctaggattaagagtgattgctctagtctcttatgcaaatcagattaaatatttcagagtttaaacccatatctcttttggctctatttattttcaaataaaaactcaaagtgggaatggaaaaaaaaaactactcgttggcttaacataaatctttaaactgcaggaagcttcaccctcaaaaagtagttgaatctctgagggaaaagaaaaggctgaattctatttttcataaatgatggattattgtaccacactgtgtattttccagtaaagtgtccttttatttgcactgtgtgattacaagtttctaaaagtatgtgtggggtcacttgggtgctgtgggaaaatggaaggaacactgttctgttaaaatcagtagtgaaatcagaagcaaactatgtcccgattatcacaggcatgtgtttaaattttgctttccttaattggttatgttgtatttacttaaaatgaacaatttggcaagtttttctcccttgacaacagaaaagcgtaaactgttttataagtttggctgttaaaatcagatttgtaaaccacgatattcaaagacttttacggctgtttacagggtcccagtgatggaccttgctttatatccacgcacttcttaacatttttattttgtatttatagtgctttcaagttatttggttaataaaaagtatgctatatattatagtcatctattgacttcaacctctacataactcttcttagaacaaaatgagtggaatgaatgatggcacaggccttgtaatttgacttgtcatctgaggacaattatttacggcatcaggaaatggaagttgacgttctagtctgtctccaggaaagtaatcattagagccaactttggagagtttggctacgttaaaaactgtctaatcatgtccaagactctgctagtttctcagtatgtatgagaaggaaacaagataaagcatttaaaaacatattttcattttctttgaaaaaccaatgcaccttacacgcatttctcacatgtggagccagatggtggtattgaagacaatatgatatacatatatatctctctaattaagaatactatcaccagaatacctaggggagtttcaaaaagatataactcataccgtaattattttcataatctagcatttatacgtcatgtgtgtatattttaatttgcaaagtactttctaatggcatcgtttttactagttccaaatggaagaaaaaaaatataccgtgcttggccctgcatttcttggtattctatcatgggaaatggcaaggtttttgaggtgagaccagaaatcgaaaatattacttttgtaacctgtgaaaacttagattgattattctgtgtcattccaaagatggacttgaaaccaaaattgccctgaggcagagttattctgaaggatgttaagtgtttcttcagtctccaacactagaatacagacctatgggactttgactacagctgtcagttgaagcagatcatacatgactggtggtcactgcgatgactggacctagaaggaaagttgttaggatagcacataaacacactttgttaagatgctcagaatgactcttccaactatacaattttgaatttgttaatggctgatattcaaggtcttgtaaaagcaatttttgtttgcttgggttctcagggcacttgatatttctccaaaatgacctgaggtcaatccctcctcttagatcctttaatctcttacatttccatttgactccttactgtgctgcattataattacacaggccagacaggcggccatggtggctcagacctgtaattccagcactttgggaggatgaggcaggaggatcacttgaggccaggagttcaagaccatcctggccaacctggtgaaatcccacctctattaaaaatacaaaaattaggccaggcgtggtagctcacacctgtaatcccagcactttgggaggctgggggtggggtggatcacttgaggtcagaagttcaagaccagcctggccaacatagtaaaaccccatctctactaaaaccacaaaaattagctaggcatggtggtgttcacctgtactcccagctactcaggaggctgaggcatgagaattgcttgaacccaggtggcaatggttgcagtgagccgagatcgcaccactgcactccagcgtgggcaacagagagagactccatctcaaaaaaaaaaaaaaaaattagccaggcttagtggcacatgcctgtaatcccagctactcgggaggctgaggcacgagaatcacttcaatttgggaagtggaagttgcagtgagctgagattgtgccattgcaacccagcctaagtgacagggtaatgattatctcaaaaataaatgaataaataataaaaataaaaataaataattacacaggccatatacatgttatccacaacaattaaacccagcactgccatgtatatagtaggtggtcaatttgtgtttattttttattatcttccagcactgtccaacatgaaacatatgtataatgtaaaatcttctggtagccacattttaaaaagcaaaaagaaacaatttaaataataagatattttatttagcagaaaatatccaaaaattatcatttcaacatatggctcaaactgcatgtcaagtgttcaatagccccaagtgactagtggctagtacattggatagcacaagtctaaagcagtgcttttcaaactattgagatacacagagacaatcatacttgtataacacactggtggaaactgctcatagccaaagaatatacagtacaactgccacaaggactcaggctgtcttggtcttgcctaaattaccctaagagctgaggacatctgttaactctcagacctatagtacccattttttaaagtttactttaatttaaaaaaaaatttttaatttccgggatacatgtgcagagtgtacaggtttgttacataggtatacatgtgccatggtggtttgctgcaactatcaacccgtcatctaggtttcaagccccacatgcattaggtatttgtcctaatgctctccctccccttgcccccaccccttgaaaggccctggtgtgtggtgttgtcctccctgtgtccattcttaagagccccatagctgggaagctgtctacctttctcacatgatagtcactgtacttttattatcaattcatttaaaaaatagatagctcatgacaaatatatagatagatggtagatatgtatgagattgtgtatatatacatacacacatatgctatagatatatagacatttatttttcttttcagagttcttttacattttctcaatgtatagatagaccttccaccgataaatgagaacttcagatggccctataatttttccaatcagtttaaggcaatgatcatcaacaggaagtaattctgtaccccaacctccaccctcatggacctatggcaaagtctggaggcatttttttttattgtcataattaaggagggcgtgctgctggcatattgtgggtacacaccacggatgctgttccatatcctacacagaggacaggcctctacaacaaagaattgtctaccctaatatgtcaatagtacaaaatttgggaagcaatactttaaagtaatataaagtattacagattttcaggtagcaagaattgtctcaatttagtaatttacagtacctagtcctatgtgataatccaaactttaattgaaaaataaaattccacccttctcccagctaggagataagcaggatatttttctttttctgtcattctcagtcttgaacttcaccttaattccccattttgctaattcaagtttgagcctgctttgtagtcaaaggcagggaaagcaggatgcaaaaattccctttctttgccagttatagagaggtttctcactccctggaccaggtagattttcaaaagcatatctatatttattaaaaagaatacctaataaagtatcccaaaccctctcattatgtcaacaattgaatgaaggcagtggagcgttcagttaagatatatatcttgtctacagacacaacaaattactatcagtaattaataataagacaccttgggccaggaacagtggctcacacctgtaatcctggcactttgggaggctgaggtgagcagatcacttgagcccaggagttcgagaccagcctgagcaatgaagtgagatcccatttctaccaaaaaaaaaaaaaaaactttagtcaggtgtagccagtagtcccagctacttgggaggctggggtgggaggatcatatgagcctgaagggttgaggctgcagtgagctatgatcacaccactacactccagcctgggtgacagagcaagactctgtctaaaaataagaggaggaggaggaagaagacatcttggatgtgtttagaccatgcttaatgaaaacccagacctcatgtattatattcatccccgaattcacagcctttagcatggagcctgattagtagacattcagcaaatatttgttcaggagtgaattttacacacacctgactttgaagataaatctgagaataggaaactgaggagaggggactaatgaagacatggaaaaagtttgaggcaaattatgtttctgaatttcacatagaactggtagtaattatacatcaataaggagagtaagaaatacctgcttcagaaaaataaatcacttcaggttaatatagaaaagaagattgacaagtttattcaagcaagcaggacctccagaaatgtctgcattagctagggatggtatataatcatatttaattgaaatcagcaatgctaaagagttgtctcctgtagtttagatgaatttttctttactctgaccacaattttgtgcataaatacatggaattatccatgtaaagattacgttaaatataaggaaatgaaagtgaaaataaattgtgaatatatggaactaatcccattctcattgtacattcatgctgcaacaacaggactaatactttcatgtgggcaaattttactcacatggcttgttgtagacagaagagcctgagctattaattcaggtagttgtttcataactactgttttctattcagatttgcataaagtaataatcataaaggagaaatttaccaaaagcctctgatttttttaaatcttcagtgttcagactgcatcacagtgcttccgatacaagcgacaaaaatcgagttaaaagcagattaaagaagtttattacccgaagaccttccctgaaaactctgcaagaaaaaggacttattaaaggtacaggtcattttatacttgtactataactgtgataaatgaatgtgcctctgtgttcatagctaatcagctctaaaggaatattagaatattttattcttcttaggttgcttattaaattttctactctgtaacagagaaaagaaaaataattgtccagaaaacagatcctgagaaaataaaggaggtatcatggggccattgaacaatatacctagttttgcccacagaggatctgtgttctgcactaggaacagagaaaggatatcctagtgtcctgctagaatgataccatgtcctcctgtgtctgggtggttccagttcacagctgggttttagtaagtatgaaccagcacacttaccaacccagcccttttcactatcagaaatgtccagatttggataaaaggttatctgatcatcctagtcatagtctgaagtaagtgctaggaagaaagtctaagacaaactagtgtcatgaaaatgtatggatattgagagctggcagtctaaaaactcaatccaaactgaaataactaggtagttttacaaatatatgtagagggcagaatagatgattgtaagaatagatgatggccaccaatcatggtctctggcattagactaattagatcaccagtcactcattttgacattgatcaagttatgatcttctctgtgcctcagctttctcatttgttaaatggggatacttatatacatcattgaaaggaataaatgacatagcctatgtaaagcattcaacagagtttctggaacaaaagtaaatattctatgaatgcccactgcttattaatataattattcattgttgttatcactgttagtgtgtcaaatgaaaggatgaatggatagatagaaccagtgattagtatatttctataactggaaattatcttacagaatatacagactaaattgattctttttaaaaacaagaaaacatgaagttcattattctctgtatttttcaaattttctagcttatgtgtacattttgaaaattaaatgtaagaaagaatttgaaattgggcgaaaagaaactcctaaccctcagaagaaagctgaaaggctaaactttatagaaatcgagaggtgatttaataagcaatcatttctcatgaagagggcaaagcagatcctaatttcagcattacttaaaaagattagcatttaaataatttataacaactgttcaatctatcagtttccgtccattttgaaacaggtgaacagatctgaaaaattagctagcactttgaaccaattgtagaaggtgaaatttcatgaagcaaaagcatacacattactaatagaatagaaaattcttaggatttaagggtaaaacgaggaccttgctttaaatcagagttgcctcagacttttactctccgatgcataatacttttctgagttgtagacagtaattgaccctctacagattcaacttcactaagtagtattactagtaccttcagttctgccttagaattcatcctatagatgatcattttcttggaaaagattcagttgcaggttaactgccatcttgaaaaatataaaaccagctaagcaaccaacaatcctaactttacataatgtccgagtttttcacgactgggacaaaataaaaggggttttaattcagtggcagggtctggctccacatgaaatgctgaaggattaattactacagtgctctagaattggtctcagaaagcattaggaaagctggatgcctaatgcagttttcataccgaagcaatggaaccgctaaacacactctgattcatgcatttcttatcttagagctccattaaattttcaccataactgaccaatgagtcagtattcattagtagggctatggaaaatctatgtaaaattctgatttgataagcttccattgttgtcttcagtagaatttttttccacgtacagatcaagttatgcaaatgtagtcacttcttgggcttgtttcagttttagctatgaactttttttaaggcttttactaagtttttgggtttttttttcccaactcggtaaaaggcattaaaccaatttttaaaaatacctggctagtcacacttagtactttaatccatttttttcttacacttaaagcaaagacttagaaaaacaataaaatcagtatttttaatcagttaagaaaaattgcatacaattaatgattaatggttaaatggttagtttttgcaagcaaaatgacttaactctttcaaagggaagaattatttagaaagaggaataatggctttagaattgttctgcagctcacttggccagataatctatatcatactttataaactgtctaatcttccagatcggcacaaaaggcctctattaccaaggttcaggaaagctgtgcttggcagtttgggccttaacaattgtgcttcctgaaacctgggagggattctgcagcgacatgtcagttttctttttctttttgtttttgtttttgtttttgttttgtgatggagtctcgctctgtcgcccaggctggagtgcagtggcgcaatctcggctcactgcaagctctgcctcctgggttcacgccattctcctgcctcagcctcccgagtagctgggactacaggtgcccgccaccacgcccggctaatattttgtatttttagtagagatggggtttcaccgtgttagccaggatggtctcaatctcctgacctcgtgatccacccgcctcagcctcccaaagtgacgggattacaggcatgagccaccacgcccggccggccatgtcaattttcaaagtgtttattctttcacgtaattcaccagtaggttgaggaggctgggctttgaattcaaccagcctttattgagcaccacgatgggggcaggaagggctaatattttattgaccctataacgcccatcagagtcacgtccacaaagcacttaatgtgaaaagagatttaccccaatatcacacaatctaaactcaatcacaagccctttcttcaaaacctgttttatatgtggtttcattagctagaacctagacttggaaacagtcccttgatggtgctgtattttcttatttatttatttatttgtttgtttatttttttgagacagaggctcactctgtcgcccaggctggagtgcagtggcatgatcttagctcactgcaacctctgtgtcccaggttctagtgattctcatgcttcagctcctgagtagctgggattacaggcatgcaccaccatgccccactgtttttttgtttgtttgttttttagtagagatggggttttgccatgttggccaggctggtcttgaactcctggcctcaaatgatctgcctgccttggcctcccaaagcgctggaattacaggcatgagcaaccgcacctggcccatattttctaatttctttaatatgactaaagagaagtacatattaagatatcaaataaagtgggccagaaaaaaattctgaatgattgctcaatgaaaagaaatcttaatagctcaggtgggtgtagcaaacattgtaccattgcagtggtagctttggaaaagttctccaagggcattcaagtttgccaaggaatggtgagccctttttaaatatatgagtttattaacattgagcatctcattgggaacaaaacttgaatccgtttaacatataaattataggcaaaagcgtccatttttgggtggtaggagtgtttataaatctccttggcctgcttttggaactgaagtaacagctctttagttttagccagactgccttatgtaatctttcaaataacagtattgacatccaagtttaggtaatacagtttttagagaagataaccattgtttggctttttaggagcaattagtatgcccttatgtcaaaataatagcatcagagaggatttagaaatgtttagtgtttagaaagtagtttcattcatcctaataaggacaaaaccatactggatggcattagtagaaactgaaattagtatcatattacttatttttgaatcagtatattataaaacctgcttgaagaataaatagcacacctcagggatttatgataaggagaagtgctttctagcctcatcttagttttgctccctaaaaggtaccactttgaacagtttctatttatagttctggtgatttggtccatacctacatccttcttatttagggtaaaagctggtttgtttttttgtcaatgtccttcttatcttcagtgttgtaatatcttactttatcagtcttagacagtactttaggtttctactgcaataggcgtgaattttactcaactacaccaagcctcatcttagctttttttattattattatttttattttttggagatggattctcactctgtcacccaggctggagtgctgtggcatgatctcagctcactgcaactcctgcctcccaggttcaagcaattctcctgcctcagcttcctgagtagctgggactataggtgcacaccaccacatccggctaattttttgtattttagtagagatggggtttcaccatgttgcccagcctggtcttgaactcctgagctaaggcgatctgcccgctttggcctcccaaagtgctaggattataggtgtgagccaccgcgcctggccctgcttggttcttctcctcgccagatacttacagtcaaatacagctcatcccacagtctccattagctttctccacaacttgcaagatgcctacatctctacttaagttttgttaaccctagaaaattgagcgctaagcctccattggtaagatgaagaatttacagccaccttctcctctcatctcctctgcctcttctcttctacttctatgtcatacaaacttattttactttacttgtttttataagtatggcttatttataggtaaattttaaaagttaaaaaaaacatggctgagcatggttggctcatgcctgtagtccaaacattttgggaggccaaaggaaaaggactgcctgaggtcagggttcaagatgagcctgggcacgataaagagaccctgtctctctacaaaaagtgaaaaaaagttagccaggcgtggtgatgcatgtctacagtcccagctacacaggagactgagatggaaggattgcttgagcccaagaagtcaaggctgcagtgagctatgatcacatcactgcactccagcctgggtgacagagtgagactccctttcttaaaaatcaatcatccgggcgtggtggctcacgcctgtaatcccagcactttgggaggcagaggcgggcagatcacgaggtcaggagatcaagaccatcctggctaccatagtggaaccccgtctcttctaaaaaatacaaaaaaattagccagccgtggtggcgggcacctgtagtcccagctactcgggaggctgaagcacgagaatggcgtgaacccctgaggcggagcttgcagtgagccgagaatacgccactgcactccagcctgggcgacagagcgagactctgtctcaaaaaaaaacaaaaaaaaccatcaattaatcaatctatcaacattcatactattatgcttacataagattgtttactgtagcaccacatagacttcctttcctgtacttataatatcacaactcccgtgactctcaaagggtaaggcccctgattattgtggaaaaactctccttttacatttgagggatatattaacagttttatgctgtttcacgttacctccatggctttttcatattttggactaaatggtgaaaaaaacaataatcagctttattttagtcatgtaaatactatcaaatctttggccaagttatatgccagattggttgaacatatccatgggtggcatgctgtgaattatgggccactccagttatactgttcttgctttcaaaccttatgctctatcatttgcttataatcacgcttttagtctgattcatttttccattttgaatttcctgcacagtgttcttcccctacccagagtttcatttttttcttgcattctgggcccttatgtcattatgtgctttcattctctcaaactgtctgtgtattctagtctgccactccttgcttttttccccctgagtatcttcttctaaagtcctttcagcctctttctccaatttgcactggttgctctccagctgattgccctgtgatctccttccactgctcctctgtgttggatccactgtcttcggcatcccatgccttcccttctattactctttaacagtttccatgaacccatttggaaagcatgagtcctcaacggtctaaaaaataccttcagtatgcccacacactcgatcagtagcttagttgggtataaaattccattgcctgtccaacactgagttgcagattccgctcttaaaattgttttgcttgtaccattgttactttgaatttctctctctcagaatcattggggggttttggtctttattttgagattctggaatcaagataatgtatatagtggacaggatttttaaattttattctgcttggcccttaattttaagaattatgattctttcttcagtgctggattttttatatttttgttattacattgatacattcctcccacctgttttctctgtttcctattctgaggtcttttttatgtgatcattagatcatctgaattgatggtttcattcagtgttatcttttctcaaattttgaaagaattctcagttttgttccccaatatttatattattttaactttagcaatcatgttttcaattttctagatttgtttcccattcttctttttttgcacatctcatttctcacataccatgaaaacaaaaactgtgttgaccactctactcctatacaatagtgaggatggcacatagaactcaataaatattcggtaattgaataaataggaaaagtagatattttttaaaagctatctgaggacatagattagaatttgttgttgttttggagtcttgtttttattttttattttaaattgttctcttctggtctttaaatgatcaatttcatctatggtccttttctttcctttatttgattcattctatttctatcaaattagtgactttgcccaaatgtctgatgggcaatagttgtccactcttattaaagaatgagtctctgtagagaatgactagagctctgaaaacatgggtagacctggccaatgatatggttttgccttagggtggtctgctggtgcatcccacactaatcccatacctcaaatatcatatattttcaaaggatacagaatgctttatattctcttgataaactgaatcaatcttactgctgatagtcaatttttcagctccattttacaattaagaaaaatgaggagaaaatatctcagattatttgaaagtatagcagctttgaaatttgaccaagccaggcttgaagccagattctttgatttaccagctattaacttaatatctggttattgactttcttctttatgaaatttacattgaaagtttaaatgaaatgatatatgcgaaaatggtgctcagcttatcttggccatcccacaactgttttctccctttcttttttgtttcttcctttcttctttccttcatttcatcttgcctttcttatttttatctttctttcctttctcccttttcctcttctttatttaggtgcacagagtaaattatgaccaagatggccctaggaaaccattctgttaagtatttgcttaaagctcgagaaatcattgaaggcaagcatctaggaaaggcagcagtaattcacttacttcaagaaacatacactgataacttgggcttggcttatatttctctttttggtaattttaatcatgatgctctttatacataaatgggcatgagctcatttttctaactacactcacttatatagtgtcatgcaactgctggaacatttaagtaattacccacacagacataactgattgtttaaggtgtctgccataaaagaaaataatgtctttgaaaaattatagttcttttaaaaatatgtcaattatgttgagaaacaaaaaaaagatttgtcattcaaactgcaaatacaagctatcagccctagacttaacagtcatgtttatgaatagcaacatcattgagttaagagaaaagtgttttttaaataatttgttagaactgatatatgacagagtaacataattgtcacactgttaatttaagcaaaatatatatgatcaacactgtaaaatagctttgggtagagacatgctccaactttgccactttatcagtgttagtctgagaataattatacttgaatttatatactagggcatgggtctatcattgcttgggtctgaaatactctgacaacttccacgatatgcactaatgtgcttaaaaatatcttgtaaatcttcttttttaaaaaacttctttatggttcaaaattgaactgtgatctttacgtgtgcgctgtgtcatgatttaatattagccaaaattaatagccaaccttaagcttctttatctcggcctacaagcttcctggttcctttgcatttatagttctcaggcagtttctgttatttaaaggctcttgggagcaaatgtgttggtaatacagtaccacatagttagcttttgttcaataataagatacaggacaccatgcgagatggagaaatgttgagaaaagggtgcacctgggtagcaggttaagcccatgtattttaaaagcctgttgtgcacacaggaaacaatccaggtcttgtgagatattaaaagcagaatagctttggagcaaactagagaaaatgaggttcagaaatgggagcaaattaggtaaggggaaaaagaatgagccagaatgataaattggtttccctgtggttcaagaatttattttcttatggggacagatctttttatacagatgttagtgagaatgtaatatttgagattgtgacttacatacacttgatttttttaacctacaaaatggttttaccagtaaatttctggtatgtaactcactatactttatgtgttagcaaacaacaatgataatcattctccttttagttcctttaaattacatttctttcacattaaatcaagtcctcaagatgtttcccttttctcaagtaaaagaaatgccagataataccaggcttcagccatgaaactgacccaatgcctagtaatagctatgcttaatgctgggaatgtaaaatgaataaaacccagttgattcagccagcatattggcattttgtttttagccaatgacccctaaaacccatactaaattttgccctggcaatagatgctggttttattcattctgtggactatgtatccttaaaagattgcccagaattctggcatgccctatagggttacatgaatctggtgccagtttgaaatattgtatttgagccttccagtttgaggactgacaagcttccacaaaataggaagaaatagatcatacacaccaaaaaggaagcagtaacaagtggaggcaggctttgtttcatcttatgactctatgccatgttttaagcatactctgtgctctaactcaaatcttgtgtgtgtgtgtctaaattgtaaaacagatacaaaacctccccttccacccccaacattgcaccaaagttgatgtgctctcgaaagcatatcctcaactagttggagacaaccaaaagtcaggctagggtggtagttcctccttgtgttagaagtctgctgcgctctggagagatggcccatggctgtttcagtcctctaatcacatcctaaatctttcctctgtgaaaccacctgatgagaagaaaaagatgcagggcccttgtcagtgttcaaaagaatcccctttttaaaggttagcatttattattgataccctgctgttctccagcaggtgttcttgtaccgcatagttccctcctgactcctaaagccagcttcacgagcagtggaagattcttcagcttagttcttgttagcttttcagggcctccatagacctacgaacagtatccaaagccagtgctggatgctgctttcgcctctgtcgttggtataattctactgctcacactaagtactagatggtgatttcattgtgtggcgaggtggataactgagggagaagaaagcagaatttcattctgacctggagattgattatttgagcaaatgtgtgaatgaatgcttcttatatagtgagacaagttgaattttccatgctattcaaggaaggaggtctcactccttcctcacttatgatatgaatgggattttagagttcacatggtgtgtatgttgagtgtgtctctaaagatagtacatgtcagagctctcataactcagatatcctcattagggaccccattcagcagatgtgttagactgctacgagcaaaggaaatattaatatccacaattcattttgacatatcctaagattaagagagtgctcttttatttcctttagcatcactgacagtttggcctacaaatcttttttctccaaattcatgtctattataaatcaacaacatttcataaatttctaagattcaaaaaaaacttgcattattttatttcaggggcccaaattttgtccgatattaaaagcatctctctttggacttcttaccccacctgattagtgataacgaaaattaactgggcctctgtaaaactgagtcatcaggaaaaataactccatgttgtaaaagtgctattcctgcattttctattcttctctgtgggagggaggcaagaggccatatcagaatttggatagtcataattggtggtctgtcagtattagtgaaattgcaatagggagaggtatatctcccagcttttctttgaaattgactatattgctgtaagtgtgttttatcaaagcattttctggggcaacagatctgaaaacataaactttatgtagcattgctcctccttagatatttccctttaatatgtcttttctttttgaagataaaataaaagtacataaaagagttctgggaataggcagctatatgtcataaacaccattcactccccctcacccagagctcccaccccccaaaatttggaaacgatttgattgaagtgatgactgccttgatcttgtttgaatactccttcttcattgtcttcttctctcaatgggaggcaacaaccctgtcacagagacattcctgggagggaaagaggtatttctagcaaccatattttccaaacacaaaattgagacacatggcctgacaatgccataatatttgaagtagggactgtgctcaaagatccagaacatatggtggaaagagttttcttataaaaggcagccatttaagacactttctagattcttattcacaaaaggctcattcccccatcccttttattctcattaaaaaatattacccacagatcagaagactgaccagttttccctcaaatttgcttttttgccagcttgagaaccaccctattgactaaaaagttaaatgcacagccatccaggaagaaatgcaaaccagactgccaaacatattatgaatatattgctcttcttaaaaatgctagttggtttttcatactggagtattgactaactgtctgtgtttgatgtatggtttaccagcctgatgtcgacttatggttagagcttaacttgttagttctgcttttgcagccaattcagaataactacagatgcctcgagatattaaaattgactgctcaaatggactcagtgcgggagtttcattggttttaaattgataacagctgaaagagtgaatgattaaagtgtaaatgggcataggacacagctctttcatagaaacacttgtgaacagacttcagtagtgtgggagttttttctttctttttctattgtagttatttctaagcaaccttgagttaaattttaaaagtgctcaggaatattcaggagcctagaggagaaataattcctgagaaactgagataaattttgatgaagtgggtttctattctacagggaacatttaaagttaagtagcattccataaggtggtaattgtgtctatttcccaggcatttaagttaagtaagctgtgtaggaagtataaactgtcataatagaagggttagagtgttgtgtacatctctttcttcaactcataaaaaccaaagctccaaagtgccttatcacagataagtcaaagaaagcctctcctttgctttcttattctcctaagaacaattattattattttcattatttaaaaagatgttctgaatactttcttgtcgcatggagaaaaagaatacaaaagagaaataaaaaaacttttctccccctccttaaatcagcaatacttatataaaacaggctttatgaaaacttactttcaccatttaatagtagcttaaggaaaaggcacagtaaagagaataattaagtgaaatgtaaagaaatttatgaaaaagaaatatctgtttataatacagccctttttcaacttaatatctttctaagagttaggtgtgctcattatacaatattgtgacctagctcctttctgttttcaaatgtctcttagtattttatctttgatattccatcaggaaatatttatacattttttattttatatatttttatatatacttttttaatatttatatatgaagaactttatatagctaactgattaaaagcatcaatctacagtaacacattaaggcaggatttgttgacaaaatataagtccatatagtatgtactaatttcacatattcattttaaaaaaattgaatcattgtgcctagctagtatgtccccacatatgtagcaaatattcaccttatgttaattacaatttgtggaataagagatttagatatatttgacagtaacattagtgaatagtgatatgtatgttcagatgtaagaaaatcaaattatgaaggatgctctgactttaaaacaaaataagccacaaatatcctggtcaatgtttacaagaaaatgtgttatatatttatttactgctcaaattttccccaaaattataatgtatatacctggaccacatcttaaaattgcagactcaagttgccttcatgaagcatacagccgttgaatcatgcttttgttgtgatagacagcttatgcagatagccgtctaagaaactgctaccaaggttgacattttcacaagatataattcctttagatatgtagagcaaaagagagaaatttcattctctttcaacagttgttcagctccaattttgtaatgattttttaaaatctatccatatgagacaggagggagattttagaagagatgtcatccaaataaaacatatgtgagggtcattaacttgaatataacactcctaacatgtccctttgaacttggaactcagattcataggaggaaagaaaagatggagctgaaagaggcctggtctgggttaacctcacagtaaaggaatctttcacataacaagagactgagaaataagccgatggtataaaagtgatatcttgaggatatcttaatatggtgagattccgaatactctaaatttcagaaaaaccattgctcccttggactccctcataatttgtaccacctcatacattcattcattccctggacagtgaaatacgatgtttacatcttttgtgacttcacattttaaatgcattgaagcctttacaatgttacaatgagcatgttacaatgtttgcatcttaaaaaagtaattagcataggagaccatttgatattacataaagaatttgacaggacctcactcaatgccttttaagaaataatatcgaaagaggaagtgagagcctgttttagttataaatctgttcacataattaccagttgaagaagatatcataaacattttagaagagcgaggttagaccctcacttcattaaaaacagaattccaaatgatgtcagatacctccagttctctagcatccgtttcttatgttcatgtacacacttgcatgcatgcctttttagtcagaaagatcatgtatttgtagtacgagtaaataattttgaagaaaaataacattggttagaaatatactactaaacacatgaagagagacaaccagatctgcatgtgaggttaagttcaacttgagatgccacagtgatatggacaaagtattccaaaggtggctttgcagtataggaatataaatattccaaatgtgactacacagtgtagcagccgactggacttttccataggagaggtctctgcctaggtttctctactacagcatgaagaacaggatgggaagcagaagcttttgccagggagctgtggcctcaaaggtattgaccgggcaggatgtgaatagtgggtaaagttggcaccacagccttacttcatccaggacagaaggtagaaagtaaacagtccattggaaaatgtttggggacacaagacatgggatctgaggaattctaggaatggtagtaaaagactttgggtttggctgggtgcagtggctcacaccagtaatcccagcattttgggaggctgaggcgagtggatcatctgaggtcaggagttcaagatcagcctagccaacatgatgaaaccccatctccactaaaaatacaaaaattagctgagtgtggtggcaggtgcctataatcccagctactcgggaggctgaggcaggagaatcacttgagcctgggaggcagaggttgaagtgagccaagatcgcaccattgcactccagcctgggtgtcaagagtaaaactccctctcaaaaaaacaaaaacaaacaaacaaacaaacaagactttgggatcaagtcttagtggaaagcacttccctgtgataagccaaagccatctgttcctataatcagttattacagcatgaatactacccaaagcctagaggaagcttctgtgtgtggatcgttttgttgttgttgttgttgttttgttttgagatggagtttcactcttgtcacccaggctggagtgcaatggcacgatctttgctcactgcaacctccgtctcccaggttcaagcaattctcctgcctcagtctcctggatagctgggactataggcacccaccactatgcctggctaatttttgtatttttagtagagatggggtttcaccatgttggccaggctggtctcgaactcttgacctcaagtgatccacccacctcaacctccccaaatgctgggattacaggtgtgagccactgtgcccgcccctgtgtgtggattctttctggcctcccagatgcaactctctgagaagctgccatgaatgtgtatgttgagcttcagtttcatttactgaccaggaccatggacatcgatcagagatctgctagagagagtctgcgctaaccaacttggcataccatctgcatgctagtagtggtctaggaagactctgctggggaaagcgttagccttttggctcagccttttgcccccgttatgaccagcctagaatcctagacacaaagaacatctaagaaaatatgtagtgcgttcttgggagaaagagatactacagcacaataactgtattagttttatataatgtttgagtatgtaaagcacacttgaaataattaaaatacatgaagaaaatctttttctttttgtgcttgggtgtgtataatgggaagtcataagttgtagtgaaaggggcaaccaagactcttcctgtgctatttaaaagagctgtattttacttattcaggaaaacagagtattgcagaaccataaagattaccaaattttgaagtagacttggctctgctacttacttgttttgtgaatttgggcaagatgatgaaatgttctttcttcacactctccagctaatacttctcaggactggtaatgttttataaaaagcaagtagcgtagcaaacaatagctattgatggttatactctactcccagttctacttagtattgcgtaccagtccttcacctgactgcagagaacacattctgaaaattgcaaaacagataatatatgatgagattttttgtgacattgcattaaaatacagttagcattttgaacactctgtgtgcctagactgtgattataactttttcaggcattatccaatgatgaggatgaagagctatgcttgcatttctttatgctacaggtatgattgttattcctattgcctactgacatgtattctctgagccactgtattctgagaggatacaaagctacacaaagcaaggtccccaggaagtgagtaaggaagataaatgcacaaaaacaacggtgtaatatatcagatgtcaaatgctctaaggggtatttaggtcacaaatttggggaaattacacatggaaaagtgtgggaaagattaatgcttttatcattttatggtctttaaactgagccttgaattagagccttggacttttgtaaaaatgggtgagacatttgaggtacacaatcgtaggaaagtctggagaacagccttagatgaaatgtaaagagtttgatgagaagaagtgtctgtggcaagtgttttgcacaatcccaggcttaggagtttgtattctactttataggcaattttgttattcatttaatattttttatttgtttttatttattttgaaaacatgtattgaggacctagcatgtggcaagccataggctgggcactgggcctacaaagatgtataagttgtgattccatccttcaaaattagacattccagcctgcttggaaggaaatattctgcctcaagaaaatcacctccatacccccaaaacttggctccactagaagacacactagaaggctatattatgaaattggtacttgttatctactttgagttaattcctacgtaatcgcaatggccaaagcccctgcagctgtgggaatgaacagagtaacactgaccttacagcacaaatgtcccaagtcatggctccctcctgtgtaatcacaacacagcctttctctgcctcctcagctactcaagggagtccctgaagtgtgttgcacaatttgatgaattactgtcttttgccccattgtgttctcctctctcatttctttctcttttatacccttactacccacaagctgcctgaagaaggcaccttaccttggctgtgcagccagcactttctgagagttacctgcttccctgcctaggtactggccagggctcctgagcctgcaaaaccttccatgtgccagaatgtgctccatccctctggatcccactgaatttctagtccactttgtcttcaaaggaaacagaaaggctgttctcctccccaccctgcctgcatggtgcacctgattttttagggcctgaagcaacaactcttactcattgaatctcacaaggtgagagagtagcttctttccactgtgtctgaggctctttcctcaacagaaattacacctagtccctgggacttagccagagtacatgtgccatttgccatatctcaggagttcacaattctcctgactgtgttttaccaactaatatcagctcttgcaagtaagcatccatggtggcgaacatcattctgccaatacagtaggcagatccaactgagatactccattccttctctaagtcccctccctccataagaggtcccagtagctggaaacataactgtcaagcatgcaacaaacctggcaaatgagcaatatacaaagcagcatctcacaacatgatacctattcattcagtttggtgggcaactttgggacaggataaggtgttttggaaatgttgttgcattgtcactttctgcagtagaaactgaaaaatgagaaacacactgtgtttgactggaagcccaaaggagacaaaatgttttcagaaatgtgtgcatcatggcctactaatttgggctcataactactctccaattacattcctggaaatgtttttcaatttctttgcgtggaataactagcagaccacagtgctcagaacagcccatggggaatggcattcctgagtagaggttacatcacacctccatggaactagccagcccttctgcagaaccacatgattccctggctcttaatatggtttattaaaaaatcctttacctacctcaaagcacttttcatcaaagccacttttaagctgaagctgaggactaaagaatgcctttaacagaatcctgaaatagcttttaacctgaggctgagagagaaagtgcttttaacctaaagtgctttcctcttaggtgcttcagtgcatacctagcactcagcattagtggctttgagaacacccttaagacccaaatgaaagagactccattattgatattcaaacctgttatgttaatatattaaagtaatatttgaaatcattaagcagttttactccaactaaatttgagtcttttcttattgaactatgcattcatgcaaataaattgaagtcgtaccacctgggattctaacaaatctatgctgatattaggaaaagtacagtcttctttcctaggttttactttaatctagagtgagtcaaaatttctacactttccccacccaaaaagaatctttcaactcttctcaatcactgaatgacacttccagctttagtccatataagttgtgccttaaagataaatcatttagtatttttaattacctgaataaattctgtgtatcaaattttctcctcagacttgtcactcaaacaaatgcaattaataatttcacagtagttttaatccccctataaagttcctacttagtcaagtaagtgacaacctaattgataagttttaacttcagattaatagtaagttatataattgagcatgtgaatttcatggacagttttctattcaaagtatgtaaagaacatacaaatatgggagaaggtagcagaacttaacatttgaattgtattacccttcccttcctttgctggccctctctgtaattctaatgagatgatgacaggcaaatgaaaagcagaaaatatcatcaatccacaatgtacgtcaacagtcagctgaacaaaatttggtcatgttaattatttgaaatacatgaaagcaaacaatgaaaatatgtttccctcatactcaagtgctcatattacaatctttagatagaaatcggtttcttggactacaacccagtgagaaaatattagactaattagtctgtcctactgtggtctgttagaaaaaaatattgaaatattagggtattttccttaaaaaataaaaacattctttataagctgttttaatatcaaaggaaataattttcttttgtaaatttttctcatatttatcttttaatctattcatacattcatttatgcactcattaggcaaccagaaggcatgtaatataataaatgcaataaatataaatacaagtagaagaaactgcattcatcttttcctaccgtgtaaagttttgttgaccttgaatatcattttgtagcttcctctacttagtaaaattgtaatcatttttactcttccaactcagttaccagtgccacaaagctatccctttcttcttcattctcaattagtcctaccttctctttatccaaaagctgtaatttcattattttaatatctttcaactggattatgagctgtatctagtagaccagatactattttactgaactccgtacttccaggagttagaaagaaataaggaaatgaagctggacatgaaatcttgcagtggttttagagttattatttacagcttcttattacttcctattgaaactctcatgtcagtgagtgcccctttggtggatcctgctcttctccccatcttcagaatgttgggttacccctatgttaaggccttggacttcttttctcatttcattcttattctcagactattggacattaaacattcagagttgaaatataccattcatgcagcttcgaattccatctagaggttgatgctttccaaacttaaaacatcagtctcaaacttcagacttgcatattcaaatattgatttcatgtcttttggggtgcttggtacatatctcagatttatctagagtaatccttgattcttcagatcccatgtgtcctctatctcaggaaatatcactgccatgtgccacctgggatcacccccgctttctactctgtctcttccttcatcagtagatcccacctttaaaatatattctaaattcaaccacttttgattacttccattggattcattcttacccaagcaccatcatctcttcctatatttcactacccccctgatgagccttcctacttctcctcttaacccccttaaatctaggcttcacacggcaattagaaggatcatttataaatgtaaatcatatcatgtcacccccccctcctccataatctccatttacttagaagaaactcattcttaatatctaatgtgtgtccttcctgtgacctatagggtcctacctgctttgaccctgaggctacattttatgttttttcctcagccatacttcctcttgttcacaccactccagccactcaggccttcctgctcctcctctaaggaacctggcttacaccagcagctttatacacttgctgctccccttgtatgtacatggctcagtcggtcacttcatttggtgtctgctcagatgccattgcctgagatgccttccctggcaacaccaatagctctctgtctctctgccttgcttcattttttccatagcgcttatcaccatctgacattatatgttaatgtgttttcatgtttattttccccatttacatatagactctgtgaagacagagagtgttcttttcactactccatccccagtgggcattgaaaaatactcatagatggttagattcaatggataaatccaaaaatgcataaaggatttacttggtgaaacccttctctatgccgttgtgattctgtgtgctgacgtacatgtgtgtatgtgtgtgatgttgctttagataagcagagggtgggagagataggtacaaagtattgacaaagttcttgccttgagtagacaaatatagaagaatttcatgcgcacagtgtcccatttggttaataactctttaagatgcaaatttcttcctggctggtgtaatcaccaaaatgcctactgcactagtcagaccaaaattagattgacatctatttccaggtgagtttaggagctgaaaacgaggggccaaagggtacttcacagaagtactgtttagggttgagagtgaaactatgaaaactgaagacggccagaagcctgagaaacaaagagaaaaagtagaaagggctgggaagaacttttctcttctgtcagtcccatccctgaaactcatctttgggctgccttgatcaaagggtgctacccccgcagctaaatgtccagcttcatttgaaagctgcagcaactccgctatccttgttcggggagatcctcttcccccaggctagtctctccgtagcagatattgtcattatcaccagagactttagaatctgttaggtttgatgagatgcaaaaatataaataaacatgtgggggaaaactattcacagaagcgcatatatttggtaactcctatttatttagattccaaactacttagaagttaaagtaattaagctttttcttgtacttgcctcttatgaaaaaaaaaaaaaataagtaaacaaggcaatgagagaggtttacttccagtgcatgtcgtagattcagcagagaatcggcccaatttttgatatctatgtaacataaagcagcaaccgatatttctaatcaaagccccaaagcatcataagttaacgcagtacctcctgaagcacttacagtatattctgtcgtgttttagcattaggcgtattttttctgtgtcttaattcaaaaacataggccattccataacctatagcactaacagaagtcacccagttctccaaacattctcagtaaagttttgggaaagttacatgacatggggctcatgtcgtgagcattttaaaggaaaagaaaagatggtgggaacagaactggagaaaatataaaagatgagagtagaggctgggcatggtggtccacacctataattccagcaccttgggaggccgaggcaggcggatcacgagctcgggagctcgagaccatcctggccaaagtggtgaaaccccatctcaactaaaaatacaaaaattagctgggtgtgctggcgcatgcctgtaatcccagctactcaggaggccgaggcaggagaatcgcttgaaccagggagtcagaggtgtagtgagccgagattgtaccactgcactccagcctggcgacagagtaagactccctcttaaaaaaaaaaaaaaaaaaaaaaaaaaaaatagaaacaccatgctttgataagcaatctaaaagttttgggctgaaaaccaattctcaaaaggaaaaactaatgtaatttatagtttaaaatcaaaagatggaattattaaattgctgaaatcacccatgtttggaatacgattttgtcttccaatatccgctgcctctctattatagcaacttagtaggaaataatctgcccatatgtgtggcattgctgtgggagaaaaattctaagtgaatgctacctactatggaaactacgagggctgtattttctctccccacccattatttttataacataatcctgatcaatgaagcatcatctagagaaacttccagtctagagcgattgatgactggaagttattatgacaatgctgatgctggtggtggccatgaaatgagcaccctgacccagctaccagagttagaagacagtcgctttttctccttcttccaatttcatggctccgctaagcatcttcatttctgaatatctccaagactggtcccctagcctctcataaattcattgaattccttcctacttccacccctcaacatcattcaaataaactttccgttgcttaatacagccacagtgttgtgtttttccgttgcttgcagccagaaaccttaatcaatatacgtcattaccacgatagttggataattgtctgatttgtttttgtgactaagccatttgggctgccattattgttttctgcttcgctctgtgttccgcatgtgtgtgtccttctaggtgctttgttcttcctttttgaagtttactagaatcgctgcaatggccctctctcctgaaagcagagtcacatcattttgaaaagcctgtggagactgtctcctgcataaatgatgataaaaccgtcacattatttgaacatttaactgcctctattgagcagttgtcctcatagttttgattcatttggaatctgactgacagagatcccattactgggtgttctttccataatttgtcaaaaaacttatagcagtgatgagggagaatgaaactaatttgtaatctggaagacttaacctggttatgctgatgaactaacaaaatcggtcaaaaagtttgagagcttaaagattaaaaaccaccattctctagttaaacactaattcattatgtaaacaacatgatttataagggcagtcatgtggagggtctatttatttttctcaccaaaagatgctttcaaagaaaaattgcagaaaatgaattttttttcccaatcaatgtatatcctgccacccctgatcattaagtgctgaaacggtgggatgaagatagaatgatcacactggccaaggtcacaggagtttgcagaagattccaaaaatattggcacccctagcaagaggtgctttctaaataatatgcatatttttatggttgttaagtgaggaagaaaggattaccagtaagcacacagatgggaatataggtgggaagtcaggagctcagggttttggaagtgttcttttttgtttgtttgtttgtttgtttgtttttgaagaggagagtagaaataatccttaatgttgttccaggacaagagacatgagcatttaggggacaaagttcattaatgcttgcctggaaagcagaatgccttttctctccctccctttttttatactattttaagatagaagtttccatggctcaaatggatttctatcattgaattgtcctccttggtgtatgaaactctaggtgtattagatttacaaatggagagcaatcctaccacagcacttaaattcaacaatgacagtgtagttaaatctctgatttcctttctttggacagcactatttactttgcaaagccatgtgatgtgcattatcatctcttctcaattatttaattcattgtctgtcaagggctaatgttgtagtctacattctttccactgtaaatgacagaaacttgtccaaactgtaaaagtcagaatggaatttactagctacttaattgaagagtccaagggacagggatagcttcaggcatgactggatctaggagttcaaaatgctatcaaatatatttgtcttccatcactcagctctgttttccactcttccagaggtggcagcatagcgtctagaagatcagactcatatcttcatagtttaatatctctcataaaaagagggttcctctctcccagtaacatcagaaaaagtctcaggatttacttgacaggatccacttgggccacatgttcatgcctgaaccaattactgtggccaagaagataaaatgcatattcgtcactggagatggagagggtggagtcaacactacccaaaacaaatggcagcaaaatgagaaaggaccatccccaagggaatctcagggtgttcttgccagagaataggaggatagacacaggaccagcaaaaccaattgatatctaccatactcttcctagccagtgtcatctgtaagcagtggatcccattgagctattttgccagacctggtcctgttgtgactgtaatccctttcttgaaacgtttgtccaatgctacatccatatttttgccaggtgtatttgcttgcaataaacagaaatttactcaagagttctattaaaatgggtgggaggggatctcatggtatttatggagctcatgacatgggtatggcaagtgccatggcaaggatacagagtgcctggagtaggcactggaaagtcaggagctgagttggatctgttccatttgcctctccctgcaaactagttcctgtgtccgctcatctgcggcacataagcatcttcccaaattggctgtcccagcccccagggtttaagtgtaggcagcctagagttctcatccctagaaacaaccacctcagtctctcagtatccaaattctaaattttgtagaagaagcgttgctttgttcaagcttggggcacatggtgacctttgatgtaaccaagttcacctgagatactaggttcttgtactccagagccccaccttcttgggtgagtacagcaagtttcaagagaggctataagtgagaagaacagttttggctttgctggtaactggggaaagcaaacatctgccctctagctagtgaaattccagatgtctaggctctttactcaccaagacaccaatggcagtttttcccttgtgagggactggatgcacttgcctggaccaccagtaagtggcagtaatgtacctcccccacttccaacattataaccgctaaaaataatcagcagtgtacttcacccagctccgtggcaataaaaaataccctgtagctgaaattctctcctatccatcccaattcaaaatcctcttccaggtcttatctccacttataactaagtagtccccatatgctagccttttcacctctaaagttcttaaaataggagtctatttgctgtctctacttcttcaccttctcttcaagtcttaattacaactatctgcttttcagtttcactcctctactgaaaccatttttcttaaggtcactcatatcctgaaattgccaaaatccagcgaacatttttcatcttgatctctcataaccattctgctgcatttgaaatacttttccttaatgtctaaattccatttccattctcaagaccctcaagtaactgcatctctgtcttctccagtcaagcaaggaacttggcagtcacttttacctggtggatcagctcacctcctacacccacttgccaaacccgactgaatcactccttcttgccatgacaggtttattgtcttagttcgggtccccatcctccctcccccaagagcctaatgctctgtgacctttcacaaataactcaatatctctgggccttagttccctcttctgtaaaatgaagatgatgatagtatacacgctcaaaggattgcaggtgcatgtgagaattaaatgttagaatatataaagtactttgagccctgcttggcttagtgtagtgtacaataaaccctcactatttttttacacgtatctgcaatagcattagtcatattatgttgtagctgcttgtgacagttattctgtccacctaaactgtaggagatggtgcatcattacattttcaggctggcacacagtgtctggcttataacctgcatgaaatagttactgaatgaataaagcaatctttgcattatttacaatatggagcacatggtaggtgttcactaaatagtcactgaatggaattggatggaattgggttaatctggagagaatgcagaagaggtgccataaaatttggtaaggcataaataatttaaattttaaggtgaaagtaattttctttgagactcctcctgaggattgaaattaaactgaaggcataactccacattcttagcaaatttagaacttttttttctgttttgttcactctccagttttagtttccatgtcctgccaaccctctttgttttcattctcacagcatagcttagatcatatttcaccaaaaacctggactcatcaccacctatgtgagtaagctattgctacatgacaaacaaacataaaatctcagtggcatataacaccgagcatctatttctcatgtgtctgtggtgcaggcttgactgggccactctgctttaagctgcaggtctgactggacttgtctcttcactgagggttgccctcagttctgtgccatatgtatgtattctggagcccaggctgaaggggcagcagctccccagggaagctcttctttggcaatagcagagaaacaagaggatgagtagaaatctgcaatgcgtcttaaggcctcagtctggaactgacacatttccactcacatcattccaaagaagacatttggccgagcccaatatcaaagaaatgggggaaaataaacactgcacactctattgggtggtacgagatggttccatggcaaaggaggtgaatgtatacatctaattcagagaagacaagaaggattgtgcacagtgattacacctatcacacccttatcctgattctggtcttcgtaacatctttcctaggtaatcacatcagtcgtttaactaatctccttgtgcttcatcttccccactatattaacccccccaccctcccttttctttacaaagtgctaccaagtaaaccttctcaagtagagtatgattataatgatcactttactaaaaaaccacaatcacttcctaatgtcatgtcatatgcttttggctgcagataatagaatacctagttaaaaatgacttctttcatatgaaaataagtctagataaggtgttttagtgttggtttaaaagctcagaagtgtcatcagggtctcaagttttgttgcttatttttaatacattagctgctgttcttagcactcattgtctcatggtgacaagattgctgcaatagctccaagcatcacatcattgcaaaatgatattcaaagatggattaaaagaaaaagaaaaaagacttcttatatatccctttcctttcttcaggggaaacaaatcttttgctatatagtcctgagtcactttcctagacatttcattgaccagagctatctaatcacccaaagttgcagagcaggtaaaaatcaatagagatgattttcactttctgtcatatgagtggcttctaaaaacaagaaagaaggtgggagaggaattacttatatgtagaaaatcaatggtatctgcacactctcaaataatttaacttacctggcaagatttaagatgctttataacataacctccatctcttttataacttaatacatcaagatttctctaagagtgaatgtattcctcggcataccccagtcttcctatcattcttcccatcattcatgcatttgtttccttcctttcattcccgaaaatgctctttgttccctcttttacttgtctttccttatctttgaggattcagttattcagagaagggaagcactcaaggctgatctgttgccccaccacatgctcccacattgcctctgcgtttccccagttatagcagttttctcatgataaaatgttcttacctgtttacttatatactgcctctactgggcaaagatttagaaaatagggaatgagtcttggttgttatattaccagagcctttcctagctctaaatacagtatagccactcaagatgttcttttgcaaataactaaatgaataaaagagtaaattccctggaatgctgttgtctgtatcttctcatatccacctgtctaaaacaaaacaatttctccaaacacaaactctctctctcccaccctctgttgtacaaacatacacacactgcacaccacgtctacactaaatgacacaaaaagacctcatactaaaggacatttttcttagcattcagtaccttttatgacacctgctatattcttttttttgtatattctttgaatacttttattagccccctataatattacaaacttctcgatattgtttttacaactcaatatgcctacctcattgctgtgaagatagaagataatatttgtgaaattgatttgagtaataaaatccattaatgggttttttactttatagcaattcttcttcctgactgtaatctccagacaatgtaaatcatttgatctgatctactgggttattttttcctagataatattttatgtcattctttcttggagtggttacacagtgttttgaacaagtcattgttacttgaccaaagtattcaaagcaaatgcccattactatttcccacttctctatactatgtccatgtgttttgagcttctttctgttacttggataaaaatgcacatttccatattggagttttgtttttgtttgttgttgttgttggtgttgttttgagatggagtctcactctgttgccaggcctggagggcagtggcgcgatctcagctcactgcaacctctccctccgggttgaagcaattctcctgcctcagcctcctgagtagctgggactacaggcacgcgccaccatgcccagctaatttttgtatttttaatagaaacggggtttcaccatgttggccaagatggtctaaatctcttgacctcatgatccgcccacctcagcctcccaaagtgctgggattacaggtgtgagtcaccatgcccggcctggagtatattattaatagtgttttagctttaattgttccctccatgttgggttgtcaccaattcaaaccattatgttttcctaagaaataaatgaaaattatgattcattgaattctctctacactcgattttgagtatccccttataacaatatatatcactgaacattattttatgctgcattattattctatctaattttacatatactttaaaaaatgtattgactacctccactgatggttaagatgatgtcttgcagtccctcattctacaaatgtttattgaacttctagtatgtgccaacactgtctaggtactcaggatccaataataaatggttgagatatgacgcctactctcctgggttttgccttctaagcaagggaaacagctaagcagaaaacatttcagtctcatatgtcaagtggagatatgtgctctaagaaatgtaaggctgggaaagtggcatagagaatggcatggagtggagccatttttttaaaggctggtaggaaaggctgcaataagaagataccatttgatcagagacctaaggcaatggagttccatgaagaagaaaatgcaaagtccctgcagcagaagagtgcttggcagccatgagaaacagcaatgtggggctattacaaatttaaagacggggaggaaagacccaaatgaaatccattaattagtggaggtcagattatgtaataccttataagttacagtagggactttgatttcattctgagtgaaatgggaagcccttggacccactaaatatttgtttcattatcagtaataaacagatactatctcaatagcaaaacccagaaattgatggtggtgagggttgcacaacattgtgaatgtacttaatgccaccgagtggtacatttaaaaatggtggaaatgatcaattctatgttatatgtgttttaccacaattataaaaaacaaacatctgtctttaaatactgcaggccagagtctgtgcaagcactggtgaagacatagatgattcagacactcagaatctgctttgagagaatctattccatatattataaatgtaaatacacaatgcaaggtagcgtcaatcatgttccaaatgagagggctaggctaggatttcacagtgggtattctcggaaacattagtctggagacatgctctctgaaatcaaaggatgttgctcaaataagtttgggggaaaatgcatccttcacccctcatggggattcacagcacacattggcatatcatgggctttaaaaataaatgcatgttaaacctgtctaactttgcagaacctaatgatgtgaaaccattttgttcgcaggccctttttcctgaatcatctattaacagcctgagggtctggtattccaaagaacctgtgtcacaggagacacaaagctgagataggaaggagttagtgaagaaagtgtgatctgaactgagccctaaaggaaaggtgatagttagattagagaagaggaagggcattcaaggcaggagaaatgctaagtaattcacttcgaagcaagtctcctagaacttgcctcctcatatactattgagttgcagaatgaatgtcctaaatatactgataacattgtaattttcgtaaccattaactggtaaacttcttctaaaacactcagtataccaaagacactaagataaattattttgcaaaaattttctcaattctttgtctttcctttatagaccacaaaattaaggcccagagagactataacttacatagtcatccctgcctaatcgatgcctgagcgtcagttttctcactctggggcgagggtcctgttccatcaaggagggagttgtggtcttcatatgtctgccatagacactatggaaataaagcaaaaaaaaaatcttatgcaagatgaagatttcagcatgcaatggatatggaaacggaatcaaattaaagaacaacgcaagcttggattttaatgaagctcatctttgtttcttttgcagatcaaatttttggctctcatctgcacaaagtgtgtgaacgtgaaaattccacagttccgtggtttgtaaagcaatgcattgaagctgttgagaaaagaggtgggtgactgaatgtgcagcagttccccccattactgcaccctctacacaaccaatactcaagttagcagtgccacctgatttgtctgagaagccatgcaattaaaacttgacttgtgttaatcggttaagaggatcatctttcttattaacttcagtttgtttttacaatagggacattagtaattctcactaatgttcttttttgtttttaatattttgtctgtctgacttactgttgattcaagtgcaaacttcttgttttcaagccagtgataaaacattcataaaatatcagcactcacagtgttagaaccttcctaacattcatgctggtagacgttgtgccagaacaatttttggtaagcccccaacattacccaagttaagcaaatagcattctgaatcacagacagtgatatcccaccttccacatgtctctgttcagtacagaatacgctaacgggttttttcaggaacaattaaaagacacacctcaaaagatgacctttgattcctctatttcagcattctgtttttcttctgaaattatttcatcttactgaagggaacaaaacaaaacccaactgaatcatcatttctactccactctatctgtggggtgtttttccttcaaactatgacttcattcattcaaggtcatttttcctggaagatacatatagtagatgcagaatcttaaaaaatgtattgtataaaaatgcaaggcttcatcaccatctgttacaagtttacaacatattcccaggatctagggggatatatatcatgtaaaagatagaggtgttttcagaaaaaaggattggtgaacctattcccatttccagctcctagtctcttaagacaatagaaccaaggggaaaaaatctttacccaataatctactaggaaaaagccattttaattctctcagtgttacctggctttattataaaagcataataaaaatggtctgcaatttctaactcctggaaattcatactttaattatactgtaaggacagccttgggatcctattattcccctatcagtagggaatgagagaataacaagaaggggaagagtgggtagggaatgtggataaagagaatgactttggggaaagcatatcaacacatcagagagaagagcagagagtacagtgagagtagaaagcagcaactgcaggatgaacatgaggagaggtatctgtgagaaatgaagtcaattggagtttagagaaaaatgtttttattgcaagttgcaatttcatttaattttataagtacatttttaggaataaatattctttggtaagtacttaaagacaaaatggatcactgagaatattataaagttattatttccaataactaaattgtcatcattttcaggaaatcttcatccacttataaatactcagccctgacagtgtgagcactattagaccaaaaacccaaatagggcgttggggaagcacataataagatgtgtgcatgtgtaaagaagcgctccattcctcccgatttatgtctccaccctaggcaaaacgaaaaactgctagatgcagctttgcggtgtgcagatattataatattgcagagtagaaaacgtctataaatagaaaccatgtcttttgttcatggcattttgttggtgatttttaataaaataagacaatgtttttgctgactggagcaatcacatctagcattatatttcattgtccctgtgtttactcttaaaatgaatttgtagatccagcactaaacaggcgctaatcacacatatgattattaaaataattcctaagcattttaatgaaactcaaagactttccaattccacaaagcaactgataattcaaagcactttggcagcatcagcttaaaggaaccctatggaaatattcagtaaaaactaagaagcacaagataaacctctcacatcattgcaagatttacaagtgtgtacttttgattataattttctatgatcattttgttggattaatattcttatatttatacaccaattctatttactcaaagtgttgtttttacgaaattctggcataaagcatttcaggacagaaataatttatgtgaatctaagtccaatgtttatgcaggcttctgatgacattttatgctggggttggtattaggaagtagcatataaaggcgccaagtctctcagcatggctgggactcagcatatctggatccctccttctaatggccagatactctcccagccaagaaactcaactgcagagtcatgggaaatgctgatggaccagttatgggaaaggaacatttaatgaaaactatgtgtttactctcacagtcttagggaaatggtcttgatactcactacatcggcacattggctgttataaaaaagatttgtttccttctctttttttttcttgtgattattttttactcctttaaaaaaacctacaaattgtggctatatctctaaaatgcttattagatggatgatttaaaatgaaacattatcaggaaggcagatctcactattcattcattaattcattcatttatccatccagtcagtcagtcagttatttgtcttacctgtttgtaatgaacagagccaaattgctcacacttctgtagtctctccaaggaaattctacccagtacttggcaaaagatgcattctttattcatccctggtaaagtgatattagttacattttaaattttgcaacttttggacatgcctagaagaaaatctaccaataaactgaatgtgaaccaatttagctaataacttgtttagtatgtttccttatcttgatttggttctctttattactctaaactaccagagcattctccttctcaccaactattataactagattaacttcatttctgtggtttctgacattgtctgctgagccttgaaaatacaagcaaaatttggaagacaaactgttaaggagcatgttagtctttaaagctcttccaagtggttccttcccgcttgccttgcctttatagtcgtagagcatgtatatgagaaatcataattagccaatgaaaaactcaacttatgtttcttttttgaagcaatttctgtgaaaatattaaaacacggttctgctaattcttaattcatatcctgggtacaatgaccaaaagcatgagatcatctgacactattttggaggtttgaggaaacaagcatgtagagcaggggtatctaatcttttggcttccttgggtcacattggaagaagaagaattgtcttgggctacacatagcgttacatacactaacgctaacaatagctaatgagctttaaaaaatgcagaaaatctcataatgctttcagaaagcttacaaatttgtgttgtgctgcattaaaacccctgggccatgggttgggaaagcttgatgtagaggaaggcattgtgacatatagtagatacaagcagtgagaagttcatttttcactatgttatagaacactttgtgtagtttatgatgacgtcatatgtgtagaaattgcttacttaaaaatgcgatcacctgtgtctcttagatagaagggcctaggagacctgaagtaaacaaagtatatattttaaactggtataacaagtaagaccttaattcatagttctttttatgcaaagcatgtaattgactatcctttgttgaggtccattatttggaaagaagctttatacagcacgtgacaccttgtaagtactcaataaatattggttaaatgaagcaatcgaagccaaatagctattgagtacctactttgtgtcatcttccatgttaccagctgataatacagaggagatagacattaagcaaacagacacacacggttatgtatgttagcataaactgtgataagtactatgagagaaaagaacagaccctacaagacagaagaaccataacaataataaaaagcagggaaatacgtgtgtttaaaaatgatgtaataaaccttgaacgataaacacatatttatctggttttatcttcattataagaccaggagacatttaattttgccttattttgcaagttattttcttaacattgtgactatgtgatatagggagtcctttggtgtgagatctaaaaggacatgccttaagtggcgaaccagtcatgtttctacccaataataccaaacatgcattttgccaaatagatattttatataagagtagtgttaactagataaatgagcatatttctaccctaaagatatttttatggatccaaaatttttttggttttaagggaataacattaatttttttaagtttgtaatataatttagattagcattcatttggaatatgtcttaactcatacttccttcatgattcccggttctggttaatatgtacccaaactattttaaaacattaaaatgatacctagagatttattgtacaacagtgtgaatatacttagaattactgaactatacacttaaaaaggattaggaagagaaattgtatgtcatatgcttttgaccacaatttttttaaaatgaaatcatgtttttcaaatgtgataattccaggtataagcaactttgcagaatgcctcagcagatgctaatcaacaagaagtttgccctttctgtcttttttctggaacacgaaatactatgacaggaatggtacacaaagttacatatttgacttggtgcctaaaagccaccctgggatccataaccttgcttaaagatttaagaaagacctttagtctacttctgagaaggtccttagcctcaaaaactttatctctcaacttgacttcttagcagctgttatattttttttgctgtcgtttgtttgacaggatccagttataggttccgatgtctgtttaaagaaacaaggaggctgttggctttaaaattccctcattgcttgtgtgatcagcattttcccaggcttttctacatagtttgccaagcaaagggactgaccttttgtagcaaacactttttcatttcaaaatgctcactttgatttttgtcccattttatgctcattccaaactgtttacaacccactaaaaatgactgtgaattatatgtttgtgtaatggattccttttgtggtctgagtggaatgtttactttgaacaattagttatctttgggtagattatagcaacttggaaaaaggatggctaaaattattattataccttaactgtttcttttttggtaattcctctactgttaggagaagtttgagagaatatgaaattaacaagcctgtgacattataaatgaaacctgtttaattatgtgactatttggatatgtgtgttaatatcacgagaaagcgtggctggacacctactcaactcagtaatatacttatctaacaaaaatgtaaaacttggcatgtaaataaatacatgaatatttgccatatacatgttgcatttgcatatgcacatgaatgtgttatataaataacagacatgttaatacagctattgtacagtacccattgtacagtatagtagcaagcattgtagttgttaatataattttcctgatatttgatccagtgcaccagtctgcctcttgagatcctaccgagtgcttacttgcaaaaatcagactttacatagttgtttcccgttgcctttgaatccaggccccgaaactgcagatcatattgccttccctagacaagctctgctcccagttctgctaattttatactgttcattctttcccactttgggataatctattatagttggatccaggcacgcactaaaggctgatacttccatgaagaatgtgcaatttgtactgttaagtttgtgatgagattcttgaaaacttttatgattctatcttgttccagagagacttctgcttgctagttttataagcagtgagtaaaaaaaagtaacaaaaacaaaacaaactgataaaaattacatgctccaaaaaaaaaaaaaatcaagagtacaagataagcactttttctttttccctggagaatatttgtggactgaacaaaaatgtttctgaggtcagtgacctatgtttttgtttttttttttaagtgtttgcttttcatgccttatgttaggcatctgcatgcatttacaatggaggtgatcttaaagaagctccatgaaagtttgcagtgaatctccttggcttttctgagttaaaattaagaccagtttagtgctttggtgttttgtgttttgttctgttttgttttaatgcagccacaaagactgccaccttcctgacagcacagtgttgtgctgggtccaagctggaattggctctttggggtagtcacgctggggcctctgtgtctgtaagaaagccacatttagggctcgaggggaagacaaaatcaaaaaagaataaacaggaaacagccagcaagagtataaaagagaaactaggaaaagacaaccaaaagaaatcagagatgacaaggtggagaggcgggggaaaagctgcattttgcaattaagaaaacaaatgtggataagaggacatgcttgtgaggtctgtaagaaagagaagacaaactagtgaaaacattgccatctctgccataggtacctgatacctgctttgctgttccagagaaacttacttatgctcaagaaaatgcttgaaacttaaaccttgcaatttatggcatgcattgaatgttcacaaactctgtatacggagctggttattaattaattcacatatttattagtgacatttaacagagtttatctatgtctagcaatgcatgacagtcttattatcaaaaagaaagcttaaacataacagaagttaatgtaggaataaacgtgcagttcaacaaccagagaggctatctaagaaatacagcaatgtggctctggtcaaatcagtcagcggatattcccacactttaaaatccacaatgcatcagaataaataatgtcgcttcccagatacagcctgagtctaatttccaacctccacccccaatgtaaagtttaggttcttaacatacttttcccttggagtcagttggaaggaacagagccaaaattaagaccctaggaaattagcttcttattgtgtatggggaatttaaataatgcaacacctcaacttaccaagatgcaatactctcaaatagcctatactggtgtcatttacacagtgggagttctaggactgggagttttcccattacaaggccctatatgcagaacttaagagttccaccataaaaataatcttggctgaaagttagcaggatgttttagcctggaagcaaatgtttacaaaatttgagaaaaaattgcatgcatttggaaagctttcaggttttcaaaaagcagaagcaaataataataaggcagtcagagattttcagatttttttgccctagcattcaaaaactgacttgtagcttttcagtagaaatgttttgattcttgtcccataatatgaactgattgattaaaaataatcaactttcacaacagtgtcactctgttttatgaaataatttgttgtttactggtagaaaaagaatctatacattgtatttgtgtaggtatttccctagggtttaaaaattaatgataattaagaaaccaaattaattcaggaagctataaatgaaacccaaatattatactcctttgtggatttcctaaagcatgatgttcttttttaaagtttataccaaaaaaaatgacattttccaagggatttttatactttcaaattgtatactcaatttaagcattaatcaattagtctacacatatatggtaaaagagacatacagattccaggtgaaataattacagtggtctatatgaatgaacatgacatatttttttgtacaggatatttagaactttttacccatttccttaaaagactcatgtcttagagattcctctaaattctttgggaggttatcttatagacgagtaggctatacagttaaagatgtttttcttgggttcaaaataatcatttattttcttgttttatctctctttgcctgattttatacgtttcaagtcgcttcctatttttggttcagaaaaaaaaaatggaaaaaatcaagggctggacactttgagaaaaaaacctaactctgcaaaaccaaaatagctctgaaatgataatgctggaagaattcttgaggttatagtagaccagagacccaatatgtaaatacacactcttttttaagaagataataatgtcctatatctagggtgtaagtatatcttatagaagaaaaatatttaaaatattaagtacatgatgtgctccctcgtgtataagccaacttctcatatggtacctaacacataatgaattctcagtaaatggtgtataatcagataaattatattcaacattgctgaaatcctcattggagagttgcacaccattgctaccgatgcatatagttgatagtataaaaagatcaatcaccaacagttgttggttgaaggcagctcagagaataacatggtctgtaaatccactttttaaacatttaaacaagttcatttctgataagagtatatcatattgttcaataaggtaccattcttgctatcaatacacagctatgctaaacaattgaagttaggtttccttaatgattttattttcatcgatttttggatactccatttaagttaaccatcagcaactactaaaatatccattctctactcattttcatcagaggaagtcatatcccattaggcattgtttcaattccaatagcctgctgtttttaatcaagtaactgaatggtaactatgacttgtaattgacatgcctgagaatggtcaggcttaggctcagttcccataaccacacagcaagttaagccccacatcttttcctttaattcagacttggaatgccatgttagtgctgttttgtattagtttacttccctgtgaatatatcaccctcttgattcattgtttgttttccatgtacctctcaggaaatttttatttggatgataatttttttgagttgatagagactgtccaataattaaaataagaaatatatggtcaatacacaggatctatcaatttgaagttaatgaagacagaatacatgattttgctattggatattgatttcatttcctccaaatttacttcctagcagaaaaaaaaagttaaactctgctgttgctatcaaaagctctgtaaagacgttgaatataccaatgttattaaaattggactgttgtctttcttcttttaaaatgatgttgttcttgttatattttgcattttctgacagtttgggatgactaactctttagtctccctatagaacagttgcacacctaacagatggtattgtcacgacaacagtgagatttttttcttccttttgtcttgaaggtaggcatttgacgatgtatttgatattacatagtctaatattggagtccatgtgtttggcctagagtttgacagcataagaaacattcatttcctctggatttaattattgactctgacatttcatgctactggttttctcagggtgatctcaattatacctaaagcttcagtgagcccttcaatgacttcagagctcctatatgcaaataattactcaagctgtttttttcccactcagatccatggtctagaaacaacccttcttgaatttccctctgtctcctcaaactgaacttttttgaactaaactcatcacttttcccaacaaagatgttcctcctattttatttcttaactcagcccgcagcattacaatctatattccccattgccctagaaagaaatatgttagacatcttagattcttctctctcattacagacagaatcattcaccaagcctcatgagctctactttcttactatctcttgaatctggttcttcctttcactttctgtgaccttgattgggcctccatacttccttttgagataaatctcctaaggaggtctttgcctttgttcttatttctgcccaggccactcttttcaatgctgccaaaatgatccctcttaaatacaaataagattgtgttatcccctcttagaatcctccaatgattcattgatctcataaggataaacaaaattccacactaattacccccataaaaaaggataagcatatgacctctgtctactgttcagcttcatatccttataagctgctttctatgctccaggaataccaagtacatgaatttttctaatggcctattcctttcccatgcttttctttctccctttttatccatctgccaaattcacattcatcttcttgtgaatatcacaagaatcaccttctccaaggaatattctctaacttaaatccataaccatcccgccatgatctcttgaacatcattagccccttcctccacaatattccagtgacagctttgcttttcctaatagagcccttattgcctggaactacaatggcttgtttcattatctgtttccctatctagagtgtgagtccttgagtctaggaattatggttggatcaccccgtccccacagtgcttagcacactatacctggcatatgatagggcctcaattcataatggatgattaaatggatgaagagacaaatattatccaagctttctgtttatccactcatccatgcctctatccttagagaaacaaagcttacagattgacgattcagtgacctgctagaagagacaatgattaaatgtctctttaaacataacgtaaagtcatattatccagaatgtaaagaaattaccttaaaagtgaaagtaagggttttgttttttgtttgttttgttgttgttgttgttgtttttccagggggcatgatatatatgtagaccagtatgacataccatatttgtaataatcttgaataggataggacggaaatagggcaatgacctttgtgtccaatacaggtttcagacaaaacatactttctcatttttaatagggagaaaccagtctctcaacaaataatgttaaattgtttcataaaactgagggattcgactaactaaagccaaatttgatgcttttgagaccgaccagtgtcataagaatagcactatccactttctggttcaaaatattatgctcttttttatataaaccttcaggcattgtgcctacttccttgtaagtttgtgtataatttttcccattatcaccccctaggtaatctttcaccatcaccactttccaggcatctaccatccactgaatagccatgtttctgattatcttctcccaaatgtatcagcttgcattatttaaagctgaatctcattttattatttcctgctcgtatttctaaactccttaagtccatttgtatgattcttttgtcctcacagatgtccacagttcctcccaatttagtatcatcagcaaatttaattaatgctctgtttacctctccttctaatgaaaccagtcccttgtttcatttcatgatacaaagtaaaaaatgtattggcaataaaacagtccaaagaaatgtttcctcactgtaggaggggaagttaaggatacagcaaagaacaatgtggtgaggagtggacagtgcagcagggtggtgagttagtttgctattgccctgaagcaaaacctttttcacagagactacactttggcatattgcctgggttgatgctgtgtgtgtatgtgtgtgcgcgcatgtgtgtgttctgttctggaaggtagctttaatatcctaactgaggacattttaccaaagatgtatttatgaatatatgaaaagcatattgaaaactataaatataaatgtaattatagctttatatacattagtatttatagttttaaatacaataaaaggtaagctagtaatgtctgattcatggtgtagttacaaatctagatatggatgcatacatctggatatatacagacattcaatcattttcagtgggctttttctagcattcactgtgatgtaaatttatctctgtccttaacttgattagtgttttaaatccaaattaacccttggatttgaatcaaattctttgtaaatagcaggtttatagggtaagaaaaaagaactttttttcagttgtatccaacatgcaaacttcaatcaaagaatattttaacctctacaattaataggctagaaaattgagcttgatcagagtaaaaggcctaacctgctaacttgaaggtaagccagcatatgttctaaaagttacactataactctttgaaggtgtggatatacagatattgtgtcatttacatgaggaaaacaaagatgacatttattaagcactcataatgttagtgctttccagcatacataccaatactgtggaataaaattgtacattaattactacctgatacttcatagtctgtattcttaactccagcaaaatctcataaacgtttgtcaagtttcatattaagagtcagtcttcagaatgtggatggattagtataaatccagtgactttactgggaaaaaaagtactttcaagtttatgctttgaatggacagacagatgttaagatcaagatctctattgttgtatacaggagacaatgcatgttcacaatgctgaaatgaaggctgatatgtactttccatacaggacaaggtcaccaaagatggcatcaccaagggatggtgttaacaaaacagtgactgggaatattgttaggtggttacagcctcacattgcttttctagtgagaaaaatatctgatgcataatgcatccttatgagagaattttctcagatgccaagattttacaggcataacttccataagctttaatgggaatttcctgccagcacctgttacagtatagagttcttacttttcacacataatccaagactgacttggaacactgacttggaaaaactaatatagtgaaagcttcttgtaatgtttcctcacatataatgttcatcttttaatctttggtctgatgatatatgtatgtccatgttttccattcaaattcttttcccaccagtaaggtttcttttcacaagtttttttatggatgagagcagaaaaagcaattcttcttactaggtaaactagtggaaatgatacataaaggggaaagttattaggatagcaagtgacttaatgctagaaatcaactattcttgacttaaagtagttttatagatatactgtagactcctgagcagccaacaattagagtaccgcatgcaaaaacaactgtcagggactccacagcaaaatcacaggtcaaaataatatagtttgaccatattttctcatatatttatagactagaatatggtaacttttaatatttaaaaagatattgtgtagatataccaaaggatctattttaatatttcaaaagatattgcatagatataccaaatgggcaatgcattgggtagaggagaaagttaaaagttttaaatttcatacatttctaattaattccccaaacttccgttaccaaaaaactcaaacaaaaacaggtcacagtgctcctgcttaactagaattattggagattgtacagaacgactattttatgaacaacaacttcacttttaactttttcactttcttgaagtttcttcttgtctagagtttctaacacacaatgacacattagaatgaaaacagacatttatactcaaattcctgaatcatttctgatcactaccctgagtgacaggatgatgagcagggggaatgcttttcacttgttgaatgttgaaagacagtaaatttttagttcatttttatgacaagatttttttaacaaatgttggcaggtaacatgattaacgttggaagaactctgaaaccccgaaaacaagagaagacgtgtgaacctgttcatttaatttctcacggggcaaaatacgggaactgaaggagaacagtgcattcgcatccttccttctctttctttggtgtgtgattacattactccatgatgtcaccttgagcccctgtctgacctctgatactctccttctggcacacctgcctcagaaatatcatttatactccagcttgatgttcagacacccttattcacacttttgagtattaccttgagcttaactgttttaaaaggtatcaataatttgtctcctattagagtatgttcaagcaccaggaaagaggattttgttttgtttcatttgataaggcaaagaaagggaaaagggagtctcactgacacttctaaaagcatgctgtgtttccaagcttggtaccctcctcctctcaaggggttttgactgtagcacactttgctcttagtggaaataaggttattactttcttttgatactctggccagtgaattaatagaaatgcatttgtttctgatgtaattgcctttattaaggtttattttaaaacttaagagcagattggaaatctaagacctcgttaagtctgccatagttcaaagccatgcattaccagctgaggccaataagccttaggttgttactggggaagacttaagacttgtggcattgtttgtgtatacatcactggctccatctgacacctctcatctctccagtgagcctgatggagttaggctttgtatccccacccacatctcttcttgaattgtaatctccataatccccacatgtcaatcgagagacgaggtggaagtaattgaatcctggggctggttcctccatgctgttctcataatagtgagtgagttctcacgagatctgatggctttataaggggctcttcctccctcactggcacttctttcttccaccttgagaagaaggtgccttgcttccccttcgccttccacccttactgtaagtcttccgaggcctctccagccatgctgaactgtgagtcaattaaacctctttcctttataaattaccgagtcataggcagttcgttatagcagtatgagcatgggctaatacagacccagtgatgtatacacagacaacgccacatacagtaaaactgcaggagagtgatacggtgagagaagtacctgtattctctgcagtccttacccagagaagagacaggcctggctcagagatctgatgatttcatgggagaatgccatgaaatattcacgacatttcaatctatagaaaaaaagacctatatggggccaggaaaagtggctcatgcctacaatcccagcactttgggaggctgaggtgggcagatctcttgagctgaggagttcgagatcaacctgggcaacatggcaaaacactgtctgtacaaaaaataccaaaaaaaatagccaggcgtggtggtgtgtgcctgcagtcgccagctacttgagagcctgaggtgggaggacctgagcctggagaggttgaggctgctgtgagctgtgatcataccactgcactctagcctgagtgatagactgagaacctgtctcaaaaaaaaaataaaaaacaaaacaaaaaaacctatatgaatttaggaacctcagtttagagcattgtactcacctgaaagaaaaattattttataagttttccctgaagatgttattttttacaatttccatatttctaatttccttatgatagaaaattactataagaataaattatgttaaaataaattgtgattaatcaagcttaaaaatgtgccccttctcccccaaatttctaagtacagtaatatacttctttttttctgtgtcttggtgtgtccaaaatagcaggtaacccaggaagggagaaactttggataatagcaaccactcttttgaattcatttgaagccaacatgttgtacccattttccctttctgttcctctcccattatgtacttgcccccttattctccatctttttctctcccacatcctacacaagtaaactcattgtacttgttttcttttcagttaaagtctgctcccagtaaaggatttaataaattaatccacatactaaagcgtatatgaccagtgaggtttgatgtgaaatcctccaataggatttcaagaaaaaaggacgaattctaattgcagaattttaggcataagcaaggctgtgtgaaagaaatattttaagaaagaattatcttcccagattttctgaaaataaactgcaaaagtagcctctataattaatattaacttacgttgggaaccaatggcataaaatccaagtcttcaaattgataatctttcatttctatctctcatggcacttcaagatttagctatactgcctgattatggatttcctaacattcaaactcaatggagtttctaacatcaaaactcaaactctgccatcccctggaggaaacagggaaattaagacatcctttatttacatttcatacaagagaaaacatgagatacatttataattgatatcttgccactttagaaagtcacatatatggagttagatatttcataaatgttgtatcaatgaacatcagcatatataaaacgtcttagttttttttaaatttgtggataatgtatgtttttttcacatacaacatgaagttttaaagtatatagatattgtgtaatagttaaatctatgtaattaacaaattacctcacatagttatcatagatgagagcacttaacattcactctcattacatttttcaggaatatatgtcatcattaactgtagtcgtcttgctatccaatagatcccttgaaatttattccttctagctaattataattatgtatcctttgaccaacattttctcattcctaccgtccgcctaatcataccagcctctagtagccaccattccattctcttcttctatgaggtcaacctttttgaattccacatgtgagtgagatcatgcaatacgtatttttctgttcctggtttatttcacttagcataacgtcctccatgttcattcatgttgtcacaaaagcaggatttttttttttattatttaagttttagggtacatgtgcacaacgtgcaggtttgttacatatgtgtacatgtgccatgttggggtgctgcacccattaactcatcatttagcattaggtatatctcctaatgctatccctcccccctccccccaccccacaaccgtccccggtgtgtgatgttccccttcctgtgtccatgtgttctcactgttcaattcccacctatgaacgagaacatgcggtgtttggttttttgtccttgcaatagtttgctgagaatgatggtttccaccttcatccatgtccctacaaagaacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgagatggctgggtcaaatggtatttctagttccagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctggccagtgatgatgagcattttttcatgtgttttttggctgcataaatgtcttcttttgagaagtgtctgttcatatcctttgcccactttttgacgaggttgtttgtttttttcttgtaaatttctttgagttcattgtagattctggatattagccctttgtcagatgagtaagttgcaaaaattttctcccattctgtaggttgcctgttcactctgatggtggtttcttttgctgtgcggaagctctttagtttaattagatcccatttgtcaattttggcttttgttgccattgcttttggtgttttagacatgaagtccttgcccatgcttatgtcttgaatggtattgcctaggttttcttctagagtttttatggttttagatctaacatgtaagtctttaatacatcttgaattaatttttgtataaagtgtaaggaggggatccagtttcagcttcctacatatggctagccagttttcccagcaccatttattaaatagggaatcctttccccattgcttgtttttgtcaggtttgtcaaagatcagatggctgtagatatgcagcattatttctgagggctctgttctgttccattgatctatatctctgttttggtgccagtaccatgctgttttggttactgtagccttgtagtgtagtttgaagtcaggtagcatgatgtctccagctttgttcttttggcttaggattgacttggcaatgcgggctcttttttggttccatatgaactttaaagcagttttttccaattctgtgaagaaagtcattggtagcttgatggggatggcattgaatctataaattaccttgggcagtatggccattttcacgatattgattcttcctacccatgagcatagaatattcttccatttgtttgtatcctcttttatttccttgagcagtagtttgtagttctccttgaagaggtccttcacatcccttgtaagttggattcctaggtattttattctctttgaagcaattgtgaatgggagttcactcatgatttggctctctgtttgtctgttattgctgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcttaattaaatgccctttatttccttctcctgcctgattaccctggccagaacttccaacactatgttgaataggagtggtgagagagggcatccctgtcttgtgccagttttcaaagggaatgcttccagtttttgtccactcagtatgatattggctgtgggtctgtgatagatagctcttattattttgagatatgtcccatcaatacctaatttattgagagtttttagcatgaagggttgttgaattttgtcaaaggccttttctgcatctattgagataatcatgtggtttttgtctttgattctctgtttatgctggattacgtttattgattttcatatgttgaaccagccttgcatcccagggatgaagcccacttgatcatggtgaataagctttttgatgtgctgctggattcggtttgccagtattttattgaggatttttgcaccaatgttcatcaaggatattggtctaaaattctctttttttgttgtgtctctgccaggctttggtatcaggacgatgctggtctcataaaatgagttagggaggattccctctttttctcttgattggtatagtttcagaaggaatggtaccagttcctccttgtacctctggtagaattcggctgtgaatccatctggtcctggatttttttggttggtaagctattaattattgcctcaatttcagagcctgttattggtctattcagagattcaacttcttcctggtttagtcttgggagggtgtatgtgttgaggaacttatccacttcttctagattttctagtttatttgtgtagaggtatttatagcattctctgatggtagtttgtgtttctgttggattggtagtgatatcccctttgtcattttttattgcgtctatttgattcttctctcttttcttctttattagtcttgctagcggtctatcagttttgttgatcttttcaaaaaaccagctcctggattcattgattttttgaagggttttttgtgtctctatttccttcagttctgctctgatcttagttatttcttgccttctgctagcttttggatgtgtttgctcttgcttctctagttcttttaattgtgatgttagggtgtcaattttagatctttcctgctttctcttgtgggcatttagtgctgtaaatttccccctacgcactgctttgaatgtgtcccagagattctggtatgttgtgtctttgttctcgttggtttcaaagaacatctttatttctgccttcatttcattaggtacccagtagtcattcaggagcaggttgttcagtttccatgtagttgagcagttttgagtgagtttcttaatcctgagttctagtttgattgcactgtggtctgagagacagtttgttataatttctgttctttcacatttgctgaggagtgctttacttccaactatgtggtcaattttggaataggagtggtgtggtgctgaaaagaatgtatattctgttgacttgtggtggagggttctgtagatgtctattaggtctgcttggtgcagagctgagttcaattcctggatatccttgtttactttctgtctcgttgatctgtctaatgttgacagtggggtgttaaaatctcccattattattgtgtgggagtctgagtctctttgtaggtcactaaggacttgctttatgaatctggatgctcctgtattgggtgcatatatatttaggatagttagttcttcttgttgaattgatccctttaccattatgtaatggccttctttgtctcttttgatctttgttggtttaaagtctgttttgtcagagactaggattgcaacccctgcctttttttgttttccatttgcttggtagatcttcctccgtccctttattttgagcctatatgtgtgtctgcacgtgatgggtttcctgaatacagcactatgatgggtcttgactctttatccaatttgccagtctgtgccttttaactggagcgtttagcccatttacatttaaggttagtattgttatgtgtgaatttgatcctgtcattatgttagctggttattttgcttgttagttgatgcagtttcttcctagccttgatggtctttacaatttggcctgttttttgcagtgggtggtaccggttgtttctttccatgtttagtgcttccttcaggagctcctttaaggcaggcctggtggtgacaaaatctctcagcatttgcttgtctgtaaagtattttatttctccttcccttatgaagcttagtttggctggatatgaaattctgggttgaaaattcttttctttaagaatgttgagtattggcccccactctcttctggcttgtagagtttctgctgggagatcagctgttagtctgatgggcttccctttgtggttaacctgacctttctctctggctgcccttaacattttttccttcatttcaactttggtgaatctgacaattatgtgtcttggcgttgctcttcccaaggagaatctttgtggcattctctgtatttcttgaatttgaatgttggcctgccttgctagattggggaagttctcctggataatatcctgcagagtgttttccaacttggttccattttcccgctcactttcaggtacacctatcaaatgtaggtttggtcttttcacatagacccatatttcttggaggctttgttcgtttctttttattcttttttctctaaacttgtcttcatgcttcatttcatttatttcatcttccatcgctgataccctttctgccagttgatcgcatcggttactgaggcttgtgtattcatcatgtagttcttgtgccatggttttcagctccatcaggtcctttaaggacttctctgcattggttattctagttatccattcgtctaattttttttcaaagtttttaacctctttgccattggttcgaacttcctcctttagctcagagtaatttgatcttctgaagccttcttctctcaactcgtcaaagtcattctccatccagctttgttctgttgctggtgaggagctgcgttcctttggaggaggagaggagctctgatttttagagtttccggtttttcagctctgttttttccccatctttgtggttttatctacctttggtctttgatggtggtgacatacagatgggtttttggtgtggatgtcctttctctttgttagttttccttctaacagtcaggaccctcagttgcaggtctgttggagtttactggaggtccactccagaccctgtttgcctgggtatcagcagtggtggctgcagaacagcggatattggtgaaccgcaaatgctgctgcctgatcgttcctctggaagttttgtctcagaggagtacccggccgtgtgaggtgttagtctgcccctactgggggatgcctcccagctaggctactcagcagtcagggacccacttgaggaggcagtctgcccgttctcagatctcaagctgtttgctgggcgaaccactactctcttcacagctgtcagacagggacctttaagtctgcagaggttattgctgtcttttgtttgtctgtgccctgcccccagaggtggagcctacagaggcaggcaggcctccttgagctgtggtgggctccacccagttcgaggttcctggctgctttgcttacctactcaagcctgagcaattgcgggcacccctcccccagcctcgctgccgccttgcagtttgatctcagaatgccatgctagcaatgagcgaggcttcgtgggcgtaggaccctccgagctaggtgtgggatataatctgctggtgtgtcgtttgttaagcccattggaagagcacagtatcggggtgggagtgacccgatttcccaggtgccatctgtcacccctttctttgactaggaaagggaattccctgaccccttgcacttcccgggtgaggcgatgcctcgccctgcttcggctcatgcacggtgcactgcacccactctcctgcaaccactgtccggcactccccagtgagatgaacctggtaactcagttggaaatgcagaaatcacccatcttctgcgtcactcacactggtagctgtagactggagctgttcctattcggccatcttggctctaccccaaaagcaggattttttaatggctgaatagtattccatttgtgtgtgtgtgtgcacatatatatcatatatgtgtatatgtgtgtgtgcatatatatcatatatatatgatttaaaatatatatatgatatatattatatatatgatatatatgatatgatatatagtatcacatatataatatatatgatatatataatatcacatatataatatatatatgatatatataatatcacatatataatatatatatgatatatataatatcacatatatagtatatatatgatatatataatatcacatatatagtatatatgatatatataatatcacatatatagtatatatatgatataatgtatatcatatataataacatatgatatatataatatcacattttatcattcaaccattgatggacacttaggttaattccatatcttggttattgtaaatattgctgtaataaaataagaatgcagatatctttttgatatactgattttatttcctttggatatatacccagtggtgggattgctggatcatatggtatttctatttttaattgtttgaggaatctctatattttttcccataattgttgtactaatttgcattcccaccaataatataaaagggtttccttttcttcacatccttgccaacacttgttatcttttgtctttttaataatagccattctatcagaggtaaggtgatatctcattattgttttaatttgcatgtatctgatgattagtgatgttgagcattttcccatttacctattggccatttgtatgtctttttttgagaagtatctttttagttttttgctcatttttaacttgggctcaggttgttttttggttgtttggtattgagttgtttgagtaccttatacattctgatgttaacatcctgtcaaatgtatattttgaaaataatttctcccattctataggttgccactccactctgttgattgtttcctttgctgtgcagaagcttcctagtttgatgtaatctcatttgtctattttttggcacatgttagtttaatatattttctttccatgacaatagatcagaaagaaatgagagatattaaatatatatatataaatatgtatgtgtatatatatgcaaatacccagatatttccacaagtctttcaatgtagatctatgtgacaaaatcccccagaagctgaaaatctggtttgtattacactagtgctagatgagtttaaataagggaacaactgttattggaatgcctttttttaagtcaacaaagtgttttgagtaaccagagggtgcatacttctttgttagatggttaacagcccttatgtagtacagaatgaagctgagaagttaggtctctcctagaccactagaggaaggctaatctttctactttatattgtgatcataggaagtcagaaagccaactttattgctacctcttgtcttttgcttatacatttctttttgtacgagtcccaaaatcacaaaagccaatggtataaattgtccagggaaaggtagagcttctaagtagggaagatgtttttgtcttttcagctctattccagataccttatatttctgtctccaaatctggatgtgatttccccaataagaaatagtttatgaaatacttaattttgagatttctactgtgtgtcccatgaagattttgaacctcattttaagagtcttaaaccatctttcagctaaattagagatacaaaatacagcattcaaggatacagaatagatttatgatagtctccaaacatttttcaagtggatctgtggggacataaactcataagtatatattatcaaataatttcaatctgtgtcataatgttttcataataaatgtcattaatatttgttcacaagagtaatatatatgtatatactacacacatgtgtatatatgtatatgtatataaacacataaaatagttgggaaatatgtaaaacgatttaaaaacagaatcatttttataatccacctcacagagaatatatgttctcacattttagtgcgtgttatggctctataacatctggaaatgtgtgtaccacatttgttactgtatccccaatgcctagcacacttttgctacatagtaagtacctacacaatatctgtcaaattgcctggagagttggaattcaccaattcaagggccacagaatatcttagaattgatctgttcttccatttaatcacagtttaacacaggtccatctgccaagcaggaaggaacatgacctagtcccacctctctgtggagcagaagtattagtaatatccactacgcagtttctcctgtactctcaaaaagaaaacagtcatcctatttgtgtttcctgagaataggaagctcaaatgtctcagcttcatccactgtcatggttaggagcaccttcttctttgcctgggaaagaggctagtgacactataatttctcagaagtttcgaaaggcagcaataagctgaaaagaaccattttgtctgtgatctaaataggactttgctgatggttagtatactcaaatgggtttgtagaatattttgtcttggtgcctggaatttgcttttacgaactcacttgagaggcagcggccagggaagagctctctctcacctgaatgcttagcagaggcaagccatcaaaaccttccaggaagtggcaagccaaagggtctgaattggaggcacctccccaaagatcaaaagttatgctccaccaacacagagacactgagaaatggttgaatgtgttctaaattaaactgccctggtggtgagcagagatctgccaaaatctttcaattaatcacttttaccttcagggcagagttaggcctgagagtatttcaatagatttttattggaacagagttatttcagatattaaactatgttgcacaaagtaaaaataatgttattttttaagttgctactcttgttaaataaaagttggcaagcgttctcggggtctgtattgtgtctgtgtatttgtgaatgtgtgtggctttttcttgtgccataatccccattgatttttaaaaagtgaacagcaatgaactaggtgataaatatatttatataatattttcattaataatgtgttataaataatagaagaaaggttttaagtatataattcgctacatcacaattgggatttttttttcctacgtcttcagcagtaagttaattagaatcacctgcatttccttgggtggacaccaaatggattgcaaacaaaaacagattaaaatagctgctggagctcatggcatacagatgacaagattcacaaaaaggacaatgaggcactgaaaatgttcgcttttcaaacaattctagaggaaatttagctctcgcgacttctctgtaaaagctgcctgtaagtgttttgctgaaaggctagaacagctttgtttctgatcccttgatgagtgagagaaatgtttaagaaagatcactttacagagagattcaggctgaaatgtgatgactgtgattcaagccaagccaaaaattacagttcagaatgaaaggggagggacgtggtttgggaatccattttcccacattcctgaatctcaatcatcccagccaatgtttagaaaaaaatccaatggaaaacaatgaggtcactttgtttagatgttaaaaaaaatacgggtggagggattgaaaagaatgatggcaaatatatgaattttaaatcagtatctatttcaagtatgatgggatcaaaggctacactttatataactcttatgacttcatcccaaaaggatccatttttcagttttcttctttgtgttggtgagccttttattgtgtttctttaatttatgaaatagtctcttgctaaaattaaaaaaaaaagtgtatgtaggcacagagtacagattactcctcctgagactccaagctttccttaggaatagcatctccaggaatctggttttctttctttaaacctgctgtggccaccccactgctgtgtagatctcaggttatgctggtgtattggcttgcaaactaccagatgataatggcagaccaaattagattcattgttcttgttacctctatttgttttaatgaaacacactaagcaagtcatactaccaaatgaatgatttatttacatcagcatgatcacagcgtaacagtagaactacaacataaaagaaactcagagaataatatgagataaaccaaatataacctccaacttcaatatcttccagatacactaagtttttcttcaaggcaacagctctcacttaatgataaccagaatcattgaccaaaatttgtcttcaagactaagatttttttaaaaaaaagaagatgtaagatttgtcaatgactgtttataggtaccttgtttcccaatctccagaaatcatttcaattcatcatctttggtctgatcagaccactgatgctaggttcttttctagagaaatttctcaagcaaactcagaatcttgctgagatctttcttatcttcagagatttccaaatgatcctaaggctggcatatatctgtaagtcacatttatgtctactatcctacaggcttcatgcagttaggcctcaaattcttagctgagcttagagagatatgtaagaatgaatgtgcagaaaataagacacaaataggacactattgttccactattgtttcatgttaaccaggtattaaggtacataaatggcttatcaatctatatcacattagccacactggaactttttccccttgtcttttccctggttgattaccatttggtaatccttaagttaaaaggaatcattttaaaggtgggaattaaattagatgtatagaggctatatacacaaacaagcctgatccataaagaatcacagcaaatggaaaccaggaaataatatttttgaaagtatactactgcctatacttccggattccaaaggtatagataagcatctccaattataaaaaaaaaaaattggttagatattgtggcaagaactaagtataaatataagggaaaattctaataatgaggcaagacagtggttttactcctgtatccaaattgaggagggatgactttttttttttttttgtaacatttgaagaagtcagtgagattttcttctacttattgaaatgtctgatatcctacttaacatgaatgaaggagatgaagaaactaggaaagtaatgcaataaattgttttccaagactgaatccaatcctgtgtctctatacaagaatacctgataatagtaaaaagcaagatagccaatcactctcctcccacacgtctccctaccatccccccacccacaatccccaaactctattgtcactgaacttttcaaggcataaatgatacaatgtagaaccactaagaaaaccaaaccagtaacacacttaacattcagggtatttagttcttttcctcacccaattttgatgctgaagcaatgtaacaacacctgtcttccctggtgtccaaataagacgaggtttgttaagagctcaggactgggcagaagagcaaataggaccaatattaatgataaatatttttgcaagaaaacaatcttatttcctcatattaacaaattgaagtaacaggggcaaaagaaggaagtgggagtgaagcatttgaaaatgatcccaattgcccaagtgttcaaagaaaagtccttgaaaagcattctcctttctgattcaagagtctatttgatatcaccttcttcttagtatatatgtatatacatatacatatatattcctttattatgtgctctttcgaggtatttaatttaaatctggaatttgcccctagctcagacactggctatataaacaattttaaataattgctcattttttagtatcataggttctaagccattttcttagaaacgaaaaaaaaaaatccttctcttagtgacctctttttagtctaacattaaagaaaaattacaacaaatatttatctcttccatgtcttaagagaataaaaattcttattttccatatgaatcccctacaaatacctgggaaattaaatacatttttttcagaaatgaataatcaaaaatgagccaataaaatctagataatgatgataaccaaaagcaaacaaaataataaaggaaaaattgaaggtattttgttatgacattaaaaagaaaaacttgttgcaataattgtgtctatgaagcaagcatttcatagcagaaatatgaggaaggtagaacaaaaaaccaaaatgagataaaaattgaaaagaaaaggctcacgaaagaaatggaagagaaaactaaaacaacttcaggtaataaaaggagaattgaaaaatgcataaatgatagtaggaatttctataaacacagaaaaggacaagagtaagaaacatgaaatgagagatgtactgaaaccctgtatcaacctatacttccaacattagaattggaatcacgtaacaactgttttaaatattcatagtttaatccctcaccatttatttcccatgtaccaataatgaaaataatataatagtatcttcccaaactaatgaaacttctgttttcagtttttaaagttcttttttatgaaaaacaatgtaggcctcacattcaagttggcagtctcaaaaaagcatgtctgattctctttcctcaaaaaaatcccaatgaaataatagaaaatatgtgttttaaaaacaaaaaaatggataatggtgctgaaaacagaaaaggtgccatcagcagatgagaaatagaaattccaggaagagaggaagcagatgggatcaaacaaatagagaaatgaaagcaggagaaacaccattcccagacaccacaattaggcacagttctttccaggggtgtcccagagaataaccaaacttggagtcaacaaacaaaaagaacagaaattgtcaagagggcagtaaagaaagtaattcattaaataacaggatctaacagctgtgagaactgggctcctctttctttatcctgcaccaaggaagcacctacagcaggtgcttgagcctgagagcaatttctgtaaggacggaaaagttgctggcatctgagaaagaagacagtggagaagaaagtgtctcaggtcttctccaacagaattagatatacctttgcccaggtgaaaaattggtaaatttctctatatcccaagttaagtcttccttactttgataactggggagaacccctggcctattgtctactcaccacccatttatcctgcgagacactccaacacaccattctcatttaagattggacaagttgtggggagggagagagttggacacatacagaggtacccatgaccactgtttaatcagtctcaatcataagggtaatccaatatttgataatccatcttaaataaattctagagaagagagataatagagggaaaacaatattgagcaaataatataagaaaatgttttccaaatgaaaaggcccagatggggagcacatatgagtgacattttactgctataagtttaaagagaaatttttttttaatccaagagcaaaagcaatttacctgcaaagtgtcaagaatcaatctgacatcagacttaacagcagggatgctagaagataatggaacatatatttttcaaagttagaaaagtaaaagattatgaaactgaaataaatactcaagtcaacaatcaattaggaagcaaaagaaaacagtcagatgggtaaagtaagaaaaattaccgatcacatacttttatgaatcaagaaacttcttaaacttcaatccaagaaagaataacaacggaatacaagagaaggagggtagttgatgctgacctagagccgcattgtctaaaatggtcatcaccagccacgtgtggttaagctactcaaagctgaataaaataaaattaagtccctcagttgtattaaccacgtttcaagtggttaataatctctgtagccagtcatatgtggccagtgaatgctggtttggacagcaaagacatagaacatttctatcattgcagaaacttctgttgggcagcacttaatctgaggaaatgaagaaacctagaaaggaggaagaggacaagttaagtcttaacttttgggagctctcctttgtgaaactaaattttaatgttaaaccccaacatgttccctttttaaaaaatagtggctattattaacccatagataagtctcaaaatagttataaaaaacaaaatgtcccaaattttaagaatataaacaaacgcataaagaataaaactgggaagggaagtggtagagagaagtaagagtaaatatactgctttgttttccatagctcagagataatttgatatgctaagatatagaaataggcaaattaactcaatgaagagaaagagggtgtacagataagtggtaggaactacgaatgcactaagctctttatcttttctgagaaatcaataaataccattcaaagttaataaattaataaacagaaatatgacatattaacattaacaaaaagaatgaaaatagaacttttcttttcgagacagggcctcactctgtccacccaggctggagtgcaatgctgtgatcaaggctcactacagcctcaacttcctgggctcaagtgattctcctacctcagcctcctgagtagctgggaccacaggcatgcgccaccatgccaggctaatttttaaattttggcggggggaagataggtttcactatgttgcccaggctgttcttggattcctgggctcaagtgattctcctgccttggcctcccaaagtgctgggattgttggtgtgagccactgaacctggcctaaaatagaactgttaacaataactgtctttggaaagcatgttggggcagctactgtacttagttctgattgtatattgttctgtatggttcaattttgtattttttattgtttttttaaccatggaaatatagcaaaaaaaactatatatttttagaatggtttttatgaagtcatatagttatcctatagaataaaatgattcttgtttgaaaatcaaaattgtgccagctatttcctaagggaatcattcttaggaaatagcaaggctattgaaggatgggtgtctcataagaaattaacaataattaaattaaaatggcagataggtacaaaatcaacaccactgagttggaagagagattagaattttaaattatatcctgtactctcagtcatcgaatttaaagtgtgtgaacaaataagctagcaagaaaatgttggaaacactcatttcaacttagaggaggaggcataggtctgaatggcaccagagcttctcatgtttagctcagaacccaagtagaaatttggaaggaccgagacagaaacgtgcagcgttgaggacaacctgagtgttcccgtgctcaaagattttcgccggagggagaagccagaagttcaaagtattgcgagaatggcacttcttgtggtagctctggcctcctaggaattaggaagtgccataaatctcaggagagggactgtttgtgcaaaattcccagcccacatttgcagactgtagaggttcagatgcattttgttatgggttagaaaaacaagcaggctttcaggacacaccactcaaccaggctcaaactccacatctgcatggtttgtccatcattcgggctaccaaaaatgctacctaaaccagttttcaactatttttaacagactcatctgcattgtcaaaaactgtccatattttggcagataagccagtcaaatctggtcttagatttctttttgcaaagtgtctaagatttatggtgggaattactcataacagctgcattctttccactgggcttagaccaccatttggtctaataactcctaattgtgtgtctatcccagtctaagcttcttcaggagaaaaaaaagtcggggtggggaggcaggggaagacttttaaaaatcccctacagcaatacccagtgatttctgccaacagtaaacactattttgaaatataagaaggtcagctgatgatgaacgaataaacaatatttcagtgaatgtggatttcttcagataatttttcatactaccattaatgccactcttatttaaaaataaaaaataaaatgacttagttttatcgtgttcccaaagtatttttagcataacaggcaaaaatcctgtcagcatttacggtcatgttactttcttgaaagaggtacctctcaaagcgatttttcaccaaccttctccaaagcacaaaagaggtaccttgaagacgttggtcatttaaaaatcatacgacgtctaattatatttccaaaataagtagtttgcaatccagcaaggataatgtggtcatgaaaaggatgtccaaatccaccaatttacattggtttggtttggcataactttcaaagttcttggagtaaaaggaggatggcacgtgaataattgtaatttgggtaatagtcctagaactttgggtttgctgttctgtgagccattcaggggaaagcaaatcaactccaagactgtacctatataatttataactgttaaaattcactgatatgttccagattattttgcaaaatgtaataccctcctttttaatatgtactttgtcattttcactctatttatgtaatttaaaaagtatgatagccggagagcatgagccattcaaagcaggagccgctaatgtcagagatcattatcactcacaagatatatagtgttggtatctttgaatctaaagggcttggaagttgtgtcaagatagattcatattgcatctaatatgttttgctttactcccttttactttctggtttctgtctccagccacagagcagtttctctgctgtgactcaggtctacaaccacagcggtagcacaggtctgatttaccctccctgtctccaccagctgtgctccctccttttatgccaaaagaaagttgtgttattactttaggatgaggctgctttctttaaacagtatactgctttccaattgtttatatgtgatatgtccaatccatactactttttcaaatggttttgattactggacttaaaaaattgtttacagaaatttatgaaagaccaaggaaagcacttcttatattgtaacactctaagagaaaaaagaagttttggatacagggaatttcatcagttaaaaaccagtttacaattctatgcatttcaatagcatatagaataatatttgaaaaggaagagtgctaacttcaaaatcaagacatgcacttgattttacaccttgtataaatgaatatgcatattaaaatgatgattaagtaaggcccttatttgcaattaaattttgaaatccaaataatttcatttataatagacctctgataagggtctagctaattagcaaaacaaaatttttaaaaacacacaatgttctcatttttattgtaatagatattcacattttatctttaatcactgtaaataggactaatttgattgattttttaaaaaattagaatttctcttttagagaacatagacccacatattccattgatgtttctattttctaaaataattattattctctaaattccttaaaatcaattgataatccatgggaaaataatcagggccacattcatttgatcaaactttgtttgtttgtggtggcaagcatcaaggtgactttattcaccactcatggttctgatgccatttgtctgcttccaaatccaaaactctctccaaaacccccaagcatgccattatgaacatttttctgtaaacatttcagggcctctgagggtgattttagagaagaattttaaaataatttcctcagtagctatatgctcaaaaaaattaagagggaaaactttgagaaggacacacttgaatgtacaatttttaatatttttaaatctatcacgttatttaaaatttcataggttaaaactaagtaccaaacagcatctaatgacaaaggaaaaaaagaaaatgataagttttttgtaaattaattttttaacattctgggtgtaagtgcatgaacttaagaccaaaatagaccaatactaaaagtaggaattaaatattagaaaaattttaattaggactattatcacatttaagctgtcaagcagaaattgtactttaaaacaaacaaaccagagtagacttagattaatggaggtaatttgtgcatcacgaagaaaaaatatattgatttttacaaatatatgtgtcttagaaactttcaccactggctaactggtgtccagcttcacccaattcctcacaatttatagttctcaggaagagacagagtctcagtaatttcttagattattctagaactataaagtcacatcaattaatacatttgttaatagctattccattttattgcaattatctcaagtaaccctaaagtttattacatggaagagtaaaaactatagtgaatgattgtcttaaattatgccattattaccaatgttataagtgatgttattctaccctaaccttccaatgcaatattttgcacaatggcagaagtgttcctaatacaaagtgtgtaaaatggtaaagcaataaatgagctcattttatgccagtaaagtgctttgggaagtctttattctgttacactatggcaataatttctaccaatctatttaatactgttgtgaattacaatgattatccatgatgctataccacctccctagagaaactgctaagacctctgcatctgctggcaatctcagctagtcctgagtgcccagacacatcaaagaatatacattcttgacattaaaattatgttttcagcatttttagatactattatagtgtttgactaagtgtttcccttttcgttttcctgtttcttcattgtcctcgtaacgtggccaagaaattaactagattctataaatagatgtgtggaaaacaagtgaatgattattgaaattcactgccaggataagttattttgaattacagatgaccagttctaaaataatctgaaactcattttaccatttcgctaaagattttttaaatttttctctccataatggagcacctcattacctataatacactagaaattatcaaactagcattatatctagaatagaatttttactctttagtttcaaataatcagatcaaaatatgttattctgtaacaatcacaggaaaacaagaatagaatagaatagaatagaatagaatagaatagaatagaatagaatagaatagaatagaatagaacagagtagaaatggagagaagaaaaagagctgagaagaggagaggaaggaaagaagagagacagaaaggcaggaagacagtaagtcaggccagtagcaaatgtcttacaaatgtctcgagttattttaccttgcagaaaaaaggcaataatacacaaacgtctggaggtttcccccctacccagttggattcctatattttccttgtaaatgaaccttaaatatatgatgtaatcctattctacccactgctctttttgcctcaattagacccaaatttattgatgataattttaattaagactgaacaccatgattactttgagattaaaattttgaagattgcataatttagaacacacaaattggttttatctgagaagaatagatatttgatttactccttcttttcatagattttttttaaaccatctcaattcctatatgtgctaatataaaatatgcccttttgtcttcaggtctagatgttgatggaatatatcgagttagtggcaatctggcaacaatacagaagttaagatttattgtcaaccaaggtaagtgatttccacttcagagattttttcaaacagtttcatatggaacaatatttcatacactgtgctgtatgtactgtgaataataataaaactttaacaggagaatgtgaaagtggaagaaatttaaaaattatcagaaaagtaaaagataaccaactagtttatctagaaaagaatagcatatacagataaacaaattaatagtctatgtgaaataaataatgaatggaacatgtcaaaataaaaatgggggaaagaatagaaaaagagtaaaagaaaaatgacccagattcaaaaaatgttattggcttataatggacacttactatatgttgatgaatgaaagaatgaatgatggaaaatgtaaaagtcaaaataacagataatagaaaaatatatagtaggtaagaaaaaaattaggaaacgcatatgccatcaaagagttgtaaattaaaacaatgagataccactacacacctgttagaatggctaaaatactgacaacaccaaatgctggccaagatgtggagcaacaggaactctcattcattgctggcggaagtgcgaaatgattgagtcactttggaagaaaatttggcagtttcttatgaaaataaatgtatttttattgtatgatccagtacttcttggtactaacccaaatgagttaaaaactcatgtacacacaaaaacctatacacaaatatttacggcagcttttttcataattggcaaagctagaatgcaactaagatgtccttcaataggtgcaaggacaaatacaccagaatacatccatataatggaatattattcagggatgaaaagaaatgagctttcaagccatgaaaagacttagagtaatctaaatgcatatgctgagtaaaacaagccagtgtgaaaaggtatgattccaacaatatactgggaaaaggaaaactagagagagtaaaagatgagtggaagcagtaggacgagcttgggggaaagagggagagatgaataggtgagcacaggggattttgagggcaaacaattctgtatgatgctgtaattacccatacatgtcattacacatttgtcaaaacccataaaatgcaacacaaagagtgaatcctcatgtaaattataatatttagttaataataatgtattgatattggcttatcaattataacaatctaccccattaatgcaagatgctattaatagggaaaattttgggaagagtgaggagatacatgttaactctctgtactttctgctcaattattctgtaaacttaacactgctctaaaagaagtctattaattcgaaaagtaaaaataagaaattagaaaatgaaaaacaagaagaccaacacatcttaagttggtgttatagacagctcataggttttaaaatcatacagatggggtagaacttagactctctccttgtatccttggcatcttaacctccctgtgcctctgtttcctatcaggaaaaacagtagggggatgccttggaaacatttgggaaaattaaactgggtagcatctatgacacttaggaatgtgacagactcatgttagttttccttttacttaaaaacagtcaaaagtgtcttcagaagaactccaaatccttgtactctagcttcccacttagcttctataatagctggcttcaggtcctctgaatgtttttcataatacatttaacatataaactgtactcccacatttacatactgttgtgttttttaatgtctttgcacatgctcttccctttactttcaatatcctcctatcttttccttcccatcccacatacacaagcttccagcctggtagatttcttctttttcttcaaggcccagattatagcaatttcattcaataagcctccagtcagatttcttctctgttccccttactctgagtagctgaatttacagtagtacattcacatctaacttttaaaattccatctattataagacccatagatttaatgccaacttttggaaaggatataatcaaatgtactcggtgattgtatttcagaaacattaaaatttgtaagtcttggaatcaaaaaataggatactggctgaaatgtctgtctctttcacaaatctctaaaaaggtaggacttgaatcatccttgtatcttttcccattaaccagttctagccttggtgtttccatacaaggagttcctcatacagggagtttttaattaatatttgttgaacaatgtgtgtgggtgttgcaggtaagagaagtattaaaactggaaagcattcaactctccagcaattcaacttgggttgaaccagttttttaaatgttgattgcaatacttttggccacttgccacatgactcttgtttctaagaatctctataactgagaatctctacagctctgcttgttcactaatgcaattctttgtctttcacaattactctctttcctgggcaaaacacagaactaaactttacctcattcatttatattatttccatttaactgaatcagcgtaccccctctgtgggtaaaatatggataaaatagccctagcctcatattcattctagcttataaccagctaaaatcattcttacaatatagtttatgctgaaacgatatcctgattgggattctagacagctgggcaacacatttcttctacaaagaagaaatctcaaaacagaagccatgctagaaacaaacactagttgcatttcctgcctttaaaaaaactatgctcagcagtttgaaaaggcaaagaaaaaaatctgcaatgaaaatatgaaatctgtccatctcgtcttttgcaatccaaacttcagcgtcctctgaggctatgtaactgctcatgtttccatgagaattgacaatgtaaggctggacagaggcctgagttggtatctggtagcacagaattgtcagtaaactgtctccctggtttatagcactgtcagaatgcaacatactcaacacaaattatgctacattaggacctttgatactggtaactttgtccaagttgtgttatggagttttctgaattagatgataagtgaaatgcatataccaacccctttcaaaatttgctaatcagattatcctttgaatgcgttttctggactggccccacaaccttgttgctaatgccataccttcccctccatctggaccaggactctaatagtagagctgacttgaaaataatcagtgctgggtgcaaagagattgtaagtgtacatgtggccctctgtggccctctctctgtgtgtctaatacaataaactggcaatgcagggaaaattccatgaaaagcataaagtgctatgtaaaggcagtgcatcatttttgcagtctaagctgaaacataaatgatttttgcatacctgccttgtattaacatattttattccttctttattcaccttgcacatgtttattttctagaaggctctaaatatacatttttaaacaagtaagccctgcccactgttagactagacaaataaaaactgatttttgagattttcaagacagatgaattgcaatttatgtatttcactaactttcttgaatgctataatcatcagcaattctaaatacaccagttgaatgactcaatttgttttggttttctatttgacttactaaatcagtgggaattagatacccttattatacttccagttcagatgacatgcaagttatattcaaagtgttcacttttgaaaagcatttcctaattataactagtaatgatgataatagtaattattatcataaaagtaagcagcattttcataatttattatgtgccaggcactgtactaagcactttatttacataatttaatctaatcctttcttacatcccatagagtaggcactattattattcccattttacagatgtaaaaactgaggttcagatagtaaataatgtcctaatgtcatacagcatataagtgaaggagctaagactagatcccagatctgtctgactcagagcctatgctgcaaaccactgccattattctgcatttccaattcatcagctgttgattatctctttataaaagcagagattagtcttttcatgctacacacgctcattcatgactttcctttacaccccgcctcttggtgttggtaactgatgagtactaccgttggagttttgctaaaattgttcaagagctatttggagaaacgccaaacatcacagttaggaagaagcctggcattgccattctctgtatggctttatgtatctatgtttggcccaagaaactactttaacacgctattctgttgcagcctttgggaaagggatcgaggattctcgatttactaggctgttggtgcgtttgtgagcagcgctctgccctgtttgttgaatttggtgacagctttcagtgacattttgctgatacagctcttctgctttgtgaaggcatccccaaagaaaactggtccatgaccttagatgtcaacctgtcatcagcctgcgacattgcgttgattcttcagaatgatctgtgacctccttacacttttcttgcatggggggtactttgcaaatgacagacttcagcatggaggatgctgcatgtcttgagaacttttgacagaaagtcttggaaattcccctaggctaaactccccctccttcccacattgatacttgggtttgagctgcccatctatgccttaggcttattgcccaaactacaaattcagttcagactcacttggtattatttagacatcctctttcaccctttgaaaaagggacaagagagattggcattctttttggaaaaatctagctatgaaccttcccaagcccatgagccaatgggagagctatgaagcattgccggaagaactgactgggaattttccagatgggtgtctgttagtacacagttacaaatattctctctgttttcctgaactgaagaaaattacttcttaccaggattttagacatgtttttcttttttctttttcttttttttttttttgagacggagtctcggtcggtctgtcacccagcctggagtgcagtggtgtgatctcggctcactgcaacctccacctcccgggttcaagcgattttcctgcctcagccacctgagtagctgggattacaggtgcccgccaccaagctcggctaatatttgtatttttagtagagacaaggtttcaccatgtctcaaactcctgacctcaagtgatctgcccacttcggccttccaaagtgctgggattacagagtaagccactgcgcccggccgacatgtttttcatttatagaaacaaaatttgaagaaaaactgttaaggacaaccttctctacttgtgcaaacaaggaggaacaaaatatacaaatgctataaatctacatgatcaagaatcttgtttgtgtgtttgtgagcacacacacgcatgtgcatttgttttaaatgagaggatttttttcattaatttatggtctcgtagatatctttatctacccagattttattggcataataatccaaattagatattggcttaaagagatggatgtgcttagtttaaacatgctaagaataagctccattaaaaacaaactattagaaaaacaattttgtttttatcaactgtacctaaactactttaatatagatttgtaccttaaagcaaagccaagcattaactttagtagctatccctgtgcttttcatattatttgcagcatcaaaaattgaataaaagaaagagaaagtgagaaagaatgtgaacaattggcagtttcatcatgaaataagcaattggatgaaacagaaaaagatctgaaaaaggatttcaaatttctgttcttataaaatagcccttgtatcaagtccattcatttttctattaaataagtttatattgccctcttattatttttaaaacgaggtatttccttaagcctgctctactctcaccgccaatcacagcaacaacgaaacaaactctgttattcgctttattccattccacagggtggttttttggtaagttgaatcattgatattgcacctttttggctttcatgtgacaagattatcttttaacaatgatttatttttcccattaaagttgaaaagatcacttgatcataaaagagccagactctaacatcattcagggctttggaaactttcttagacctcatttttcagctacattgagtcagggagctcaaagactattgatgaagcatgtattgttttctagctgcttaagaaaatgtattggcattagtaaataatgctgaacacagaggtcaaaagagtaagttattcatgttcatgcacatttagtttctgatttttacattatagtccaaaaataagtttatgaatcctgacagtctccaagacacacaaatcctggctacttattttaaagcaaaactataccacacatttaccgtggattgtattttctaattcattatgtaccaaccaataatgaactgacctaatgctgttgtgaaataaaggcagaaggcatctaatggggaaaagcaccagataaatgttgaaggatcgacctctttatcttgattctgaactatttggaagcctaatagaaattattttaacccctttaaatcaccaactcttcatttccaaaatgggaaaaataatggaaatgtgaggactttaaaaagtgaatcagccaggggatagttattattaactttaattaagatgacaagtagatagatgaaatcaaatcactattgcattttcttggtaatagcatgataccaaatatttataatcaaatatggtttttgccttctacatgattgaattttccttgatgataattggaagaaaaaacaaataaaactttggaaactctttactatccagtgtttgaaatcattactagccaaattcataggccttctgaattcttggacacaaaaaagaaaatttcatgttgtcagtatggtttgggaatattctaaattgcaaagaatagcttcatgttcattggagaaggggagcgaagtctactgaaatttaaagtattaattcggttgtagcttttccatatagacttgactactgagtctggaaattaaattagtcagagttatgtaactactaatccccaagaaaaacccctaagatatttacaaaattccatcatgatcatcaccatcatcatcatcacaaatcattgccataaccatcaaaattaataagtagttattaaaagcttcataggaaaacacaccatgcttgcttctgctctaacaacactgtagcactggttcccggccttgactgcatatcagaattgtactgcatatctcctgctgcctaaccatattactgccaacttagctacctaaagcaatacaaatttattatctcacagtttctgtgggtcagaagtctgggcacagcttagctgaatcctctgcaaggctgcaaaatcaaggtgtcagccataggcgggttctcatctagaggctcaactgaggataggtctgcttccaggttcacatagtcattggcaggattgagttccttgtgggttgttggactgaaggcctcaatccatcattggttgttggccaaaagccttgtggaccatcttacagcatggcagctgccctcatcaaagcagcaagggagagacagattattagtacagcagaagttttaatcccatgtaacataatcatgaaggttacatccaatcacctttgctacctactgttggttagaagcaagtcacagttcccaccttacatcctaggggaggggactacacaaggtataaacacaagaaaggggggataattaggggtcatcttagaacctgactgccataagaatctagtggtagagcttttcaaaaataaatatttttgaagctcattcattaaaaaatccaatgtaagaagtctgcagtttgagctataagtaagtgttttaaaagaaaaactccccagataagtaaagtgcatagccaggtttggaaactccctgcacaatggaagctagttttattctggctctctggtggagacatgacttaccaagacataacatatacaagatttgcatttgaaaaaaggggaaatagaccatgaatgcctgtttcgataactagttttctagtgaggggaagtcttctctttggctattgattaatgtaataatgttcaaaaacttttatgaactgcttcattatataactaaaaactaccatggatatattatgtatgttagtatgattaaaattacgcattttaccataacaatccttttccaatgttgtgagttctgaaataaatgaaaataaaaggtgctttacctaatcatttgctaacgaaactaaggggtaaataatatgaaaaatgtaatacatttatatcattgctgataataggagcatttaattgagaatctactacatgacaggtacacaaagttagaggaatctctgaccctcataaaagttttcgaggtagataaactttattatccacattcttcacataggaaatcatacttaagaaaaattaaataactcttaggccacaaaattaatacagtattgaaggcaggaggtgaatctattttaaacttactcccaaaaatatattgcctggtagctggattcaatttaccatggggaagggggcagagagatgttatcttctttttaacattaaggaatcccaaatcacttattctcattatagtactatattttccaggtgttcagcctatgggaccctctataagaaaaaaacatcaattttaaattacccttttaataaataacccccaaatgctttggggattataagagtaggaaacttgattcatttttgaatctccagcatggcaaagtgcctgccactttgaatgtatgaaattaaggtttgattctacaaaataagagaatgatgaacatcttatacaaaccaactctatataaaataacttcattggtacattatgttaggttccattttctcagcaaagaaaactcaagctatattttacattatattttctcccagatgcctataagttagcacttaattttagactggataaaagaaatgaatagtgaaggatcccatatccccattttctgtctcaacaaaacaaagcttgaggcgagataacttactgtccctcaacatggtatcttgttagtaattgaacatgtcagtcatgatattggaaatagtggtataacttggcatgccatcttagtcctccaaaatgttggaaatacttagggttggataaatagcaatgaagtcatactgctcttgctaacccccaggccctgaattttgaaagcatgtcttttgtttttgttttcacacaaggatccctgttgctggtaattacagctttagtgactcacatatatttatatagcacctcttttccaaggtgccccatgtactttggaaacatttcctaacaaaagtgtgctgtagaaaaaaagtattctcatctccttaaagctgttcctgaaaaggaaagtaacagttgcagagatgggaagaaattttttttcaggtccccaagcacaacgtgaaaataaatattcaaagttaacaaatgcagggctaaagcaagattcaaactaaggtctgaatgacttagaaccacacagattctattatgcccttatgtgtatggacccactggagaggtggtggaagatagccttatctgcttcttgcttcactgagggtcccagcacagcaggattaatatggaagggagagatgagctccataaaataagattttggcttttacagcattcatttgacagatgcttaaagagctcccactagatgccaggcagtatgtgggacaccggaagtacagcagtgactaggacaagtgacctttccattcacatggagcctccatgtgcatggacattgcaatctatcagctaagaaccctggtgatgggttcaatgtgaattagtgggaaaatactaggatctgcaggcatcccaggtctgctccctcctctctctctgacctcactgtgtagctctcttccgtcctcattattttccaaccaccacggcttcctttctttctcagattcatcaagctcatcctcttcctggggcttttgcatttgctcctgtctactggaaatgagtttccagcagatccccacaagatgcccccctttccacagtcaggtcaccttctcaggaagccctttcctgaataattcgtctgagacatgccttcactgtacccacccagccactacctttcccagtatcgtgttttcctttcttcagagcacatgctatctaaaactgccttgctgctgcttttttttttttgagacagagtctcgctctgtcgcccagtgccacgatctcggttcactgcaagctctgcctcccgggttcatgccattctcctgcctcagcctcccaagtagctgggactacaggtgcccgccaccacgcctggctaattttttgtatttttagtagagaaggggttttgccgtgttagccaggatggtctcgatctcctgacctcgtgatctgcccccctcggcctcccaaagtgctggcattacaggggtgagccacagcgtgcttctttatctatcacctcagtgcttgccttcctcctccacactgtggcatctatgtaagcaagaccttccctgtcttggtctcctcagtatccctagctcttactgtgccttcaaataaaagctttttggatttgaatgaatctaacaaacaagtgcattaatgagtcatgttgggtcaccagcaaaggataggctctgattgaaaagcaggcgttagccctcaggaccacaacccagacccaggaaaacatacagccccgaaaagaatatcttaagaatttgagagttgctttctagtcagtccagtgaaagatgttcctcttcccaaccctcaccttccacctccacctgaagtaactgtcttccaacccaacatggaatacattggaaagatttgggaagaagaggaggaagctgccaggcttggaagatcagagccagccctgccagccttgtcctttaggccaaaaaagactgcctaagaaacagaggacccccaaactcaggtgatactaaagccacatttagggtcttatgtgaattatatgaatttccatagtgtaatccctttcagtgaggtgatttgttgccaagtccctgtcggccccatatctcgctgtacctcaccttccgtttgccagagaacacctctggctcaaattacaagtggatgtcctggtcttgctatggcttcagtgaagtaacataaactgcaaaatagaataatcaggaaaggagggaaattagctaagggtataaaataaggcctaaatgctgggaaaactggctagtcatatgtagaaagctgaaactggatcccttccttacaccttatacaaaaattaattcaagatagattaaagacttacatgttagacttaaaaccataaaaaccctagaagaaaaactaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaacttaaacaaatttacaagaaaaaaaccccatcaaaaagtgggcaaaggatatgaacagacacttctcaaaagaagacattcatgtagccaacagacatatgaaaaaatgctcatcatcactggtcatcagagaaatgcaaataaaaaccacaatgagataccatctcacaccagttagaatggcgatcattaaaaagtcaggaaacaacagatgtggagaggatgtggagaaataggaacgtttttacactgttggtggtagtgtaaactagttcagccattgtggaagacagtgtggcgattcctcaaggatctagaactagaaataccatttgacccagtgatcccattactggatatatacccaaagaattataaatcatgttactataaagacacatgcacacatatgtttattgcagcactattcacaatagcaaagacttggaaccaagccagatgtccatcattagtagactggattaagaaaatgtggcacatatacaccatggaatactatgcagccataaaaaaggatgaattcatgtcctttgcagggacatggatgaaactggaaactatcattctgagcaaactatcacaaggacagaaaatgaaacaccacatgttctcactcataggtgggaattgaacaatgagaacacttggtcacagggtagggaacatcacacaccagggcctgtcataggatggggggcagggggagggatagcactgggagaaatacctaatgtaaatgacaggttgatgggtgcagtgagccagcatggcacatgtatacttatgtaacaagcctgcacgttgtgcacatgtaccctagaacttaaagtataataatttaaacaaaaaaaaagcctaaaatattggcctaaatgaagacttcaaatggggatttattcattcaaaaatatttcttgaaaaccttttatgaaccaggatctcttctggaaaatcaggctctggtggatcatccattttggtgtcaagagatacataataaatacacaagataatttcagatgatatcagaaattataatcaagatcgtgatgtaatagagaagaacagatggagacgggtgaggtggcccttgattagatgacctgagaaggtctctttgaggaggagacatttgaatagacacttgacctgataggaagcagggaggcatggagagatgtggggggagtgcaaagcagggaaactggttctggggaatgagggcttctgtgagatcaggacacacagaaggccagagggatgggcaaagccaggccaggtaggccttgccaatcaagattagaagcttggcttttattctaagctcagtggaatgtcagtggggtgtagggcagcagtaagcagaaaattagctgaacctatttatttatttgtttttaaattattccactggctaagagaagaatgaattgtagggggaaagagtacatacaggggacaaattagaaggttgttacagtagcacagtcaagctataatagtggtggctgatttgtatgagggaatacttcatattctatttgtcttattttccatatgccttttaaaccatttcctttaagcaataaagtgtagagagaagagtggcccaggagttagaaagcctaggtcaattttcatgtcacctcttaataattgtgttgtcttgcccaagtcatttaacctccccaggtcaattttattatctttaaagcaagaatatattttcttttaagatgagtcaatcccatgagataatgaacctgttacaatggaaattgctacaccatatggaagttatatctaaatgtgtcccttacaaccatcctaatgaagtaatctattgtaatataatgaagtataacattttttaaaggaaagaatattttataaagaaagggcttatctcaagttcttcttggattatttaaatgtcactcaaattttccctggaacctccccccaaaccacaagaatcactcctcattttaaatcctatgtttacaacttcaactactcaatttacaataacctcatattgtgtataatgttatatatcactagtgaaaatcacatgcttatatcttatctactcaacacactaaacatttcttaagggcagagttcatatcttttaaacctgtctctcctactttacccagaagaatattttgcagctgatagaagcactacacattttaatttattgattgattccatccagagttggaccatttttttattaaagaaggtgaggaatttggcacatgctggagatcagtctcaaagtgaacaatttttcactgtgtactattgaactcagttccaaaaacaatagcaagaaatacataaaatgttagcattaggtattggtgatttttattgtcttcgtttttcaaaataccttcccaatttcctgcaatttacacattatttcttttgaaaacaaatattgaagaaaagagaagatatgtcttgtttcaaacaggtcaatccttttttttaacagaatagaatttacagaacataccaacagaaccaagagaatgtcagtacttgagttctctaaagcaggggtttccagccccccagccaggggccagtaccagtccatggcttgttaggaacctggcagcacagtaggaggtgagtggcaggtgagagagcattaccccctgagctccacctcttgtcagattagcagtggcattaatttctcataggagtacaaaccctattgcaaactgcacatgggagggatctaggttgcatgctccttatgagaatctaatgcctaatgatctgtcactgtctcccataacccccaaatgggactgtttatttgcaggaaaaaaagcttgaggttcccattgattctacattatggtgagcatgtaacaataatagaaataaggtgtacaataaatgtaatgtgcttgaatcatcctgaaaccatactcttccccttacaatctgtgaaaaaattgtcttccacgaaactggtccctggtgccaaaatggctggggaccactgctctaaagcacttgaaatgctattacactaaatctttgtaagaaagctacccactttatagatgaactaaagtctctatgaatttgaatgagttgctaagagttgcatttcttcattcagctgagatttggagaaggcattatgtgtttcctggtaatttagagagaaggtgacatgaaatcccagccacagtctcctaacatccatgggattctaaaaagcccatggaataattccctttaaatagcagcaggtattggtggcatctgcatttcttgctgtttcaccatctcctcatcctttctacttctccagattgtttgtctttttgtggtctcctcactctctggctacatttttcctgagcaagtaccccactccctcttcttgttagtctattactttcatgtctggcagccataaggggttcactcaccattatctgcttaggatgttggaattcaatatcccatcagtcctgggggctggagtatgtatgcgtattattatttgataggtcccagcagaacagtctttcagagcaagatgcacatcatcagtggttttgctgatggatgagctcacctccttgacacagatctcatgattcttggcataaatctcaacaggaattagctgcttcttccactgtgttcccatagcatgttgtccctgtgtttcagtactggttttagtctatttcatatgccacttctctccctttcatgactgttagatgctggagactgagctatttttcagtttcctctggattcctccctatgcccatcatgtgccatctgcattgtaggctttcagcaaagctgtgcctgccagatcctcttatttctgggtgccaaaatactcagcattacacttctacctcacaaagatctacctggcttaaaatcatcacccacctgtgtgtgcctttggagccttcatttcacccctgtcctcacccctgacacctgtaagacactgagtcttactgagcccactttctccatagtcatactctatgcacacagccatcttccccattcctctctccctctccctttcccttgccctgttctcagcgttatcatccccatctctcaagagtccactcagactttctaaggtgatcatttgttcatctgagcacagtaggtcatgcttcctgctactcctgggaatataaggtaagagacgtcatataatcaggtaaatagtgaggatttccagtctctacataaggtattttcaacagtagtgttgactcacctcaaatcacaccacttagacagctataaagccaggcttacctggaattttctttttctgactcatgaaactcttgtctctgtcatatgtgtatttttacttctgaattaatatagccatcctgaatcctaaatccacgcgtgatttctgagaccactactctcactgctaatctagttatgtaggaatccctcctaaataaaaattttaaaagataaaacatacaaccaaaacacaaagagccatattgagaaccatgcaaagcactttaaaagtggtaaaagatactagctagataaattcaaatctctagattacaaaaatggaaattcataaattaaaaaaatacctctagatacctttatatttgtttctttattccatcttgtgtgtttatagaagaaacaatattcaggtacttttcattttactgggatgagaaatggaaatgctaactacagtgcagcttcatgactcaaaagtctgtaactggtattaatgaacttttaaaatgctaattttaatgcttactccaacagaaagatgccttaaagcaaaacttcacatttcttatctgctaaaagcaatgtgttttgcatcccttacaaaataaaatggttgaaataaggtttttaaagggcttaaagtttcaaggacttctcttgttcttctagagaaaagaaatttataaaatcacatccattaatggtccctctgctagaaaacgaaaatactcccaaatatgttccactctaggaaaatcaaaaataacatgtaaactacaaatatgttagccaattcagaatatttattaactaaataatttaataataaagaaaatgccgacttgattaattgttacagagtaaaaattacaataaaactgtcttgatcagtgctttgcagaagcgccattactgtctgtgcagttgtttaacaaggatttaattggaaagataagtgaatgcacatttaaaagtattgttaatttgctttataatcaccccatccttcacagtattgacagcacaaggcacaaacccctttctgttttacaagtattattttccatatgtgcacaataaattctgaagcagtaattggaaattttatgggatccagtatacctagtatagtgggtttggaggtgcactcttcctttacaagaggtaacccagttctagttgttggaaacgagtgacaaatctttgatgtatatatttcccctatccatgtttgttcaggttcatatttggtccatttctagaaaaggttgcctctcttatattttatgtctaataaaatcaagattgagaggagaaaaaaatatgaattatttttagtctgtgactatttgtattactttcttgaaaatgtgcattatcagtggaggttctaaccaaggatggtttctagactgtagccaaacgaaatcacctgtatctgaaaatagtggtacctgaacctattaaaggagacaagagaaggggcaaagaacatctatgattgatctctacctctgcagccacactgacactcactcacacacatcccttagagtttggaatcatctcgtcaaaaatctaatcagtgtggtttgcaaaacaacatgagtgtaatgcctcagatttctaagaggtggcaaccttgactacccaagtttccaatatacaaagcccaaagaccttccttattgtagaaagagcctaaagctactttggaagcaggtcatttgctcatttcaaatgggtagagaatgttagagtgccttgtttattggctgattctcaaggagccacagtctttaggatttatttcaaaagataaaagagcctaaaacttaaagtataataataataaaattaaaaaataataataaaaaagatgaaaatatgagcgtcttcttgaaaatggggaactgttcattaaacctattttgaaggcaacagttgttcgaatcctctctattgataaaggctgcccacttggttatgacgagcagggagtgtccccaaagtgtctcatgccagtggcagtaaaagcatgaaaaaatatagggaacatgctaaatagcctcttggccatgcccccattagctagaattggtagaaatatctttaggtttggttaactatagatttatttttttcctgtagacagcaaacacttcaactataaaagcttagaaatgtcttctgaggaaaattttcgttagaatcctttgcagtgtaaacctctttgccctctggataaaatgtgttaccttacgtattgtcatgggaacaattatttttatctttagtttggctatgcctctaaatctctaaacttctcacatttacattagttttttatgcttacagagtaaaatagatacacatattgagtttcacatgtctagagattttccaatacatgctaatatccgatcactaataccaactcgcaaatcacataaatctatttcttcattctgacatgtatatatatttctctagtgaaaattcttaccttgctgagtttcactctccctatatgtgtaagtacttgtgtgttgtaaaaactgtgcgcagacacacatatgtgtacactttaaagattacttttactactttttcaaatttctccattggaggcatggattttaaaactgtttatctctggtgaaaatgtctttgggaccaagacctttatatgccccatttcaactagacagagctgagactggtgcaataatgaaacgtccagctgtcctttaattaactaaaatgaggaaaatgtaatgttttgatgagagaaccaggattctgtgagggataaggggaagactatatgtttctgcgccttcctgcatatgacacagccatggggtgcaggaaagagaggaggcatttttatgccccagtagggggagctttcttttccctactgtaaggacagcatggtgcatgtgtttaaatacaccatcctaaaatgcagacttttcattttcattttgcaagtgggaaatttcactatgtgatgggcacattactcttcttagcgacacattttgtgcaaactcatttgggaaagaataggaaatttaaaatactgccttcatatttcttctggaaatgttagcctgaatccattatttccaaacctgatgaggattacagttcatttgtatttcacagcaacccatattgtattctgttttgtgaagtaaataagagatgataccgttctaatagtgcctgtattttgctttccatgttaatagtcttattctgggggcaaaagggaaggaaaaaggcagagagtggaatactcaatttagccttctctagatggaaggaatgtgttattctgacaaagaagtgccctgaattattttataaataatctaaaccggaggaggtggaacacaaactcacttaggtcactgagtatatccatattcaaatgatattataaaaagcactgttcattaacacccaaatctctatctcttatttaactacgtttaaaatactcatggactaacctgatttgacagcagtgtaggtggatgcttatgtgccactgaagggaattctttacaaaataatttcccaccagcatttcactgtgcctgagatgccacaatttgaaaatcaattcattggctgaggcaggaaagacaaataatttcacctcttatactaaatacagttgtttcttggtgactgaccagatggttgtgttaagaaggatactgaaacattgtcctaaataagtgggaaagagttctgtgatccatccataatggatcacattaataatgtatggcacagatattatttaaaaagaaaaaaccaagtgcctgaatatgcacaccatgcactttatgtttccggtttaagatattggattaagaaaaaattgactgttatacaaataacatctgagtcttacactctatcgacgtaatcatgaacacaaatcttttaatctggtaggacatcatataacctagcatacctttaatggaatacagcaaagaacaggaaatatcagaagaatcagaagaagggaggattatatgataaagaaaaaagaactctgggagttgagttagattaaaaagtcacattttacttaacaattttaccacctctttttcacccactgactaaatttctttctgatataaagtatgactaaactattttggttgactctagttcatagattgaggttatttctattggaatgaaaggaagtccaaagtaatcctccattgaagaaatgtcccagcccaattaatgattttagctgatgaccatatagactatctttctgtctacaaagctgtcatcaaactatagctaaaactaatcctcctaattgcaaatcacttgaaaataaaagcaaatcacttgaaagagagaacatctacaatggaatgtataagtaaagtcttcccactttaccttcacttactttgggctcaggttggtgagatttattttcattaagacaaattcttaggccctgaaaaaatagatgaaacctaccatctgcaccacatttcaatatttgacttaagtcatctgttgactttgaacacactcgtgtaccattcctcatacgagctaaaatgtaatccccttcactggggactgtaaagaaatgttgactttcgatttctttacatatttgatctttcaagatatgagaatgctgcagctggaaaactcagcaccattagggaaacaaagcagaaaataaaacatacaagtgaatcagttaggactcttctgattttaagggacaaaaaccaaaggatttttttcctttatgtaactggaaaaatcaggaaatgatgcagcttcaagcataactaaattctgaagcttaaacagaatcgtaaggcctaacctctctcggtctctcagctctgctctcctccccattagcttcatactcaggctttgcatggttgtaaaatgaccaccagcagttctggatcaacatgatccctgcttctagtccctcaggaagctcctttcccaaagcacctgactattattaaccaaaattgtgtcattaactcatccctgaatcactcactgtggctaaggaaatagaatgggctgattggcttagaacaaggtaacaagccccctacatggaggtagagggagattcccatccagaattcaggaactgcagtataaggagggggatactccccagaggaaacctggtgcactatgttcagaaataagatgctctctacaacgagtaagtgaatttttacagttaagacaaaaaatgccagactgtacagatagaagagatgtcaaatgtcactcaggcaattctcttacttgcaagcagtctttgaacgtgcttaaaactctttagataaattaattttgcagagttttgggaactttttaaaaatattcagtaattgctttgggagctgatgtacataaacctcacagcaattgattggttcaggaaaggggtaatcatgtccaagttacgttggtttgctagctcaggtataagtgtggaccctcatatgtcctgagtatttcatttatacataatctttgaaatgttttaggagcaaaaaccacatgctttcaaggtcttttaggcaaccaacattgaaaagaaaaaaaactatcattaaagctaagcacatgttgtcattcaagtaccaagatatttaatagaaaattacaacatggagtatgaaagatgagagatttaactttcaacaggcaaaggtaaatattgagagggccagaataatgatgtggaattatgtagatgaaaatcttgccaagacctgatagcaaatacaatccagcaaagggccagggagagtaatgttgaaatctttgatgactctaggccatctagaaagcgccaatggcgctctatacatttttaaaaaaggtgggggggtagttttttggttgataattttggtcatttttagtggtatccctgtgcagaagaagatgcttttattcaataagagaaaactgtttactgtttttgttgtatcagggacacatgacaaagcattcaaatatgcaaataattgcaaactgatgtatccagcagtttaaaaattgaataaataatttagtttttacgcatgggcaactcttgctaaaaaaactacaaatcagaactcttctgtttgaatctattttattttgttaatagatgagctaatatgataggcatttaattgtataatatattattagccattttctttggcataccattaactttaaatagtattaatatttaacatttcataatatacactacaaagttcttattttttccagctgaacagaaaatgtacattgatagtaaatctctttaaagtgggttttaagatgctaagtatgcaaaacctgttccatttatactgtttgatcagaaatactcaaaatgccacagcataataaggcaaatgctgtaagatgacaatgatgccaaaactgtattatgattgtgtattcaaatacaatgtatcgcataattaagcataattatataatttgaatatttaagagagcatttaaaatgtgataggaagcatctaagtacatcgacttctcaggatggttaaatcagagagtgtaaagttgcgattagtatttgttactgaatggaaaactaattcaaacacaagtttgcaaggagaacacttgtagctggctcaaaatcataggccctaactttgtctcattacatttgaatctgtttaaatttgagtaccatgtttttctgtccttgcaaaacgtcatttagttagttgaggtggggctcagagtttctaggatagttgtaggatgcctaggataaatgatgctctttgttccatggatatcaattgtgcccttcattcagaccagcattctcagataggtgtgcccacgaccgtgaggggagctcgtccaaaaagaataaagggagcaactcaaatgcatccctgtttccaggaagactgcccagaggctatgccccacttagtataaatcagccagatctttttgtcgagggaagaatagtgctgatcatgcaacttcctaagtagaagatgaagcttgatttcttattaataaatatttggggggtataattttaagtgggcaagaattaagattctgaacttttccagcactccctgcacagagctttttttctccattaccagcactgaaacatttgttttatttttttatttttatttttatttatttatttaagttttagggtacatgtgcacattgtgcaggttaaaagaacttttcttcagctctcagtgttctttcttaataaaacaaatgtttcttcaaaacatttgttttattaagaaagaacactgagagctgaagaaaagttctttttatttctaattctccctaaattttcaatgatgtgaacataagcccaacagaccaggcttatggcatactctaaaattgcagtagaaactcgaacaattttttctacttcattttatgtaatggtgacttaattaggggctaaagacaggtgaaagaagttgtcccaacaacgagtatttaatatgtcaattttttcagagatttgtgccattgcaagtaaataggaaatgaaaagacaaaatttaactaaagatttcctgtatctgttagtaccaaagccagataaatttctccagaggtcaacatattctccagaagctgaccacatccaattatttccagcccacgcccaacacgaatcttatgctcctgcagacaaatataattattacaggcagagaatggtatgtttatttccacctcgatgacttgccggtgacaacagattctgtattctggatctcttcttttcccgaaattctcttgcttagcccatttttcaaaactccactgaggttccaagttcctgtgatgaattcagctcattttcttactcatccttcttttagatgtatttttaaattttaatatgcgttttatcacaattattttaataccttaaaatatttaatattttaatactttaaaatatcctagttttttgttttctgtatcattacaaatatattggtacataattctaattaatatatgtaattttccctttatactaattcatgcacttgtgccttgtcttcccaaccaaaaccatctagatcctcatggataggatcatatttgacttttatatttttaccctcaagctgtgcaagaaagtgcctataaataatggatgtttaataatgatggtcttaatgataactaatatatactgagcacttcctatgggctaggtactgtatgtgctaagttttgaacagtagtatcttgtgatcatcacaataatcccacttagcaggttctattttcattctcattttaagctaaaggaactgaggtagaatgtgatcagtaacttgactgcaggcacagaattggtaaccagcttcacacaggtatgcttgaacaccgtccatgttttcaggcatactcgatggactaattagctccacaaaaagccagaagatgcaagtgccaagtgacatttgtctcaatatgccataaaggttagagaagctgcattttttttatagtttcactttacagagaactgggctcattgtggcaaacaagcaacttgctgtgccagctggtacatggctatgtgtcattgcccacactgcagtcacatcttggagtgcccttccaccccacagccccatagccccacagccccacacccacctacaaatctcttattcatccttcaaaatcaagctaatatgttatcacctctctgaaactgtccttaaatttcccagggagaggcaacctctccttctctcctctggttttccttcattttatccatgcatttgccatagcatttagtactgtataatcatttaccttctcacttcgagagcttgaattccctaatagcaagtagggagggcttgttacctttacctctactgcctggcaaagggattagtacaacaatgtaaataaataggtcttaaatgagttacaggaaaaaaatgtaggttatacttggaattagctgtctcaactccggaaatggcacattctgtcgctattctccggcatctcccccaacttcacattcccagaatctttggaagagcaaaaactctcatcttcaaagacaattgcttaaaattttccaaggattggagcttctctttcacaatcatttcattggtggggagggtaaagggaggaaggaagaggtcagtttcttttcctgaatgacattatctctaaagactctggaaagtgataagtgccatttagcactcttttatttcaagtgtctatgatgtgaagagtgtttgcttctgcaggctgagcagccccattggagtctaatattagacgtgatataagatgtgcacatctttcacattatgaggctttatgtttcaaacccccataccttgcctctgtgtatttgacagctgctgtcctgcaaggcaatggccagtaagaggcatgattgcactaaattggaagcatgaggcaaaagggtgtgtttttattaggggggcagggaagaaatttgagggtagtaggttagaagaaatcatccacagatgctgatctctgtcggttagtggatgtgatttctgaattgtggtaattcctgtttctgtgacagttcatcaaaaatcgagggcactacttttgaaaattacccatggtttcatttccaaactagatgcagactctgtgcttttgattattagaattattcaactcactctgtggggcaatgaggaggggcattgataaatcctaccccaactgatactctgtaagagattcgttacagaagcatgaggtggcagagcaaactccatcactttttaacaagtgttatctaaacacacagtggcaaccgatgagtgagccaaagtgacaatttggaaattcatttctctccttcagaaagtctgtgtgggttgggaacagtagaactaaaagatgtggagacaaacttttttctacttttattaagcatttctagatgaattgtgaaaggcaactcagcagatgtctactggcatctctctttccccaaagacttcttttaaagtcatataaaacacttctcataccagcttgccaatgggtgaggaggagacaatacttcaaaaacttttcatggttaacaccagattgatagttcctttagcaaagctaaatcttgaaagctgtttttctttcattctaccaagaactggctcaggttgagtcccagcttttcttcagggatatgggaacactcagatgggaactgtgtagatggaagaagtgtggaaagggagagatgagtgtacattggctacgtctagtgcagggaaatcatttctccactggtctcacgtacagctggccaccctcctgatcttgctaaaggggcatataagtgccattgttaagagatggggcttaaaatgtaagaggagtttcaagagaagtgagctgcagatccacataggaacatgtcaggaattatttaagtggccggtaatatgagtatcatgctaccaacactgaacagtttatcacataaatataattgtcttctttgagaagaataataaaagctgactccatatgttacatattatttaaaattgttcctgcaagatgtattagtcccagagaagaagcaattcttctaccagaggacaacagcagttttattgtataacattgtcatttgtttaatttgtttgttcccagtagtagttttacagatttttacgaactgttacttttatagaaagttgagttactcatgatggatattgctggcattcgtaaagacaaaaatggggggggtggaagaggtcagaaaggtagatggtgtggatttccctaatgaaatttgcttaagccaatgcttctgaattcttagagaaaccaaaaattactgtagggagttaggttctgtttgggacatttctaagatttttgtgtgagtttatttaaacatgatcaagttaaactcagtctggaagacctcttgtgaactgacaaacaactacttttattcagaaataattgtgagtaaatgggagttctccgaggttttatgtttttgtatttgaaccaattaccaaagaatactaattttatagttcaatgtctactaccaatttttaggcattttattggttaagaaaaccagtttcctctgtcatttctcacaatttcaactaaactttactttttagctaaattaagtgaaacttttctaggtaaatttggaaattttggaattttaaaatggaaacattttagtttgcattctcctttgactgatagatttaatatataccgaatgagaaaatgccacccaagagtaaccattcatgttttttgaactgttaaaatgcattctattgcagtttcacaacactgaaagcaagtgtctaaaattaccgaaataaagctgtcccaacagggtagatgaaaaactggccagataatcagcagtaaagaccaatcttctttgatatcaaggtatctagacattcacaatttgttcatttgtagcattctggcagacttaaaactctagacgagaatagccatgctattgcaatataatctggataattagagcatttagaaatccgacaataggccatgtgcggtggctcatgcctgtaatatcagcactttgggaggccaaggtgggtggatcacttgaggttaggagttcgagaccagcctggccaacatggtgaaaccctatctctactaaaaatacaaaaattagctgggcgtggtggcaggcacctgtaatcccagctactagggaggctgagacaagaattgcttgaacccccaggaggcggaggttgcagtgatccaagatcatgccactgcactcaagtctgggcaacagaacaagactctgtcaaaaaacaacaacaacaacaacaacaatatagaaatataatacatatctacaaaagccaattgaagtcaaactggaattctgcaaagcaatctttatgaatgtgagtaagttaggtcatattaggttggtgcaaaaataattgcagtttggccattatgtttgcaccaacataatacatcttttattctcagtgcaagatttttgatctacatttctgaatagcttggaaaataaagtatggtcacatcagaaccagtggcaggtaaaatttctaattataaattggctcaaatgatttatatttgactttggaatgtcttgctaatatcttcgtacatgtattttactttttgctgttaaaacattttctaaacatactgataaagactagagagatggatcagaaacatactgggtgttaaaaaatcatcccgaggtttaaaatgttctttctaaatttagataaacgcaagataaatcccacaggaagttcacaattccatagatgtctaaaactaaaagaatgcagagattttctcagctccatgccgtttcttgtaattgtatgttgactgagtagagagttataaaaacaccccagcctgattttatgcaactatattgctgtttgtcaaaagaatacttaaaaacttgtcaaaagaatatttacaaactatatttaagaatatttaaataactgctataaaatttaaataatacaaaaatatacaaagaaaaattacatcatctagtcatttcataaataaacacatacataaatatacacataaataaatatcttaatatttagtgaacaacaccattctagatggccctatgtgttggtgtagagagattgatagagatgaatagtcagataaaaatatgattctgccacagtggttattccttagcaaaaatgttttatgtttagttctacttgaattttaagaagaaaaagaaattaaatgaacttgaaaaatgactgaacttcaaataaatgtttatttgacccaagaaatattagcttctgaaagaagtgtttttaataaaaagtgtttttattttagaccaaatctttctcattgatgaggaaattagtacaattattcttccttccagatagtcttccaagttatttaggattttattattgaaaatgttatattatttacatttataagtatatccccaatattgtttggtcttattctatgctgcacaggaaatatgttcacccctttgttattttaccaagttttctctgtaagggaaagtgccttgctgtaattttgtgtttattagatttaagcattcagttacttttccagaaagaatcatggttaggctactctctagtttctgaatgtttcacagtgtctgcaaatggtcttatactggaagagcatgtcacggtataaaataatatatctatatttaaatttctctaaattttgcacactttttcatgtagcactcagtgttgctgtgaagttctctgaggtcattcctcccaccaccacccccttggttagtatgatttacctgtgctgcctggaacaccatatggctatatttttaattcctaaattttaatagctacactaggatttgttagattaattgttctatgtcaaattttcctgggactaagtgtgtcactttagtaaggaaatttaagtccttctgtattttcaaaacttttcttctattacatctttaatttttttttctgtggcatttgctctattctcttcttcaagagaactagtcctatttttcttgtgtactgtaatcacttttatcaatatactaaaactattcatagacatattttatgtctttaatctttttcttttcattttatataatttcttctagtttgtataccattctgtgttttcagtcatgcatattttattttgcttctactttgacatttatagggatttgttaattccactaatttcctgagctctacccactgcttttcatctttttgaatacttatagttctttttaaatactctttccattgcataatatgtaaatattttttttttaactataggttaactatttgtctgaattccactggtttcttgaataattcatcttctgatgtatagcccttcttcctttttacttgggtctaattgatgatttcatgctgtttctgtaattagctactttttcttgaaaaaggccatttactcaattactctaattcttgattagggcaattttactcaatctcaatctctcaatctctcaatctctctctctctctttctctcctcctccatccctctccctttcctccctccaacacagctctgtgtgtcagaatctagaaatttctgtttcctcttcctccttcatgcaacttcctctttggcactgttcctatgtgatgatcctgaggaatggacaataaaatgattttgccttcagtaccacctcccttgactttctgcagcatgaaatttctaggtcatttccttactcataggatacagccattcccatgtcctgatactctaatcagattgtcagatattactcttgaaactgtaaccctttaaaggaaacctctttcatctgccatttttgaagtttgtgttgactctcagattcttccctcatcttggtgcagacttcgatttctatttttacagtatttcacagtacatatgactgtgtatggtttgatgctatggctatttttgttttactaaagattgaagggttgtattgttagtgtggtggctctctacttttcagggtttgttgttttgggaatgttttgaaagaaattagttctgatgcttttcactagaaataatctatgacctgagctcttgtggactcctaaagtttgtgccactgtgtttcggtcttacttcaaacattacttttaaaaaaaagcctctttctattgaattatttcaaacaaatcaaatatattatgtttcctgaataccccttgctttagttggcttttcccttcccataatgaaggatgaggaccttcctttcctttgtcttctgtctttcacagtcgtttctggaataccagcccttctatcagaactggatggagacctgtggacacccctagtaagctgcagatttttcacagtggtcatttgacctccagagcaagccaataatttgtcacttcattaaactggtatttatatttattaagttttttgagatacaatccctagtattgagtgatagaagagcagaaaagaagtctactgttgttagcacctcaactaactgaacccattaaatcaaaagcctttctcttaactggactcaccttccttagaagacgatttaacaatgttttctttctgctcaaggataatcatttagaattttagccctcttccttctttccaaacagcttatcaaagaaggctatgtaattgtccccctaacagaagttctaataatataaattcctcccactcattagatttcagttatgttttacaatcccttttggacaggagctctgggaagccaatggcacctgctgtctacccctccatctaactttcttccctttactacattctggagaagccatctcagttgctctaagtacttatgtatttgccttttcctaatattggagaaaatttaagctttctatttttttaatggcatactccactgcatcccaatttgcttttgtgagtagaagagacaggtgtaaatttttcttttaatttttactttaagttccaggagacatgtgcagaacgtgaggtttgctgcataggtatacatgtgccatggtggtttgctgcatttaatgacctgtcctctaagttccctccccttgctccccacccctaacaagccctggtgggtgtcgttcccttccctgtgtccatgtgttctcatttcaactcccacttacgagtaagaacatgcagtgtttggttttctcttcctgtgttagtttgctgaggatgatggcttccggcttcatccatgtccctgcaaagaacgtgatctcattcctttttgcggctgcatagtatcccatggaaatttttagctagttaaattgacttgtatacactctgggcatgcccaccaggaattctcccacaaataaacatcccctgtactgtgttaagcaataaatgattctggaacctgttcttttctgcccagtttaaaccctctgctttttggattgggcaagttttctatactctttaataaatttgttttcatatttgttgtcaaccagctgacagtttctctgccctttttataacctacttcctgattcaagacattgggtcaagacttttaaaaggccttgacttcccttttgctgattcctcttcattatttcacctattaaactaggcatgaaaaaaactcaccattgggccctcttgcctacccactactccctcagaaaacttgcagagttcaagcatcacttgcaatcaaattattctcatacctgcatttctaacccttagtttcctcctttcaacatatcattagaagtgtgattttcattgcctaaatatatacttccacttaagtagtcactggtcactggaatgatagagaaattttatctttgctccaagagatctacttcttctccatgtactctactgcttatagaaattgactgcatttcctttccaaaggtgacaagtttaagtcatttctaatacctgctttttgtctgtctcaaccacaactttaatagcatttcttgaacacaggcatcacactgtggactttatttatgttatctcatttagtaatcacagaatacaaagaagtagacattattatctcagttgttctggtaaggaaactgaggcttagtgaggttaacttactcaaaggccccatctagtttgtgacagagccaacattcaagtctagggttgatggactctaaagtcaatgtgctcttagccactttgcatatcattgccttaaacccatccctctttaggtctagggtaggcttcttgagtctgcagctactctcttttcaacaaacatcaatcaaatggctatgatatcccagacccaaggtaacaatataaagatgggtaggatgaggttcctgttcaaaagacttttggagctagggaaaaacagaagcactaaagcttggaagtaattttatccattaaacataaagtgaaactgttaaaaaattaaaattaaactcatataaataggtgaaatgtattttttcaggtatttattactttatgtgtgtaacttaacaactcagcaagaccgattttggcagaaaggtgtggcttatatgattctagaatatagaatacagtatgaaacaggatacttgacttgcacagaaaaatatcagtgaagatagtaaggattaaaactcattttgtatttgctccatgaagcagtcactgctttctagtgcccttgattcacctgaatgtccataccccagctgtttagctcatttccatgtgcatgccccatttctccttcttgagagaaaacaccatcttttaaatattttcttaatttttcacaatctgttttccagagtggatggcaatgctaacaggcaaaatttctgtttctctttaatttccaattaaaaagtagctcagaaacacttagcatacacttttgctctgttttcttcatagtattacagcacaaagctaccttgtttagttgtcctgtctgtctctctccatgagcagaaggatcttgcagtctcactcaccactatatcctcaaagactgacgccatgataggagtttaataactgctgtgtgagtatagggataaatgaaaagatttgggacaacagccactttagccctcactcctgtcctccaggtcactcctctcttgaccactgcataaaggacatcaggcctcagctgcctggccccttcttttcctcacccccaaccatccattcctcctgggtatctttatggaatctaagtgctgattagaaatccttccagaatcgccttctataatgtttctgttttattatctttatttttctagtagactacaagatacttgaaggcagggtgtgtcttttattttgtcactaacagcatctagtatattacttgggccttcactagatgttgttccagtggatatttgttattgaatgttttttattaattggcaaaaaattaagtttggatgtgtgccatgtatagctgcacattttttatcaagtggtgagtattcttgttgccgctgcttcaaagacttagtaattaatacatgtatctttgctctctctctctctcttgattcagtacctattgcagatgatagcctcatttgagaaacacagattttctttttatcatttatttcctacccaggagttatttcttcataaaaaattagtcatccaatccaggtcctagtgagaactacatgagtttgggatatcatgtgcatataggagctaaaaatatatatattgtaaatttccaaaagtatacatttggtgcttaactcactattcacagttactttattatttttcctactaatcctttccaactaacttctatccagaggatccacttccccaatcgatgtgattttgctttctatttttcagtaaaattttcaaaacatatgcattaaatataatattagattgtgacagtcagaccattcatttcatttctaggcacaaaacaacatttgcttaaaaatgtggatcctggaatcacagtggtttggggtaaattcatgccatgctgtgcaaaagtggcacagccttgaattggttaaaatacttcagggctctgcttcctcaactataaaataagactaataatacttcctaatttataaagttttaatatgaaacccaagtgaaatagatgactattattattgttattattatgcaagtgtttctgggataagttggttttttttgtttgttcttttttttttttctttttttttttagagaaagtcttgctcttgtcccccaggctggagtgcaatggcacgatctcggctcacgcaacctccgcctctcaggttcaagcgattctcctgcctcagcctcctgagtagctgggattacaggtgcctgccgccatgcctggctaatttttgtatttttagtagagacggggtttcaccatgttggccaggctggtctcgaactcctgacctcaggtgatccgcctgcctcagcctcccaaagtgctgggattagaggtgtgagccactgcacctggctgggataagatttttataactctattttgagaaggatttttgtctgaagaaactcacttttatcactttattttgcccaaataaagcactatagtccatatctctgtttcaaatattatttattaaattcaatgtttcctggataatatgccctttctgaatgacagtcaaatgccattcagtaattccctcatttttttctgccaatcctaatatatcctcatttgtttataaacaattcatttttaaaattatactctcatataataagtgaagtgtctttattttgttcagatatttattactttatatgtgtttaacttcataactcagcaagaaattatagcatcattttggaaaatctccagtcaaactctgatctttgcctataatgtatctggttttatttaactgaaatgggagaattgaatacttttaggtttttctgctattcttagttgactatttgactttagttgtgtcgttctgtaagaaaccttgacaagttaaatttatccatacagaaacctatagttaggagacctgtgagatgactataatttccttcccattagtttcaatgaattccatgcatgtgaaagagaattggagagtggagtctgcagccctgtgtttctcgttgtgcaggtatattgaggagggagatatagtccaggtctccttaagttgttcctctgctgcacattacccttaatcctcctttgagcaaatgcagactagagcagctatgccaagaagagaagacttaactctttaaacacaaggggcccttggacacttagcttatgcttcatacaaaacctgtgaaatggttaatatagaaatgtgagtgtcatttgtattgtagccaatatgaaccagaagaattgagctgtagccagcatttatttaagcatcatttttgccatctggattcttttgtggggaaagaaccattcgaagggaattgcctttggttacaaaggtgatttgacttttctctctatttatatgtgcaccatcccactggcaccgttgttcaaggttccataaagagacacttttgttctactgctgcttgagagtttaggtagcataggagagcctgaagaagatgtgggaaagcgtatcaaacatttttgtggacaaattggattcataaaggacattggcctgtatgtggaaaaaccaactaaataatttaatccaggtaaaaattatgcagccattcactcacacaggactcattggcgtcttccctaaaatacaagtcacttgatgtggcaaatcatttgtaggtcagtgttcaaacccaaatgcttgttggacacctacctgtcagctggtttaggtactgattcaatccattccttagcaatgaacctgtaaacaaaaaatggctatcacccaggaatcataatttctaattacctttgacctgtggcaaagtacaataatttaaagatgatagtgagcctctattacacaaatgttttgaagattaaaacttgagaagattggcattcacatctgggaattataaattttattttgatgttagaagaaaggcttttacatgagtatgatctgatatattttattgttaggtttataggattcagaatccgtggttattttatgattatgtgatcaggtaatttttatcttatctgagagctctttcataatactgcattaattaaatcgctcatctgaataaggagtttaaatggtacagtgggcaatgaagtaaaatctgtagaattcccagccatagcacatattattttaaactatattagagataaaactatttattgagtgctaacttctgcagagccttatcttaaatacccctagaatatataaaagaaacactcacaagtaaaggtcttttaaaccaacaataaagtaatagatcaacaaatgcaaaataatataatctgtgcaaaatatttatgtgccattcacatacacgttacaaaaatgattgaaatggaaatgaaaattattggtattctaagtattcatccccttatactattaattggaaactgatatattatttaactcttaagcagaaatgtgtgatgtttaaaaataaacagcaaattatgaagtcacaaggtaagtgttaaaatacatatatatgtgtgtgcatgtgtgtgcgtgtgtagatgtattaatctcatcattaaaaggaggaaaaaagagcctttaaagtttccattatccattatgtcaggtagcaaatatcttctcaatgtaactccagacattaaatctgtcgagaggaatgctgtaaaataaatgtctgggataccttcataaacaaaaatcttatttccataattcatacagctggctggcatttattggcacgtcaggtgcaatggggacatttcaggaacattaacatgtacagcatcatttgtcaacaaagcaacaatgtaagcaaatcgttcagaactcatacagatttacagctttctccgccagctgctaattacggtgtgctcggcctatttggtatggtctttttattggaaaatgacaaaggggttatagtatcccagtttggaatatagatgtggcttttagtaataatatgaatgtaatatgacgatgtagcttggagttgtgatccagttttcctggtcttataattgatcagctttgattgatgaaggacaagagaaattcacagcctattttgtttctgatgtaactaacctctaaaacaaaggaaaaataggggaaaaattatcaaagaccatgtcacagcagttcttaatgtttttccctatggaacatgacacataatatttacctctcaaagaaaatctgatatgttgattgctggtggagcaaatgttacaggagcctgtacatttcagaattctacgttgtactttgaacaatcagaaaggccttacacaaatatgcttaaataatgttaaggttatgacagaaggtgacaaatgtcagcagcatcaaagttaacatctataatcaccccctgcttacattgttcagttttaggaaaagacacaaccgtacaagcaaatgatggagtgtcaactctaccttcaaattccctggattgtgtcaaggcatattataatccataaaatgaagagtggtgctgtctttgtgcccatgatgtaaatctgtatttagagatggtccttctgtttaaccaaaatgcaaaaagctaaattggtaaatacttattcgaacattgtttagatttatcccatcccaaaccttattaaaatccattaaattccagagtgaaccgatttgacattcagcaaatcagttgctgtcagagcagctgacttgaccagatattaaaatattttcaactttgctggcatcagatcctcggcccttcctagagctgataatgtcaggacagcaatggttgactggatccaaaatgcattatactaaataagtatcattctcatgttccaaaaataaagattctaactccagaaatagtttgcagatagtgtccttctattttacgtaatgccccgtggaatcctgtaccatcttcgcttacacatttgtcattatgtattgtaattgttggtttcttcctcctccactagaataggattcctaaaatcagcaagtaaattatgtttaattttgtaccctcagagcctagtactacctggaatatagtagatgccaaattaagactagtcaaaagaatgaataaatgtgtacatattggggcagccctgcatgagattgtgatggaggaggaatttgctttaatatcttgcccactcatcctttcttgaggataccgtctcctaagtcctctgagatgcatatttcccatatacttttttctttgtcccttattctaaaacctacttgcagaagagtatctgaaactcataaacattaagatgtaaaatataaacaatcttccaaagtattgtcttttccaggggcatttatattcaaaccaagatccatcccttaaactgaaattgaaaattaatttgagggtattagacattattttttatgtaaagaaacatttttacagtgaaggtaccatcttggttttctttagtagaaaggcactcactcaacttttccccaaaccacccttgcttggtgctaaatggagatggtgttggttctattctccaggattatgtggcatgtagattctactaggaattgaaatgaagaccttagaatggaaatgtggcctagctaaggaagaatactatgattttaatttgcattaacatgaagtccttctagactgagtcaatatgaagagaaccatctagtgcatcagaacagagccttttcaacccatattattgtctttgtgaagcaaaacgtgctgctggaattaaaaacaagcaaaaggttgtattttttactgttcaaagaatgctaaaactttcaatgcataacaaccccagagaaacagggttgatggaatcagagaagttggaggacagacaccttaaatttaaaattgaatacttgtgaagagttgcaactcatagtctgcctttaaaatatagctgggcaaggaggtcttgtgtcaccctatatgatgatcacttcaaattggttttaaatttacaacaattatttgaataaaagccactatttccaaagccacccatttgcctaaaataatctctgaaagtaagttatttatatatatttatttataaactagcatttgtattaacccttacccaaatggttatccttacttgtatttaaaaccactaagtcagtgctttagaatagtctatgttaatctttacaaataattcatgttgcgctaattaatgattcatacatacttgagagagaatggattgatgtttacctgttcattatgcaaaaagtcttcacagaaaatatttccaaaattccaggaacattttaagtgtttttaattattttagaggtatctatgtatcttcacaaaagtaatattctaactataaatccctcataactaatcatttattcagaccctctaaggaccttcactaagaaccatttattatcctcaataatacataagaatcctattttaaatgatctcaaagttgactacaatttgtatttctcactaatttaaacaggcctctcctattcttgtcctcttcctacccctccctcaagcttcccatggtaatacatggctactaactggattgaaagcataaatgatatgaagcagagttttgagaatttgtaattcagaaaatatggcaaaatctaggaattctcatattttaatatcactattagttgatttgcttaaatgcaaaatattataataaagaaataaaaatataaaatttgtattttataagagcaatactaaaattacaatttaggatgcataatatgtatatatttaagcctatagatctcaatacaaatgcaactgaatgtagaaagtctacctttaatccagtttatgaggaaatgtcttaacgtcacctttctaggagaaagcaagagaccaatcatgagaaccatttagtccagcaatctctcaagatgccagtcgccagcttgatggagtgagcatttaattagcctagtaattccctcctattgttcccttctcaactctaattgaagagagaccttaatctcaaaggagaaatatttaacttttaaaaatgtcacagaaaggtggaaagtaactgttttgttaagtaaatagcatttactcacatgagaaaataacttttaaacaaatattttatgtttgtttcttaaggtctgtagtaaaacaaaaacaatttcaagcaaacaaacctgagagctcaatatcaacagattcttttgaaaaggaattatcaattgctgctgccataacaaaacacttaagactgggtaatttataaagagcagaagtttattccctcacagttctgggatctgggaagtccaagatcaagatactagcatctagtgagggtcctcttgccatgtactcacctgtcagaaggcagaagaacaagagagagtgggcctactcctgcaaaccctttttgtagtggcattaatccattcatgagggcaaagcctttatgacctaaactcctccccaaagtctccaccttccaacactgttgcattgagggttgtttccaacaatgaattttacaggacacatacagaccatagcagttattataaggacatatttcaagaataagctacattatcccagcaggagtgtctgaaatgcatgaagttaaggctaacaaagaacatctaaactaataggtaaatccaaagaaactccatgaaacaaggaagtctcatttgtgtggtgtaaaataaaagtctagatacggatcaaatcttggtcaaaaatagcatcaaatgtggctaaaggagtgatcaaagttaaaaacttcaaatgcctttagtatttctggaagtaaagacttcagttgtattaagtgaaatacacgtgttaaaattccgaggccatcatgctatgttacacagatggtcaccatccgctgtaaggtggctaaagggaaagaggtgagtagctggcttggggtagccacccaatagggctagccacccaataggtatatagccacattataccttacccctttactatgcctggcctgatctactgcagcaatgagctgttcactctttttgggctgggctcagtagttcacacctgtaatagcagcattttgggaagctgaggcgggagggtcacttgaagccaggagttcaagatcagcctggacagcaaagcaaaacccccatctccgtaaaaacatgaaaaataaagaattttaattatccaggcatggtgtacgccttcagtcccagctactcaggaggctgaagtgagaggatcacttaagttcaggagtttgaggctgccatgagctatgatcgcaccactgcactccatcctcggagacagcaagaccttatcttaaaaaataagttggttttttttttttaaaaaaaactaagttttattttattttttgaagttagaaagtatgcaacttgtctgtgggagacaaaaactctgagaaatatattaaacattggaaaggaagggagagtaggggtacattgttcagggttgcaaagtgaagttgagagtcttaaatagagggaggcctatgtactttcttaaaatcaaaccaacagcaaataggaacacaagcaatagattctggaagaattgtttgctatggagtaaatcatgtatttgtctattcaccaaatgctatatacctagatgcttctacaaggaagaacaaaaaaccatgttaatgaactcagacatttgaatagtgttgttgctgtccatagatgagagctttaatagtgttgttgctgtccatagatgagagcctaagcagttttcctaccagcaaagaataatgtaccttgagaaagatgtgtgaacatgtaagttcctattaatgcacatttatcacaaaaattaatctgagcataagcaatgggcaatgtgagtgttgaggatcgcttgaaatcaggagttcgagaccagcctgagtagcaaagcaagacccctacccccgccatctacacagaaaaaaaaattaatggtaactaaaacacaacgaaaatattgtcaatcagaaacaaataatacatgagaaagaaacgaagccataactaccaaaaccagaaatgtatgtctcagagaccagaaaacacttttgatccaaaattaaatatccaatattttcacacagttagaattcatcttatatttctagtctaatctatgcttgacgctttccattgctactgggtgacacggatcacttttctctaattttgttttcagttttgctatttcttatattgtgtatctgcctccatgagttttaaatggctaaattatttgcttagaattcaggtgtttttcttaacagattatttctagctgaagctgtttctgtcacatattgttgaattccaaatgcccccctaaaacataaccataaaagtaatttctttcctatcctcatcaacacttcagatagttaatagctgcgggcacatgttataaaagaagttgctgaagaagggaacttgaagtgaatttggcatagagtcatggatggtactaaacacatggatgaagttatttacttaaaatttttcttgtcggcctgatttggctatattttcaaaattgacacatactatgctgtagacttctattttcactagctgagaaacagaatgattacagacttttgcatgttatgcatttttaaatatcaccaagttaaacttagattttgattccgtgcccaggaccaagtggaaaaaaatctccatcttcaatagttcctattatcttttagtcacagggccacatactgtatttcttccatgagtaaaactcccacttggaattccaagcattgcataactagtggagtattcatatcatatataactcagtaggccttcatatcctaatcagctatttcatctgcacaatattcttcttagcagttaaaaatcttaaaatcatagttcagaatggagccaacatttaattcagccaacaaatatttattaaacacctacttctactactggtgttacaaccatgactactactttacatagttttgtattgctttaaattgtttttacaaacctcatctcatttactacagtgaaattacctactgctttgaaggagcttagagactcataaagtagattaaatcaattgtcagaaaaactgggctttaaagaacttgtctacgatggtaccggctactgtagtattttagatgattttggtgaactctcagttgattttaggtaaaagattcatctgcacaaatgtatatttatctttcattgtattttttattacaatctaatattttttaaaagctaagaaaatgcaatgaaaataacattttaaaaagtgtcagctatatgaatgatattctttaatgcatgtcacatttaaaatatgacctatttttaaagtacattgtatatgtcacaagccagatttggtcacaggccatggtttgctaatctctgtcctaaagcaatatggtagttctgaacgtttggctgaagaacatggatggcggtagaagtccctaaactggtcttcatagcttagaataacagaactgctgagtttgaaggaaaccgaacaacttatctcacttactctccaaacactgttcaatttctcttcatacttttttttacaatgtggtagtctctatatttatatttgattcaaaatataatgttttaaaacggcctgtactgatgtctcttcaaaatctttatcttgcttaatcttagaaactttcttgccaaggagtgtaggagtagacatgatagcaagggaaaggtaatagaataaattttgaaagctaaatgctttattttgatatagctaatattcatagaccttaacatttacattagtcagcaatcaaccaaaagtcatagtttcaaatacacgagggcagaatctgcctagctacacaggatttgaccacttaaaagttgagctctatgattattctgatgaagtggattggagaccatcacctttctcttagtaaatatttgtccttcacataccaatcgtaagtataattaagcattttttacttcatctggtgcttcaaattttgtatgatgcaggatttagttttctattctaattcctaaaagccatatttcaggctgcattctattaggggtgtctcacttaaaataagaatactattatgtagcttaacttgcatctatttcctttttattatggccactcaattgttcctgactttctttgggaatgatttgttaattttattccagtctcagctatgtgccttcacttaacaatgaacattgactactggatacttagcttaccttttttacaagatatatatttcaaggttttgttttcatataacataaaacagtaaggcattcattaatcactattaaattcattcttttcctctttattgaattctaaaggaaaatcagctagtcttttttttggcatgtgtcagcaaaagtatgttattatgaggtgttcttaaataatatatcttcataaaacaatataggtggaggtttaaggagaaataaggaaagaaattggaaccatctggatatccaaagtagagaaaagtttttactaatggttgtcatgtacacgttacaaaaataacattatacagctttctaactggacaggaaaaggcagaactatcaaaaagttgaaaaagaagatagccctggagtgaagcaattgacaaataaaatcatttataagacatgcatttagaagaaaagtggagattcatggttcttgggtcagtaaggattaaacatatctcagagatgacctgcttgttcctgggaatcgaaatacagttgcattccaaaaaggatggctccctgggaaatgcaaggaggggaggacaggagggaacagatttttgttgttgttgtttttgtttgtttgcttgttttcagggatgagtgggaaagcaccttctatgtacttgctcctaaatcagcctggtgaactgggaagagtagagattccatgaaagaaaagaatgtgaatacatgctttggagataagacagaaaatgggagaaaaagcaaagaaggaaagaaggaagggagggaggaagaaaagagagattctccagagacacactgcactccctcacatgtaaatgttatattaaagaagcaatatcactggaaattcacttcatcagatatttaagtattaatacataaattagaaatcaattttaggagtgttattcctccaatacaaacatttttttctggcttttcatctccttgtcatattcccagcaaataaccacacagacggggtgtgtgtctctccttaaatgagattagtgaaggtggcccgatcaattatttttaagcctgaccaaataggcgtactctaatcttgcctatttcagcataatgttgcccagcatgataaaatacttatttaaacaggtgtatcagtctcagagatctgtatgtatagtttaccttgaagtcaattgaaaacagaatattccttattgattttgcctgcctggctgctatatgtagtcaatgggactcacgtggatgtaaatagagtgaatcaactccttgctggccctggacctccttgagtcatgtgaagtaggtttctgattcctttatgttcaggcacagccagggagacaagagtactactgtcttctgctggtgcagagagttacctcaggctatgcaggaaaaatccttttttcttatttttagacctgaatcagtctatgccactaaatgtattcttgtgaatacagatgcactttgttgtcatgctcgtgggaaggcaatggagtaacctgtttggacgcagctgcaggccacctgtagagaaagtcaaattagggagagaccccactgttctttgcattaatgctttttgtattgttgtttgacttttccccctctgtcgatgtatctttttcaactagggagatcgggagcacattttaaggccttctgtccctttaaggcatctaatgattgaaaggactctaagatttgaaaggctgtaaaaactccccagttggcaatgaatgatggcaatacaaagaatcttaaagctgttgaagttgaagtagtcttcttacagatttagtttgtttggtgaacttccagcggcagctcttacaaggtactgttcaaatattcccacctatctgtgctgctgctccttctaaagatttatcatgttctcagtggaaaagtagttatccatattagcagttaactttactacagataagaaacaaaagaaattctaaaagaagaagaataaactcctcttcttcctttcctcatctaccaatgtgaagctctaaaaaagaagcccataaatgaaatatctactttagccataaatattaagggagggaaatgcacaaataaaacttgtttctggaaagcttgattttggctgaatatcaaaaaccatttcctgacaatgaaatccattagactacgaaataatctctcaaagtagtggttgcattgcttataagatttaacatttaaggttaggctgaagacagccacagatcctcaggctcaaatgcagaatgttatttcagaagttggagggacctactcttttgatcctagctgtttctcttgttttgggttcctttacttggaaattcaggttataatatagggttttatattaattttttggtgtcctccaccatggatccttgagagctgtttcagctgactgggatcgaatcacatgaaccagcctgactgtgtttgtgtgtgtgcactgttcttcacgcatctgaagcagaggagtcgtcacaattattctaaatgcagttagaggattctgtctgcctcagctttacaatgtttatcaagctcctgtattaactcagtaacacaacctgccattacaaaattcaaacttttgataaccagcatttcaccaatatgaatttatttatacaagatgccctttcagagaacatattatatctaggtagtgactgagaggttccctaatcaattcttcaagatgcagcttcagtaccttagtcctgaggaccatgactaaattcatttgatacatgtatgttatatattccactaaaatcaaagaagatatgatagaatttgttgcaactaaatagtggcactcagacaactttaattctcaaattcttggcacgcatcctgaaaactcgactctgcgctttctcctaaatgctctgctctcttttgctttattgtagtgaagaaaagagaaaagtaatgataataccgtgcatagcataatattttacagggtttttttgttttgttttgttttgtttttgtttttgttttttgagacagtctcactctgtcgctcaggctggagggcaatagagcaatctcagctcactgcaacctccacctcccaggttcaagtgattctcatgcctcagcctcctgagtagctaggattacagatatgcaccaccatgcctggctaagttttgtatttttagtagagacgggattttaccatgttggccaggtgggtcttgaactcctgctttggcctcccaaagtgctgggattacagatatgagccactgcacccagccatactttgcatttttacagcttgttttcacctatattttttgactaaatgctcacaacagcccagcaactgaggctgagattaagtgataagattcaggacttgaaggatggagctctgactctaagctctttgctctgtccacctcagcgccatagctgaattctcatatgaagaacatttttcatgtggtattctattctgctgggactgacacataattagcaccttaaactatatatccaggtaaagaattagtcctgtgtcagaaacaaggcatttccagaagcataaagtatagcacctcacaacaaggtagttggaacccagggtcaaaaacaagacagataccccaggggaaaaaaccatgtccctagctaatatccctagcaaatgatccctagctaatcatgatgccaaggtatgctgcctcaggaatcagattcgcggcatttaaagtaagaaatttttgacttccaatgtagggagacagaactgatgggccacagggagccaattgaaacctaccttaaaagcattcacctccaggcatggtggctcatgcctgtaatcccagcactttgggaggcagaggcaggcgaattgcctgagctcaggagttcgcgaacagcctggccaacacggtgaaaccctgtctctactaaaatacaaaaaaaaaaaaaaaaaaaaaaaaaaaattagccaggcatagcggcgtttgcctgtagttccagctacttgggaagctgaggcaggagaattgcttgaaactggcaggcaggggttgcagtgagcggagatggtgccactgcactccaacctgggcgccagagcaagactctgtctcaaaaaaaaaaaaaaaaaaaaaaaaaaaaaaaaaaagccatacatctgtctctttcgctacctgtgttttgaagttgaaatgattttatactacttttatccttggatgctttcttcatagcttaacacaggtattgtttaccaattaaaatgggaagctggtttaaatatcagcaatcatgctacaacagcacaattgaaggagtatttgactcaaagccttggctctcctattcacaaattttgagtggttatttcattgaacttccatttactatcttctaaaatgtggagaatatgaactaataacttttccccagattgttgtgattcttaagtgggatagcgaatgtgagtgctttgttatctgtaatgcactatatcaatattattgttatattttgcttcaatatatttattagcttgctaaaataacttcctaagttatctagctaatcgcctttttaacaccccagtctgatctctgcgtgcactcagctcatatcagagtagttaaaagtaaaatgggaaaacgtgagcaatgtataacaatccttatttcaaccactgtatatagacaactcctattttttgtcagctggtatatgagacatccacatgcaaccataaagcctgtgttgtaaagaagtttttaatgccagaaatcccatatggttttgatgtaactaaaaggtgtacactttcctcaaggtcaagtctaaaaattggaccactacaggctctgaccacatgtatgagaagccaaaggacctgtgatctcacctgcctcaatcatgtgccattatttactccacttgcctcttctgaatgggtatgatcccaaccaaacatagtgaaggggaaagttaaacaatatttggaaagccatgtatttggaaagccaatgtaaaaggtacattatattacatttgatataatgcaacagtaattataactatatatgcaattcgtatctacataagccatgatagtggaggatttcttgaaattactttcttttcccccagtgaaatgtcagttgtttttagttttaagttttgcaaaatttggaacctggttttcttacacactgtaaataattactgcagatacatttcagtcacgctgctctaacttgggagaagaatcagcaccaaaattctatgatgtttcaggtggggcagagtgtgagaagacaactcaaaaagaggctggagagtcttacttagcagaaacctcagctctcacttcttttatggctgtatttcataacacttatcttttgacttagaacatttgccaggaaaactttgattcttagggcaaataaccctgataatttagaacttagagatgtcttatgagtttgcaaacatcaatgcattatcaaaagccctgtgaattattagccatttaaataccagctacctatttttttctgattactgtttcattttaattgctcccatttcctgtcctgaccttaatgtttcagtgaaaagaaggccacccacgagagagagagagagagagagagagacagagagagagatctttcatttgtgaattgcaaagcttcagaggtccgaatttggccagtatgtttgctgcaaagccttggaatgctgttttgcagtttcaaaagtgatcatactcagcttcccagaattttttatgcctggaggatgccacaagaacaagggcagccttgttaacaagttccaatctctcaaaaacaagataggattcggatataaatcatcatttcagctcacaaagccatgttctccaccccactgaagggcttcatttacatctaaaatggttaatactgatctgcaccagaactcctaagtggaggaatgcagctgccatgtgcttagtgactctggggttagggaagaatgacatcaccaaatgtaagcatattatcatgctgacatagaggcaccttgttttctcctctgtggatagagcaaggattgtgttctgtctcttgtttttttccgctcgaagaatacctttccccctcccttcttagcagctgcaatatgaagggctgaaaatgtcacttcaactaatgatgaatgatgcttgacctctggatgggttactcagaattttatgcaattctaaattaatatgaaagatcccaactcaaaggacttcggccgttaagatttgcttcaaggatagatttgtgtaaagcagttagtagctttggggattttgttgctgttgttattgtacttggtgggggactgggagactcgtgctctgtaagcaaggtaaaaggcagaatgtgctaacatttttatgtgttatttttttcctgtgagattaatatctttttctactagaaatattgtcagtaagcagaaccagtttgtgaaaaaaacattctcaaaagggcacaggcccacacgtctttgttgtttttatttgaatataattaattatgtaaagcaatagttagtgtaagattaacaattagtagattctgtcaagtagtcacacggaaattactaactaattgaactactggtcgtctattgtgtcagaaagcagtactgagtgtcattctttttatctttttactttgttgttttcacagatcctcttgtttctaagatgtatgtttcacagccgactaataaataaataaccctggttgtaatttcataacatgcaaaaaggtttgaaataaaaacacctgttttaattagcattatggtttgttcactttaaaaaaagtgataatcctgatgcagttagctgacatttttaaagctttgaatttccatctgtatcttatattatgatgtttcaggattgtcatgagttaattatgttaacttgggaagcattgcttgcatttagaatgaaaaacttcagcttgaatagacagaaaagcagatgctatctttcttgtcaattgctttgttgtgggctgccttgcaagttttcatgtatttctggatctaaaaggaagtgtaaatctctatttattttaagtttaacataaactacacaatttcagtattcttctgttttggctgtatgtgtcttgtgtatctttacatgtgtagctttcctgcccccaaattcagaaatccacagtcaaattatctcttctttaattcttaatttgttttgttgtgcctaggcattatggagattagtacataataaaatttaagaataggacaactctactggctcaattctctctctagttatttttttctaccacctttttgcttttgtacatcaaccttttaaatggtacaaaatacatgcagcatctgggcacaacaaggcatgttaagaatggagtaggcactctaagtaggaatttccatgcttttgtgagtttaatgttcctttaacatagagagcagctgtgtttatgtcaataattacacattgggataaatgcgtgtacatgtttttctttatgggattaaggatgttaggtatggccttacacaaaagattcttgtccctcccatacccacccaaaaagtttctataaaattcaaaaccaagttacactgttctgagattctgaaatatttctctaggcatttgcacttctagatttcaactgacagaatatgggattgatgtgtttgtaatcttctctttgcccccccacctcatacccattctccactcttcactaccctgttcggtacccaggatctgtatgcactcgccttccaacaggcttccaactagattgggccaacgagaggcatctgcagcagaacagagggcaggagacaatgcaagaatgccaggactgtgaatgcttaatccctgaattggtgccatgagcaataaatgctcgtgctcaaaagaaagtgagatcaaggaaaagtggatcactctaggcagaacttctgggataaacaatcttcctttgggctttaaagaagtggtgggattgggccataggaggtgggtgggtatgatagcttaggtcaagaatgagcaagaaccacagtatggttcttgcttgggaatatcgagtatactagtataatgggcccagatgctcaggtctgaatgaggtcaaattttaagactgaatggcaggttgtggcctggaaaaagaggcctcgaatgatggaattagaaaacttagtgtttaaaatgtatggtgaaggtgtgttcagtatataaatccaatctgtaagtgatatggaaagtggaagtttattcaatgccttatcacatattcaaatgaacgtatggctgctctaccacttaaaaatagctctgttcattaaaggaaatgtaacctagattttcagaaaattaaaatacaatgttcttaagtcagtttaaactttaactgagattcatagtttggttctgccttcctaagcatttggactaaggcagagagtataaatctgatgggtcatcttcctgaccaatcgactttccattttgattgcaaacaatccacttgtttatttagatacaaccactgaaccaagtcatttagacacaaacattgaacaacaacccatgtgtttcattcctctcaactttaggtgtattttgcctcataaaatgtacggcattgtaattgttattaattagctacacatcaaagagcttgggttagcagtgggccatgatggcctgaatcacaaagtgtgacttgttcagtgtatttatttatttatttatttatttatttgagacagtctcactctgtcacccagggtacagtgcagtggtgtgatctcggctcactgcagcctctgcctcctggattcaagcaattctcctgtttcagcctcccgagtagctgggactacaggcacgcaccatcatgtccggctaatttttgtatttttagtagagacggggttttgccatgttgtccaggctggtctcgaactcctcacctcaagtgatccaaccaccttggcctcccaaagttctaggattacaggcgtgagccactgcacctggccttttacagtgtatgtaagactaacactactcctctagaaacaaggctgtataccgtaatggaatttaccttcccaaccaagctgatttgtttagatgctgatcattggaaataaattattaatccaggaactcatgttgtttgttagtttttttaatgtaatggtttgaagcaggctgcttatgagcctcgtgtaaaaatgattctgttattagttccagggcataaacttgaatgacactttttcccttcttgctctatatgttgctatacaactgttttcatcccttattgttttaggtggttttgcaaaataatttgtgagataaatcagggttggaatgttagccttgacactaacttcttgtatgaattcgagcaagttatttaatttctctggtccttagttcctcacttataaaatccgtgaatactaccttgctttgttactatgaaaatgacataagatcatgcagataaagtaccaagcacagcggctggcacatgacaggtgttaagttaatggtcttgtcgtctttgttgttacagttgttgttattattactcaactttcacttctatgctgataattttcaaatttgtctgtccagtctttatctctttaccaagctccatagtccaaagtccaaatatctacttagcatcaccaaacaaaagtgtcaatagcatcccccaaccaaactcattctcccaggcatctttttatcaaaaaacaaactgaacaaattaaaaatcctagctactctttctcaagtattacatgtaagataacttgcataactagctacaaacaatagttttctttggttcattccccctttaccacccctatgttcattaaatggatggcctcacatggccttttcgttgcatttctacaaatactatttagttctggccttcatggtatcttgctgggctgtttccagggtcttctaactaatttgcatattcctacttctcacctctcaaatgcattattctatttcctacagatttatcttcgtgaaatacagtctggatatttcctcatacaaacttttgacaattctttcacatctaacagagaccatttaatctattagcataacagttacacttttccctggcttccaagctaagttctcattacatttcatcattcacctttgcactggtcataatgaagcctcttgccaatatcaaattttgatccatttcatacctctttgctagaacagtggtcctcagagtttaacatgcatcaaaatcacctggaggacttgttaaatcatagactaattagtatttgtagaaatgcaatcacacagccagttgcatccaaaagcctctgtttcagttaaaactgaggtaggtcttgataattcaccttaaatgtcctgtgtgtgatgctgatatagctggttctgggacatccttcctcacccatctcagttcaacaaaatcctatgcacttctcactgccattgtgtgggagacgtttcatctgtcacctgtcagaatgaaccattccacacattgtgttcatgagataggaggcaggactcaaccacagaggcgaggctcagacaccaaaccaaaatgaggactagctaaagcagggacagggcagacctgggcaaagccaaaaggcatcccagtgaggcccgatttggagtttacctgtcctgtatcactagcagaatgattgaggttttaggtggagccagattgcctggactccgctactaaatacctgagtgaacctgaacaagttccttgatctctggagctgcttttccatcagtaaagttgaactaataacagtacatccagcatatgttgatgtgaggattaaatgaattcctgcatgtgaggcacttagaatagtgcctgagaagtgctcaactattattggttttctagtagtttatacctttactacaatgctcaatgacgcttaaagtttgtaggcctatctccttttgagatgtcagtttccttgaaagcagagaccacgttgttgtgaatccccagaaacatagccctgggcttagcactttatagaaatccagtaaataaaatttttaattaaatggagatcaaagaaagattgcaaaaggatcttaagtaagtaaaaatcttctaaacaataaacaaaccatccatttctttttccctcatcataaagatgaataaaaatgaggtcaattattaataatacattgaaagtaggtttgccttttcctttgaattttctaaactctataattaaaatgacttcaaattggaagattgttaagaagaaattaatcttattggtaagtaaaaaagcaaatcccatggttgatgatagatatgacctgttagcaatagtcacacttttatattttatttccttacaatcagcatgtggagaccaacataatccaattaactgtaattcccttttgtagcatccgtaaagtagtttatgatactaaaacaccattgaagtcttatctctggtcagataatccaaatggattctgatttgcaaactaccagcaggtctttataaacttcaggaaaatagaatattttgacttccctgaacctacaataaatgtgatacacaaaaattcgtctctgaactctaatcctttgtaaatgctagccatcagttttctagacttctttctctgcacctgtttcttattaactgacttcttttaaaagcatttttttccacagtgaatatccagtatttcaatacatcagagcctctcagctgagcttcttgctcattgtgtctttttggacacaccacccctcttctatacgcccactccaacccatcctacatgctactgccagagcatctttctagaatgttgctcccctgcttatggtcatccagactctttcagttgtaaggaccttcatgctgtaccttctgccttcttttctatcctcaacaccctgagatatggaatctatgcctctagggtctccgacaacttgtggcatcccaaatgcatcatgttcttcattccttggcgtgattgttacttctagttgaatttttcttcatctcttctcttcctctctcccagctcctgcaccaccctcactcacctgactgctcatcgtttaagatcattattatgtgacacctcatctggaaagccttctgactacacccagatgaagcttgatgctaatcttctatgttcccatagcagtctgcaagaagttatataataacatttaccgtacttgattacatttttttctatttgaccaaacttcctatatactatgaaatctttgagcatagaagctagatctttatttatcttatttttaccccagcagctataacatgcctagcacaaaatttgggttcaataaatatttgataagtgaatgaataacctacttatgtcttcagtatttgttaagtgttttgaaagagaatgataaacaaagagaatacaaaaataatgctgtgtgtgtatacatatatctattgtcatcatcgttggtattatattatgaaatagcctctgttatcaaaggaggttaaaatttgataggtggtacaaatatatgaatagctaataaaaatgagtgcatcagtcactggctaagcactggggatataaagaaaaataaaaacaaatttctttgagacagagatagaggagagaccctttgtttaaatcactatagttaaattaattaggcatgccccaggagtgatggggttctcaggctaggattagaaacatggtaagcaaagtttgaaatgaaacccaatgtagggaagagtcaagattaacagcatagatagctaggcatcacaaactatcggcagagaccgggaattggtgccacaggtttgtttaggccagaataattaagatgataatgttgttcagtagtttcaacaagaagttgttgcacagggacctagctattttaccttactttatgcaagtagttgtaaaatttatacatctcccaactcttattttgtgtacctttgtagagctttagtggtgattgtggtgaagaaaagtcctgtgatgcagaaaatttagtttactcccatgaatccaactaatcgagataacttaggttaaaaattatcattaataattactagaaatcatctcttcattttggttgtcttaattgacaactaacagatgtcttatctggggataacatagtttcaatgaatgagagtagcaatatcttaatctaccagttttgtttaccttttatttcaatttttctgaagaaatacttccagacagaaaattctaagttagcaaaaacccaaatccatatccttttcaatgttaccatttctaaccctacacatatcaccaacatagtaaggggaatgataaaagccagaaattatattacattctggaaatatttgccaaagtctgtctacattggatgcttttcatatattacatcacttaaatctcacacaaaattaagaactctcatttgacaagtgaagaaaccagaatgttaagtaacttctatatatgcatttttgcttacaatggacatattatctgtatatgggaatttataggacttagtttatttcctagatatcattaagagataggttttgacttggccctgtgcttcatatttgcaaacgtaatataacttggagggaacaatagcaatggtgttgaaatttaaagccactatgaagcaagctttcaaaaatgactttgtcgaaatttaatcctatgattctctcccctttggagtacgtaatgtatgaaatcatccatggaattccagcaaattcagaatctgtttggagaagatggttaaataaaaagaaccattgtgtacggtatctatagagtacaaaaagcctttgactgaatggaaataagaacagagttggaagctctgagtaagaaaggaattaaagaaatatatatgggtgccaggaaatacatcaatttttttttatgatcctcactgaaagaaaaaagtctgttcatttttgttgctgttgttgcatctaaacaggactaccttttctcagctacctaaacgaaatatctaaaagcctggagagcagcataatgtcactaacgtcattttataaggtagcattatgcatggagttatgatgatgggaagatgttttatgttatgccattataaattaaaaatgcacaaagcaatgacacatgtgttatactttccatctgtggcacctgcttcgcaagtttcagttgcacctattatgttattctttacattcaaatgaaatctgaggagaaataaaaataagacagtcttgctcctaactagcttcctgtactggatagagtagaagaccgttccacctccttccaagagagtaactaaagatatttcatatgagcctgtgacatgcgcatgctttggtcttctcaaataatttccaaagatatgcacaaaacctcaaagcacaccgaaagcaagctaacgtggcgtgccaaagtagcccattagatgttcagaaataaaagcttttaaagaaaagttttaaaatcttagaaagtttgtggttacttccttcctccctctgtcgtaattcaaggaggccacagaaaaccaggttttatagaccaggtggtaatagaaccatctattctacgcacaggtctgtctcctcttgccagaaaggaaccattttcaaacataggactcctaagagcttcctgggggttactgtgataaatcatatgaaacagatcttgttgattttgcatacaagttttcatatttaaaaccactttgctcctttctctttgataggtatcatgaccatagacagttgattggacttgagttgagtttttcctgaggaagtttccaatgttttctagtagtacttagagtctcaggtgatggcaaccatgcaatatttccactttagacatagtagttggacaaagaatgaatatgaaaacggcaatcatgattttattctttctctggagaccacactggagagtattctgcatgtttgtagagaaaatcatttgaaataggttaagcctgaataggcaggcaatttttcaactaattccagcttcaaatctgttctctgaatattggtaattatttttcttcaaatggaattacctaaagagctaactctgttgttcactgtgtttcacaagtgtagcatagcccttgtgttgagaagatgtataggtatgatccagaaatttgaccttgtctttctctgctcaaaaccttggggcattgtattagtttgcttgagctaccatactaaagtaccacagactgggtggtttaaacaccagaaatgtatttcctcacagttctaaaggctggaagtctgagattaaggtatcggtaagttgatttctcctaaggctccctccttggtgtataggcagtcaatttcctcctgtgtcttcacatggtctttcctctgtgtgcaccctaatctgttgttataaggacaccatacatattggatggggacccacatgacctcattttaccataattacctctttaaagatccaatctccaaacatagtcacactatgaaatattgggggttaagacttcaacgtttgattttgaggaatggaagaacacaattcagcacataacaggcacgatgcatatttttgggtgatatatttgttatttgagtttgtcctggcttgcccccaaggacaaaataatatgattctagggaagagtaacaggatgtaaaatgtccagaactttatattcactttctgagcacctgatgaagccctctcctttgaggaacataaagcagcctcaacagctgtagctttaaaaacacaaggcccagtatgtagtctccttccatctctgtttgtttgaaaacaattaagtgaacaaacaaattaactggccaactggtttagttttctcagataatatcctcaatgaagtctcatgttacagccaaggtgtggaaggaggagctttagccagtgcagcacagaaagatgctacttttggcacagggtgacatcaccgtgtttgagaatgcagaacctctctaatccaccagaaatcagaccaaaccatcactttcaggagccagcacagcaagaaaagttgagctagttgagtgattcaaccaacttacttttgatccattcctttaaatactaaactaaaaatcttctatatccttataaacagtgtcattttatccacattaatatctaatctttcaatttgattttagggccaaacatattatgttttggatcgatcatccctctggcatctcttccatttgggatgtgactttcatgtacccagcaggccttttagataagggatccaaatggtcatctgtgctggaagcagggacatcatcctttatgagagtttcatagtgtaacaagttcttttcactgtattaatgagatcagggctattctttctgtatcctgggaaagctagggtgtcttttcctctttttaaaattgcaacaataaaataaaagttggaaagaggttttaaaagtgctatgaaaactattacaaggtaaagaagcacttgtttttaacacatgaagaagattttctttcttgacttggttactcttctattctggatagtccaagtgcaagcatatttcaaaaaagactaggttaaaacaggttgagtctagttaaaattggacctgatatcacaactgctggttatatataccaatacctacaaagcaatatataatacaagaggaaaggggtaaactcctttttttttttcctttgagacggagtctcgctccgtcaccgaggcggatggggtgcagtggtgtgatcttggctgactgcaacctctacctcccaattctcctgcctcagcctcccgagtagctgggattacaggcatgccaccatgccgggctactttttgttatttttttttttaccatgttggccaggctggtctcaaactcctggcctcaggtgatctgcccacctcagcctcccaaagtgctggtattacaggcatgagtcactatacatggacagtaattaaactcttaatgatatttaaatgctccttgttccttggaaactaccattgacctactatggctatcaaaggttcatctttcagttctttttaagaaaaattattcctaatagctactgtcaaattttttctttcaaatataatttgtaaagcttgatataaataagtttttacttaaaagataccctaaaggctcttcaagaaagagcatttcagggtaaccttgtttgggtacaacatttaggttgtgtgtgtgtgtatgtgtgtgtgatctcataaaattcacatggtatttgcattgtggagcttaacctatctttaattctgtttataagctttaaggcaaaaccataaccaaaatggatttaagataacctaattagagggccaggagaaaccagcacagattgaaaggattgtgagacatcgtgattcaaccagacttcttcctaggattggactataacatgtgatatggtttggctgtgtccccacccagatgtcatgttgaattgtgttgaattgtaatccccaatgttgggggagggacctggtgggaggtgattggatcatgaagatggatatccctcttgctgtcctcgtgatagtaagttctcacaagatctggctgtttaaaagtgtatagcactttcctcttcactcctctctgctgctggccatgtgaagatgtgctggcttccccttcaccttctcccatgattggaagtttactgaggcctccccagttgttcttctatacagcctgcagaactgtgagccaattaaacctcttttctttgtaaattaaccaggcccaggtagttctttgtagcaatgtagtttttgttgatcccgttcaagaaactgcatcgtactgagataaatcctctaaaacaaccaggctggcttacaatgtttgttcagtgtttcagttgccttagtcccttttttattttatcattttggcctttactcacctgcctcattctggtgacatattggatatgtttgattccttatgctttaaaatgtttttcaggtacattttcccatttgataccaacaattatccttctatcttcattttacaaataaataaataaatagatatacaatgaattagtggtaaatccagtcctggagtgggtgtttcatatggtctttttcctactctatcatatttcctcttcactccattgctacctaacaatttgctccatctgtgcccgtttcctaatgcagttgcttcttattaccaatttgttttgtatctgtttatataagaatctgtgccttctacaagtctgtaattaccaaagatgagagtcagtttacaggtaaaagcatagcctcgagttagacatttaaggataaaatgtaaaaattacaatcttgacataatagtcaatcaactaccatttgcaattactgtttatttgccttttccctttctgcttctgccagccaagattaagtctgaacacagtgattttaaacatagtgggggcttactggctctttatcctggtttcatcacttggcagccatgggaaaattgtttaatctacctatgcctcactttccctatctgtaaaatggacatgatgataacaatagcatcttcctcattccttgctgaaagcattaaattagataatgaatgtagagtgcatagcacagtccctggtacagtgtaagctctaagtaattgttggttatcgctttcgttgcaaagtagcctgaatgagttcatatggattttgttctataaaaagttatgattttgtcaagaataattaccaactcaaggtcatattaaggaaatatcaatatgtgtgtatctaattttctagttccctgaccacctatggtagacttcgtaaatctttgttgagttacttctacagacacttatggacttcactatagtggctctcaaccaagaataattttgcaccatggggagatacgtggcaatctctagacacaatttttatcatccccactgggaaatgctactggcatctattagataaaggtcagggatactgctaaacatactagaatgtacaagacagcccccaccacaaagaattttccagccccaaatgtcaatagtgtggtgcttttgagaaactctactctattagaaaagggaaaagtataagacatcatcactgtgtagaatctagttagaaaatgcttatcaaataatgcaaatatatttgtaataatgcctgttaacaccagggtagggttatggttagttcatcttgaggactggttggcttcatgagaaggcatactatatggacataacttcatgtttagataaactacagtggccttgcaaaatttgccttaacatcacctggtttacaagggatcttaaccttggttgattatgaaaacttgatataaaaattagtattatatttcaaaatactctttccaactatttgccatattgcctatttaagctacttgccgaagggctacaaattattattatttctttaaatggaaactacatgggaatctatagtaggaatcttggtttaagggacacagttaatattatatggtattttaagtagatataatcaaatggtatctattcatgggtaaattttctttagatatcactatgttcgattttcatgttcacttgaattaactgatattaatgtggaaatgagtaatagtaatgctgttttcctttggttaagccattatttgttgctgctgctgttgtttccttgctcaagttaaaatcattctcttttttacctgctgaacactttcctttagcaatttcaaacttgtgcaccaaaacggcattttgtgttggacttttctgataaatttttggtagagatagttgtgtgtgtgtgtgtgtgtttgtgtgtgtgtgtgtttaggtttccacttaaagttcagtgccaaagctacagtacttatacattttctaaatgtgttttaagcaataagttgtacaacatttttagaacatgtgttaagctatttctctaagaatgaagctcttaacaaaacataagcactctgcatgagatcttagcagcaaagtgcttaaaagataaagtaagaattggtaccatgggaagaacaccagctgtagagcacacaggtccattatgagaagtatggtagtgggtagggagaaaatgatttaatcaggagtaaaaccaattttattataagggcacgcagggggtgtggcaccatagtgagagggacatttcaaaatatctgacagatttcaacaatgtgaaaaccccgttctttaaagtgacagtaaaccccatcaggtctccctttttgatgctattgttaacagttgactgtttaaagctggcctgctaagatgctgtcggcctatttcaatagtgtgtagccaaataaaagactaattgttgaaatacaatcaatcaaaaatgattgcagggcagaaagaaggtctcctctgctgattttgttgtgtatcacattattgtgttatgattgaggtaggaatgaagactgaaagggaagattagcccgtctgaaataaacagattcaccttcatgtcttctctttgcaaacacactgttgagcaggaacaccacttactataagccttagaaacgatcgttcatttatttaaaaaaaaaaaaaaaaaaaaaaaaaagaactgctgaagatttgggctaatgtttttaaaaggacgtgaacattattagcaaaacagcccatgcagagaatccctacagtgacaattctcagcttttcttacattttggtgcaaaatgctcctctggattcataaaactgacatccaagggacatgtgaatgcgagcccaagacatcagtaaagaaacaaattttcagttgaccaaatacctcggcgcttgccagtattctcagcttttcagttaacccccagattgtctaaaatgattagtttaaggtttcatgaagccccgaatccaaaaccttttccatgttgcacgtttagaaagacaaatcgtctggctcgacagcagtgcctttgtacctcgcttccttttaattttatgtcaagatgtccctttcagacgtgaatgcatccacttcttgggtgagactaattccagacattcatattgagggtgaaaaggacaaaaataattgcccagcgcactttatttctattaaaaccttcattttgggatttactttctttagtatttcaacatctccactcactcaagcttcccaagcaaatatttctgttgtttctaaaaagagttggtaagcacttgtggtttgtctttagtgtgttatcatttttgacagctttgcatagcctacgtaggccaacaggggtctgtctaatattgttgctgggcatattttcctcactgagatgagaactaaaaaaaaaagattttgaagcagtaagaaaagaattaatatcctttctcactcagtattctcttccttgctgactttatattcaggcaaaaaaagggaaaaagtgttacccattattcccttgtacatagcaaggctaacacatgtaaagcaataactcattttctattgccatgtttagcatatgtctcctgttggctcagcaaggcctttaggccggtcccttgagccggccatcattggcaactcttagcccctcggcctcaaaaccaaatagctttgaatcatgttgagctgtgatgctaattttcatactgatgcattatgggaataaacgtatctgacatactgtgtcaatggcactgtctctttgtgtctcttgtttttttgttagctgcattcctacagatggtattccattgaaaatgttcccttcctacggaaagagggaggaaaaaaaaatgcacagcaccaaacctctaggtgcagaaggctgttaacggttgctgatgatagtaggcaaacattaacataataattagtgtcttgtaattgtttcattaaaaccagttgttccatttctcctcgtgttttcccagaagagaagctgaatttggacgacagccagtgggaggacatccacgttgtcaccggagcactgaagatgtttttccgggagctgcctgagccgctcttcccttacagtttctttgagcagtttgtggaagcgatcagtaagtacctcacagaaaagggcaggtggtagaataacctgacatcctggaattattaagtaaataataagaatgattataataataatcatggggaacagatagtatccccgatgctccatatcttacgttttcgtttttgtgttttgatggcttgttttatttctggccctgcagtattatctgaggtttgtttgtttttaattaggaaaaaaaatatgacatcctatttagggtagccaatttaactaagtatcctcaaatgaaaatagtgtctcatcaaatctgctttaaagggttcactgtgtgcacccctcatctctgcctttatactttcagaattgcaatgagtttgaatacaaagcggtctcgaaaaggatcctaagtgaattaaatattacatttcatgaaatatgtgttaaattatcaactaagacatcatgttctcttggttcactcacccttcacccaccaacactagtaaacagtcagccataatttgcttatgagcagcgtgattatcaaatgaagtaatggcaagtttcttctgttaaactggtgactttataagagagtgagttatatctactactaaccagtagtcattgtacactccatgaagcttccttttctgttttttttttaattcataaaacacacacacacacttaagtaaaagtgaataaatgaatgaatgaatcaatgaaaatcttttccaaatggaagggtacttctgctattaatccttggagaagcaactactggtacgtctctaaatttaatatcttagggtatgcttactgtaactgtgacagcttggaaaaagtttcctggcaagccagctgatttaaggaagaaaaagaaagaagaaagaaaggtaaaattaaaaaccttgcaagcctggcaggagcttaattaaaatcctaacgagacaaatctccaagaaaaaaaaaactgctgtattcaggaggtctgatcttggatggctgggtatgaagtgttcccattagcacaagtggagatttgggggtcctgtgttggaaaacagcccctcaacatgccctctaattctgtcattcacaaagccttcacccttgtttaaagctctggcaaaacggtatcaagaaaaagaagaaatttctctcccaaggtctttctcttgttgcttgctcacaatttcagattttgttgttgctattgctgctgctgctgctgctgctgctgttgttgaatgcagtaacaatactctaaagatgggttttgagttgaggctggaactcttatcccttgtcgtgacttcatctcatgacccctctacttcttcagaacagcaatgtttcatagttcagcatgctttcctaacttcatttgaaaagaagaaataaaaaataaacaagcaggcatttccataacagctttttctgatattctgtcttggaacacccaagcaacttacaatgttggaacagcgttctggtaggaaattggagggactttgcatttggatgcctatttctgattgtgtacatttaaagaagtcatataaatttcacatcatcatctccacacattcaagtgaggatgatctcatttggaaatatacttcggtatgtgctatttgggggctataactaggatatccatcatttaagcttcctttagttcacctgattctaaagatgttaggaaagtcattttcttagcttgagagatatggaaagcaggccctccgaatccacatgagagtatgtcttttgaatttctctaaggagtaggatcatctcagggatattctagacttaagtccaaattttatagaatttcagaaatataggcatggtaagaacggaacatggcagagttgaggcagcagactattgggattgatggctcttgcaagggtttctgccaacacctataaaatgggttatggcgagaatgaataagaaagtgcctaagaaagtctttcaaaaatgtaagagggtgcacaaacagtgctaaaagtgtttctccatatgagctttgtttgataatgtaatttggaagagaagagagaggagacttcgtccttcattgttcaaggcaacaagaatcaaactcagggttattgtgtcaggacgtggttcctgccggtgggttcgtggtcttgctgacttcaagaatggagccgtagaccttctaggtgagtgttacagctctttaagatggcacagacccaaagagtgagtggtagcaaggtttattgtgaagagcgaaaggacaaagcttccacagcatggaaggggaccccagcgggttacccctgctggctggggtggccagcttttattcccttatttgtcccctcccatgttctgtttctgtcctatcagaatgcccttttttcaatcctccccgcgattggctacttttagaatcctgctgattggtgcattttacagagcactggttggtgcatttacaatccccctgctagctacagagcgctgattggtgcgtttttacaatcctcttgtaagacagaaaagttctccaagtccccgctcgacccaggaattccagctggcttcacctgtcattatgatctgaaagtttgtttcccatcaaaatgtatatgttgaagttctcacccccaaggtcatggtattaagagatgggggggctttagatggagattaggtcattagggcagagccctcatgagtgggattagtggccttgtaaaagaagcccaagagaaacctgtatcttcttccaccatgtaatggcacaactagaagttgccatctattagccagagagtgggccctcaccaatacattaaatgggctgtcaacttggtctcatacttccaagactccagaacagtgagaaggaaatttctgttgtttatgaattgctaaatttatggcattttttatagtaggccaaatggactaagacactcagcagccttgcttcaactcaaaacagaatagtagaatgtcattattttttaatatgtaaaacagagggatcaaccaacagggtaatggggctgagacatatgatattggacagagacgtacatttactaacccacgtatttttgatataaccttgaagctagtccttgtgttctaaacctaggaaaaactctaggttgtaattcatatttaaatattcttaagcaatgagagaatggccacctagatccttggcaatggtaaaaaccacaccagaggaaatactttctctccatgtgtaccaattgtactaaaaagtctttcaaaattttaagaacatttataccccgtcacagggctttatcatagcttacatagcctcttgtaaaaatctatgcagtgagaaactcaacagatccactcgcgagttttcggctttatatggaaagggaccaaccaggtaaagtaaattcacaggacaggatgaattgaggacaaagaggctgggtctgggcctctttgtcctcagatcctagttcttcccttttattctctgtaccataggagggttggtcctagccagctatattttgcagatgctgtttttgtggggttttttttcgacttttattttagattaagaaggtacatgtgtaggtttgttacctgggtatactgcgtgatgctgaggtttgaggtacaaataatgccatcacccaggtatagagcatactacccaacagtttttcaactcttgctcacctccctccctctcccatctagttgtccccagtgtctattgttgccatctttatgtccatgtgtacccagtgttcagctcccacttataagaaagaacatggggtatttggttttctgtctctgcattaatttgcttaggataatggcctccagctgtatccatgttgctccagaggacatgatttcattcttttttatggctgtgtagtattctgtgtgtatgtaccacattttctttatccagtccaccatcactgggcacctaggttgattccatatctttgctatcgtgaatagtgttgcgatgaacatgcaagtacttgtgtctttttggtagaaagatttgtttccttttggatgtatacccagtaatgggattgctgggcccaatggtagctcagttttaagttaagttatttgagaaatctccaaacttacatgtgctcttgagatgctgttgcacccggtcaaagccactggaaggagatggtagaaagagagagaagacaaaggccagcagtttatgagtttatccccaacccgttcacccttgccacccatctgcctcaggtagcttttcagcctgaggctccttctcctctacagcttcagctttgaccagacagggcccatctggtttcagctcccatctggtgacacagactctcctttctttgcttttccagcctggagaaggtagtggcttcctgatgtgtctactttcttggttactccactcttccttatctggttctcagcttcttctttatatgggtaaccaattgtctgcatcaaattaattccctttgttggtgtaaatacttaaaatggtttctgttttttgcttacacacaagtaaaacatcatgtcagttgatgtcatggtacatgttgtcataacattatttcccttttctcttttattacccccaagcccagtttgtggagagttaacatttttatttggccccagattgggagatctgttactctttcatggaagagttaaaaggtggttagaccaaacagaattttgcatccaactggaatactttgcatctgaggagaaaatgctatttctagtacaagcaattaatgaccactggagcggtctgaattactttaatttttattatatgtttgaaagttatcacatagtccaagaagagtgaacagaaggcatttactttttaaaataacttctttttggaccaaaaaaaaaaaaaccccattaatatcataagaccctgcaattgccatagtaatcccttgtctgataatactcattggggtaacaaaaacactagggattgttttatatctcagaatccaagtacagcaactattgatctgaaattctatacttgagatcaatccaactgggtcacctgcaggttatttcatggggatttaacccactgactgcaaagatttaattccctggaaatgacttgtactgaaggcattattagtactgtaaatgtgaactcagtagaaaagcacagccagggagttttatgataggtgatgcaatcttgtggctagaggcctgcaggggtccagacatttccagtagatctaaatcctaggaaatgtactaactttaccactgttcccatctttttcttctggtaactctacagatccaaagaaaaaagacaacaagcaatgttttttctgttttaatgtctgcatttttccaaagttcctgaaaaagagaaagggaggagaaaaactcattggcatttctaataattgtctcatgtaattctcaaaataagaaagcaggagatattggagaaatggaaagatcatctgcacaataatttctagctcataaagtagttactatgagaatgagaatagaacaggattttcttactccatgttaggcacttagtaagctatttaaaaagaaattagtttttagagaagttataaatgcacatagctcaaaaaactagacttggcattcaaatacaaatataaatactttgtatcattgtatattgccttgagcaatagctattgccaagtatctgtattttatatcatcctacagaagacccatatgtcctatgtcatcttatataagactacaagcattttttctacattttaaaagctgagtttagaattaaattaatggtcagaaatttcagtattggagttttaggttagaaataaagtagaactttccaagagtgagtgagatttcaatgtttagtactagatattaaaagcattcatgccttaaatgttgacttctctgggtacattttaaccctgcactctgatttctatgatcaattgctcaatatctccttttgaaatttatttatatgtacacaatgttacttttctatttcatatgagtattttaattgtattaagattcttatttataattatttacttgatcaaattacaatattcaacaaacaaaatcttacagaagaagttaggatgaaaagcaatggattgggccctatcacatcatatcccctgacctactcgtgagaggaaacctcatttagtgattttaatttttatctcttctggttactttcataactctagataatatctctacttttgatttatcaactatggataatatctgttacctaatattgtttcattctactccacttcttttagtatgtggtagccatatattataattgcaagctaaataatatgcctaaacctcgttttcttgtttcatcaacattcaacaatatctgctaactcttccattcataaggtgagcatatactccttcccaccctttccttaatctttctatagtttatttttaatttttaataattgaggatttttttctagttctactgaggtataattggcatacaatgaactgcatgttttaaaagcttaactttgataagttttgacaaatgtttgcaccacaaccaggaaaaagaacatctctgttattcccaaaagtttcctcttaatccttgacaattctctttccttcccctttccacctgctctgcactcccatcccaagccaccactgatctgcttcctgtcactatcgatacatttacattttctagaattttatataaatggaatcatacagtatgcactcttttgggggagaggctttttttcattcaacataattattttgagatttatccatgttatattagttcatttttcattaatgagtaatatttcattatttgaagataacacaatttgttcagttgtttatggatatttgggttgtttctagtctttgattgttacaaatgaagcatttacaaatctgtgaacatttatatacaaatttttgtgtggacaaatgcttttagtcttcctggtgatacttagaagtggagagctggttcatatggtaggtatatatgaactttttaagaaattgctaagctgttttccaaagtcattgagccatttttcaattcccgtcaacagtatatgagagttccagtttccccacatcctcagcaacacttggtgtggtcagtgtttttaattttagccattctatgtgtgaagtggtattttgtggtttaatttgcatttcactaaagattaatgatgttaagcatcttttcatgtgcttattggccattccattattttctgcagttaagaaacctactttttcaaaaaaattggctatttctttgctattgagtttcaagagttccctatatattcttaatgttagttctttatcaaatatataacttgccaatattttcacccattctatggctttgttttccttcttttaacagtgttttcagaagagcagacatttttaattttgataaagtccagtttatccattttgtcttttatggatcttgctgtgccttcacgtggactaatactattttcttcaacatctgttctgttgttagtctcagccagtgaattttttttaatcttaggcattgcagttattatttttagaagtttgcatttttaaatatattctgccttaaggtgtctaatttttctctagctgttttagcttttattattttaaatgatgcataattgtacatatttatggggtagaatatgatggtttgatacatgtatacagtgtgtaacaatcaaatcagggtatgtgagctggcagttgttgatttgttgaagtttccaaagttgccttttgtgtacaaaaataacttttcctcccactcctgggcaatgttccatacattttccattattagaatgcaatcaatgctaactccgtgatcaaaaacaattttatgattccaatgccatcacttttggtgtttttttctggcttgactaatagtaatatataaaaccatatgaacatatatattgtgttcatatatatatacatatgaatgtatgtatgcataggacacagagattaggcaagtcggtgctaaattgagatagtaatgatgttacatacaagtcttcaatttaaaggctacaatcacacatgcctttgaagagtgtttttttaaatgcctggttttttttaaatgattaattaaggagtaaaacaagttgtgagaaatggcatccataagatcaactgagcaccattaaaatgcagactattagccaccaaaagtagagattatcctgtgcctaaacggaactcatatccctgtctatacatcagtcacatcctcatcagataaaaataatacattgccctatggcaaaaagtacctattgcatgttctaatggtttttccccccatggcctttattccattttgcctttagagtatactctcaataggtaattgtggggggaaaagccagtcaagtatatttgcaaatattttctttactcttgactttatcttgccctttggtcaaactatttctgatgcatcatcaactccatgatgacactctttaggagaaaagaaacagagcttgcaaggcacttgactaaaaacggttgctaaacatgaaagcatgatagtgacaaattgccttaaaaccagagaaagagcagggtgtaaaggttcatcacaaagaaagcagagatgtaaaaataatgcagtataaaaatatcctctattgcagcatttcaaggaaatttgaaattgaaacaaaggtaaattttacaaagcctgtttttttagtttccactgcaagctaacattctcacagacttggtatttttgttgtggttgctttttaatgtgtgtgtgtgtgcacgtgtgcacgcaaactggaaagtttatggctaatgcctagcctgtctcttaactcattctaattatattcataatgaaattgaagaaaaatacttgactagagccaaatggcttgcacaggtgtctttttgtaagaatggtttagtgctagatgataaacaactggacctccatctccttaatttggcttaatgaaaagccctttataagtaaaactagaaggtgattcagaattaaaattgggccttgactcagaaattaattgagtggtaagacatcagctccattagaaaatgtggtgcttgtctttttgcctttcctgaaaacttttattttacttgcactcctttcttccatctacgtaaggtcactttttcaaagcaataaactcttcaagctgagcaaccagccaggcagccttcatgagtcagcttccctagcatccttacttctactgaatagacctgcttttaaaaaatagataacaaaacgcaaaatttctcctcaaaacttggtggaaagcaattatcttcacctattcttctaatagtggaattgagtggttggttttcactgcatcaatagattgtaataaaactgaaggttgggaggccttctatcctacactgaggcttctgcctaatttcttatgctttgcttgacaccacattgtgatcaccactgatgagtcctctaaaatatctgcccacttacccccaactctgactcaggccatctctaggagaatggtctctcctatttcccatattcatttttttctctacccaacccagcatgattctagttctaaaatacacgcaaactgatatatctggcttgcatttcattttgagaaaaatccttccaaggtcttcaaagtcctttatgatctggtcacccacaaggtctccaacttcatcatttactgttccctgccttgcccattgcattccagcccattggtaccctggctcttctttgaataccccaagcacattgaaagtctttgactgctccatctgtctaccgaacacactctcccagattgctactccactgtcaagtcctcagggaagtctctcatcagctaagctaaagtttctacccgcaccgcacaccaccacctgtattcaaatcctgtctccaccatttactatctagacctagagcaaatatttaatctctctaggcctccatttccacatttataaaatggagggaaaagttgtatcttcaccatggcaattgtaaaaagaatttcatgaaatgcacttatttacagaatccctggcacacagtatcaagttcactggtattatcatattagaatataatcagagtgtcctttagttaacagtctcagagctttagttaacagtctcagaggaccttgctgtccattctaactaatctttccacttctctggaaaagccatttcaaattattgtcttaaagcggccatcttcattctgctttaatattttgctttgagaatttcacacagcaccaaacatgtttcatatgacaggatattctcttgcttcgtgacccagggatcccatttccttcatctcatgacatttctcctttgttctgccagatgttctcaagcccaaccccacttggataatccaaagcctaccactttattatagaacttacgcctttatcataacccaaatgctatccagcttctccgacctgagcttgccttgcttctatgaaatattagcaaatctgtgatgttcacggtggcaccagaagagccaactccaaagtgataccttctctcagttgggaaatttgtaacactgtagatcccaaaatgttatcagttgaacacagggacagacagacacacacacacacgttctccaaactggaaatgtttcactttttctttcagttgccacacaatactctagctttgaaaggtagactttttattttttaattatctcaagagaactttcatattaacctctcaggagctttttttttttttttttttttttttttttcaaattttttgtaaagacagggtctcactatgttgcccaggctggtctcgaactcccggactcaagcaattctcctgcctcagcccccgaaagtgctgagactacaatcccaagtcaccatgcccagcctcgtgctattttcaaagcctgttatggaataagaatggatcctttacccagtactcttgtttgcctacattcagtcagacattctcatttgctcaagcacttgtcctttctccagccctcctctgtcaatacaagaattttccttaaatagcttctaggactatcataagcaccttgaattgtggcttttcttgatctggctcattcctactgctctgcagagttaaacattagatgtgatggctcctggagtactataaatttcctgggggcattctgctcatgttggaacagtggaatatccacactgagaattgtcatgtggtttagagaatggaatttttccctaaggataggctcatacattttctacctacactttctgaacagaaacatggaaaatgaatacactattatagaaaataagtagtggtgctggtttaagagtaaaagtaatatgtttggaaggatgacagcagatatatatatatattttaatctatgaactataaaaaaattatattggataattatgagtgttttcttttcattggcttatttatagttttctatttaaatgtgaagttcctcccacttccaaccatttaattacatataacacctttatttttcagaaattggaattctaaaagatcaaatacctaaagcctgagtccatgattactgtctagccagacagttagttcttggcccctttcctttttcttctcaccttgagtgtccagcaggtgaaaggttgaccctttcccatttccagcccattcctctgccaagtaacggatgggcagatctaattagtaccatctgtcccgctagttgcaggtggttactgtcttacaaagagatgaaagcaacaatcttttaagcttttcttccaggtccctaactctaggcacaatggtaacattattctttgacaccttgtgtgtattattctctgaatatctaattggcatctaagaagaaaccattacctcattgaaatattctttggaaatttctatgtgcttgtgtcatgttatgaaaatgttttagaaaaagtcgtcaggaaaagaagaatgatcctgaacaaatattagacccagaaaggcttcagaagctcctgtctgtaagcttggatttgtgatgctcagagcttctgcgagctgggccccctccgtgttaactgagcagaaatctccaccaaggagaaagacaagccagagcacaactagaaaaaccactttggtcaatgtcagatttccagcaggatctttttctaacagccccttaaatatttttaaaacacttaaagtgtaacccgtagagcctgttcagtgctctcctttcttcctctgcactttcaataatttatcatgaatcaaagtttccagacccttcatcaccaagatcacactccctcaaatgtgccctcctaaggtttggaaattgtctcagtcagatcaggaagctatagcaaaataccagagagtgtgtggcttaaataatggaaatttatttctcacagttctggagcctggaagtccaagatgagggcaccagcatggtcagttcctggtgagggcccttaccctggcttgcagatggccaccttctcattgtgtactcaaacacaagatcattgtgtcctcaaatacaagaaggagtgggctctgatctttccctctttctgtaagggcactaatcctaccaggagagccccaccctcatgaccctatctaaactttgttgccccccccaaagacccttctccaaataccatcacattgagggttagggcttcaatgtattaatttttgggacacattcagtgaataagagaaatcatacttcagtggaccgttttatttgcacaactttatcagtgcagaataaagcttcctcctatattctcacaatatcttcctcttactatgataaaatatttgattttttccttattaatattatactattgggatccaaaattgaatttagagtccaagttctcacttttaccattttctctctcagataagtttgtacaagtttaaatttccatgctgaaatgtgcacaccatcttgtaccatggtacaagagaattttgctttaagttttgcatattcaaaagacttatgtcacctgagtctcataacaacaggagctgggaccaaaacccaagtttttaactacaaattcattgtgccttcctcctagtattgtgatatttacaaacctgagcagtttgtcttccaagtccatatttacgtcctcaaatacattcaaaaccatataagacaaattgcaaggccatttaaaacaatggagcagttagagataaaaatttacaacatttggggaggaaattcaaatattgtgccaaaaaaaaaaaactcatccgacaaagggctaatatccagaatctacaatgaactcaaacaaatctacatgaaaaaaacaaacaaccccatcaaaaagtgggcgaaggacatgaacagacacttctcaaaagaagacatttaggcagccaaaaaacacatgaaaaaatgctcaccatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtggggggaggggggagggatagcattgggaggtatacctaatgctagatgacgagttagtgggtgcagcgcaccagcatggcacatgtatacatatgtaactaacctgcacaatgtgcacatgtaccctaaaacttaaagtataataataaaaaataaataaataaaagaaaaaaaaatattaaaaaaaaaaaaaaactcagagaagagacattccaaatttacaaagtgaagttctctagacatttggacaacatttagaaagaatttgaatcactaatactataaactattagactagtgggaatttaaataaaccccataactgtccatatgattacaattctaatttctagtatacttaccatacttttacttacatatagccaattgctatgtgtacatttcactatttaagtttatttttataatactcctttgtggttactattattcttcctattgtttccatttgggaaatttagactaatcaatattaagtagccttcctaaggctaccagctgggaatttgcagagctagaattcgaacccataactggaagattccaaagctgttactcttaaccacacaactgtagtttttgactaatttgaaaaaaaatgattacaagtgtctatttagaaatgagataattagtagattcagatgtagttcagataaagactttatgttgttaaaaactacaatgggaggaaaccaaacaggacacaaatgaattttctctgctcatacacgtactcaaaacctcattgtttacttaagacttccatcttgactattcaatttaaaacaaattcaacatttttaattgctttctgtatccaaggcaacattacaggtactcattcttgtgcctgggtcactggaaaaatttttaaaagtaaaataagcaccagtgaaattcaaacacacctagcagatggagaaggctaaaggatatgtaaatttatttgtaacaaacatttaatttatcttttaggaatgttagctaagagcacctattctgtgcaaaatgcatcactagaagaaaacaacaacaatcaagctcccatattccaaatgcttaaaggtagaaagaaggcactatgtccttattacaatccccggcaagtgaattaggaaataacattataaaatttcttagaactttcatcatatgtgttatttaattaaaaggtgaaactgcagcaaagtgtcacttcatccctcatgtcatgtgccagaaaagtattttcatggagtctataaattcattatttcaaccctccatacccataataaaaagagctcaattataattaaaatactatgtctactcacattcagtggtattccactttttaaaaaatgtttaacgtctttgttaaaacacagcaaacttacagaataagaccacagatcttaatagtattgtaagagtatttttagttgggacattttaaaataaaatttgtttcccaggcttgtatgtttgtgactcctttttctggcaattaattgtaaattttctctactgagttaaatacacaaaactgggtataaattgtctcttgtctaggtacagaccaacgaaaatatcgttttatgtctgtttatctgacataaacttctctggagtaggagacatttcttactgatctttgtagttccggcactaaatgaatttttaaaacaatgtgctttgtggtggttgtttcaagtaattcctcctagaacaatccatagtagttaggagcaatgatctcaaactactgaaatggggaatcagaaggaagagggtggcgagaaggtgaatggcagagatggaaacaatgcttaattcaatccattttgttgacagtaaattcaagaattaactgtttacatctctccaaatgttcctatctgccttctgagctctgttatacagctactaccagaggactaggtggactctagtattcacattttctacatgtcgaagaagtattattactacttagtttccagaaatttcatctcagtggcttaaaagtttatgagagaaaaagggaaaaattaaatgagcaaatcaagtcttttgaccaggctaatgaattttgcagtcttcaaagggttacctgaacttctgctagtacaacttgccagccttaaatgcagagagcaatggtggagagaacagtaaaactgtactataaaaataaattactgtcatgaatattaagcaacaagaatataataaacatgactgtttgcatgattctgatttattggtactgatatgcttataaattatgacactaagtgtttattctagttgtttcagaatatgggccaaacaaagctgggtggacacttcctgcagacctgaccatctgccaccaaattcctacttcatcgctcttgtcattgcgtttcttatgtcagtggcatcagggccatgtatgaacaaccattcccttttagttcactttgcagactgaagtaggttgcctttccaggacctggtgtgacaaccatcatcatgaagtttgtgatgtcttgcagtggaacaactgcagctgcaaagcatcctgaaggctgttccaacttacgctgttaaacagtactcacttttgacataagagggtccattactgtatttatgaacctcttggcaccagattggggatttcccaatgcgaagcagcactgcattttgcatacttgcttagcggtgggggctccataaaactggtgctgagaagttaaagacctaaaaacaaacaaacaacaacaaaaaaaaaacaaactgtgtattcatatagagtatttcaactgccataagataactacacaaatagcactgttgttctttctaatatccacaagtaaaagttattaagatttgctatcggtttttacattatttggaaccagatatttgttcaacagatggctagaataaggtatcacatgagaaaatagcattctcctgcttcaggtttttagctttcatgttacatctcatcaaaagttacttcaggagattaattattttaaaattttcttttctctaatgttggtggaaacctgcaaggaagacagccagtaaatttacagtaagcttaatgaaagatgcaattttcacacagtaaagtatgctataagggtataagttggtgctgcctgtaaagaactatttatgatataaacttagctgtagatgaaatgccaaagttcatgatgagacaaggcctgttactgctttgaatcagaactcttagaaaatttgtagaaggacttttggctatatttagcaaaagcctttaaaatgtgcatgcattgtactgacagttatatatctagaaatttaccttaggacattttcagagatatgcaccaggatgtatacaaacttgcccctcaaaacgttacttataatactgaaaaatgtagaagtatgtgtacaaacttaaggaaggttagataatggcccatttatattatgaaatactaagcaattggtaaattgtgatatagaaagcattatttcacaaggtaaaacaccagtaaatattaagagaatataagtatgatatggcatgtatagtataagcctattgtaaaatatgtttgtaaatatttatatgtagagaaaagaatgaaaggatttacttcaaaatattagcagggaatgattatacaggtttttttctcttttttgttttcctgtgttctgcaagtttctgcactaagtatatttgtagtgatttttttttatgtataagaagagggtgagtagataatgttgggggggatttcagaatcagttgtttgaaggcttctcaaacctggctttttgatccaactcacctttgtggaaacagattcctggacccacccaggtagatgttgattcattatgcctagggtaagtttccaaaatgttttctaaaaaaaatcatgaggaaaccctcaggtgatcctggcggcagtcacatttgggaaccattgattttggttctttttccttggtgaagccaaataagaggagagcagctcttcctactcgtagtatgttgacatcacagcaccttgtccaagccatgctatatgctcctcaaggagagtactgaagaagtaagaggtacattccctgaactagagaagaacatgtgagcacatgtgatctagcagcacaatgaatgatgaagacaataaatgttctacagaagggagagacaaaaatgcagtgtttgggaggccttcatgaaggaggcattaagagtatatggagtttggagagccagccagggaatgttggctccagccaagcactgactccagccctgagaccaggctgctgttttgtggaaagtgaggaattggggttgaaggcagcaatgattttggagacagcagtaggaaacaaaggagagcagatacagttaatccagtattgtgaatccctgaaagcaaagcagtaatttcttatcctcctgcctatcacagaactttccacagaaaagggactcagtaaattcttggtcaataaattaactaattaattgcggagaattcaatactgcagatgggttaaattttatgctgcaggcagggaaactccattaaagatttttgagaaaggtagtggaaagcagaaacccatgttttagagaagataatgtggtggtaattgtcaggatatgtttaagaggggaagggaagcaggaaaccccattgtgatttggcactacatttggctatcgcccaaatataaccttgggcaagtgacctgagtcctctgggacccatgcatggatatgcctcaagaggctcatgtgccactccccagaagattggccaaatttatgtacatgtgaatctgtgtattttctggagcaagattcctagatgtgtgacacctcccctccacccacccccccccaccaaaaaaaagttatagagtgttactgaaagtatactttaaagactggtagcatcagaatcacctcggatcatgttagactgtaaatttgaggtccccactccagacctcctttatgataaccagtgaatatagagtctaggaatctctttttacaagctctccaggttattaatatgcaggcaaaagtttaagaagcatctagtagcttggttacatctaaggtgttcaccaacttaaaaatatttcactattttgcaaaagaataaaaggaagaaatgaaggaaaagaagaaactttatgtaaaagattacaaaaaagaaaagttgcaatgatttaatgacatctcggttaaacggtcttggaagaaatagatgggttagggtttgaagctagataaccaagaggatagaaatgtacttgacagaaattgagaagctgtgttgatgagttgttttgcacacagtagaaaactgagtcaaacacaaattatcagtcagatgattattcttactggcattgctcctacagacagaatccggacagttgtaggggcaaaaaagtacaatacattttccttacccattttgagggccatggctgacacctctataacaaaagaaagattagtaaggggaaagcataacagatttatttaatcaaaagtgtgacacaggaactttcagaaatgaagatccgaagacctagggaaaactgtgcatttttatgttaaggtttgatagagaacgaacagccatgtagaaatgtggttggacaaaagtatgatctaatggtaatagactgggggtagggagtggaactcagcaaggcctgtttgctagattcttttctgtgtctctgtatgacattccttcctctgggtacagggcaggacacccatcacatcagggtcttcaggggagaagacagaaagttagagagtgacatttctaggttttatggcttgctttgaggaagagttctagtttatatgatcagcttccggggagaaatgagaggagaaaggagtgcaggcaaagatcagagagaacttcctgcttctgaggcccttctaatcttcttcagttcaaagcactcagcatgccaaaggaccatacttggaggtatcatgttctgagccccaacacaggtcagtgtacctttgtaaggaatttgttcaagattacccaactgaatttttacagtgactggaacgttgaatagccagtcagaagttgacagtgatcagaacgcaagttcggccagatcaatgataccaagatataagttgctgcgtgcaaaaaaaatcaagcctaaaacttggattctcacgtgaaaaatataaatgtgtatgcatgttaagccattttagttctagtcctcattttaaatgtctcgatggttcttgataaattatattcactttatagcacatacttttatctgagtatgtcaataacaactcagaccccttctatctgctatccaaatatagaacagaaagtatagaaaactgtatgttgggggacacccactgccatataattgcgacaccacttcgtacagtgagcatgtttggagtaaaagtaatatgattggatgaagatgtatgatgcaaaattcctattacataggtttgagattgttttacatctttaaacagagcattaagaaataatcaaaaatggttaattgaacaggcaaaaatgaactttggctaattttggcataagctctccagctctacaagccaaaagatatctttaaagtaaaatctttaaagtaaatgaaaccaactcccttgattcaagaaagagaaaagatctgcagattgaaaagaacttttaactctaagtctacactgtcattaagtgtacttagatttgtaccatataattattatgattgtagcaattaatcaactgattaacatgtagggtcagcaggatccagtgatcttatcttgaagcttgaattaattaattatactttcttcaacattattattttctatttgcatacccagtttgtacaagttgccccttattgacaaaatgtggtttagtctctgtacttatcacagcaggtatgagcactcactgaagtacttttgctcatataaagtcagaattataaggaaactgaaatgtcgtcaatactttctgaaataattgtcttttatttttcattatcaaatatataaattatacaaattaattagattcttttgaatggtagggaacataagatcaaataactcttgtctgagtaagtcaaattccgcgatactattgaagcatcacgtggtggctgtattattcaggaaattcagcttatattgcaagaaatgccccaacctgcaccttgcaaacacaagcttttttaaaaaatattttttaaatattttcaaatacataatctctcttgcagaatctctttggccaagtttttgcaaaatgttcaagatggcattattcccattcgttagatgaggaaactgaagcaaaacacatgaagtggtttgtccagagcctcccagatagctattctggcagtaatggaattgaaaagctctttcaccaaatatgtactgaaggatttcttcagcacgcactaatgttgaaagtagaaacagtaagatgagcagggcatggtgttgcactcaggaaattcacagtccagcaggggaaacagacatgtgatgagatatttacaagtgcagcaccataataaatgtatgaagggctgtgagagcagaagggtaagaatgtcagtgcattcttctattctgttgctcatggtgtttcagaatgacactcttgatggagttgtttcatatgaaagaagaaggtggaatgcaaaagaaaaaaaaagattgtgatatgagacctgttgcatatgctaaagcagcttttttctttttcctagaagccacttattagcagggcctgtctcagttggaggctctgccttttttgcttacagactgtctgacgcctttataaagtgggccactgcattgttgattactatacaccagggtggtctgtgagccactgttttctgccatcccacagtgagacagcatcttctgacgttctggtctcgtatgtccttagagaacggtttgtgtttcccaagaagcttaagtctggatgatttacatgtaacattttaaactccagttgtgtaatgccttgactgggatttatatatgctgaaaacagtttttcagttctgtatatgacagttagtatgtattgtattgtctaccctcatttatctatgagaccagagatgtgacccacagtaatgaggatctaaaaagtgtgtcctctactgcaaaataacatcatgcagtagatgctctgaccacatactataatctcataatcaaatgattaagtgcttgtcaatccaaataagacgtgtttaattttgacaaaaagaaaagaaaaccgagagtagcaattgggttaagacatgaaatggtcagtttctttctgcctgtgttgagtttcttttcacccacatactcttttgcttttttccaagagaaatggcacattttctggatgtgagagttggtcaaaagatcacaaaaaaagtcaaaaaataattctactctgtgaatgaaaaatggatatttgtacttaccctcataagcattaaaagaaaataatgcatgaaattccatagaaatgtgcctatcatgttatactgactcaaaccagaagacctagagtatgatattgctaatataatacatgtggtgggtatgagtggaagtatgtgtgtgagatttatcattgccatagtgtaaaagagttgaattagcttccacttgactagatgagagctcttagttcttattttgaaagcaatcaattgagcatggttaattaggatatcaccaagtagttaaaaaaaaaaaaaaaaagaacataaaaaaagcaaggcacttattagaaagtatactttgaatctgctcacattacagtgctgatcgaaggattatggaaagaatacaccaaagcaggagttgttaggtgctttctacatgaacacatttttcttcaatttcaacaaattattatagttattttatgtggtactgcaaggctgcctttatgtgaatcattgagttacaaacaaagaatacatttcagtcatccaagcagtaattgtaagaggacaagccaaaaagatctcatttggggaaaaaattaatctttaattctgtacttattctgtccgtcagagctcttttatctcaatttacaaacatacgtcgctttatataatgttaaattacaatgaaaattcaaaataactagcaacgttaactagctatccaagatttatatggtatcattgaaggtatgcctttcacttaaaatgtcccagtgtgagaaataaattaacttttctcattaatatggaaaataagaatggttttcatattttcacagacatgccctcttcattatattttgatgggtataagactcatttcaaagtaggtccagaaatctagcagcccaagagggctgagtattaatcctcggaatattagtccactcagaggattgatactgcagcacccagcttgttccctacatctactaataaactcaatgggagtcctcttaaccctgggcaaggttgaacacttgcatgatttgaggttttcaaacaaaagtacaaaaacaaaatgcacattctgccctaatgcttagctggtttcttgttactcgagttctataatttaaactttagccttcttgtatgcattaatttatgagttactgtgcggccaccactgaatgcagcaagtatcctgctatttgtgtgcttgaatgcagaaacatacaaatgttaaaattttacatgcatgccctaattgttcaagtaacagtattaggcagatctaagtgctagtagcctacagggtaattcagatttgaacatatattatttttccctgcagaagattgtttttatgtcaagaataagagccatttgttcctcttctcattcgtgaactcaagagaataaacttggatctacatgttgaagctggacatgtcaagtccttgactgttcatgtctactaaatccttgggctattttgggtttttccttccctccccacacctcctcctcacgctttgttataaaactacttcaatttacctgaaaataagtgtgaatccaggtaaaaacctaaataatcagaaataatggctttaaatttctaaatgaaaagagttaccttgtatccagtatggtagcagaggttttcaccacgccctgtagtcacaaataaaatgtcctatgattttcatataatcacagtttttccaaagaaaatcctttgctcataaagatgcagtgttaggtgcacatttctccatcttcatctatctttttgccattctgggagtgaacagtaaggtagtctttgcagttcaactatataaaagagggtcgtatctctatgaatataacaagacatagtgcaaaccacacttttagtctcagacctagtaatttataagcaagtcaaaagatttctctgacttcatttcataacccctagtcaatgtacgtgagtcttagcatagtcagggtcatagagagcaaggtatttcctaaaaattcctatatttatcaaatactgtaaaaaagcaaaacctctctctagcaacaagcttaattttcttctatcattcatcatcatcatcatcatcagtgtaaccagttgcataaccagcatgtggttctatatttcgatgtttgctgaagaagcaagacactgaaagtcagatctgttgttcatttcaaaacagtcctcaaattctcctttggacaaggaaagaaaactttggagaaactgacatctcagtccctggttaggaagtaaatatggaagtgcaaaatggcatttttaaacaaaactgctttcctgaccgtaactgaattttcacattgtcagcacttccattataaacattttttttagttgggagtttataacgcaaatgtaaagatttgctatgggctaaatctcaacccaagagcaaatgtttataccaattttgaaaacaatcagcttgcccatttgtagttatgcatgtgttcatcatctgttattgcttgtccaatgctctccaacttctgggagaaaaagcagacatctggagagaagaaacaatgtttgctctccagcagatgtagtctgttttccacaatcattgaataaggaaggtatcgaacaaatgtgtgccctttaatacaaggaaatgaaaatgacaagattctgcctgcatgccaatactgtggaaatgctaattggacagtctatgaattggccactttgaacaactagaactcagagctccacccattttacaggtggaaggaactagtatctaatatgaatgacaacagtgaaatactttcacctataaagtacattacactttagggattgccagagtaagtgaagaataaccatttcactaaaaactatttttaccacaaatatttaacattttccaaaattttataaattgtttcttgtcttccagtttcatgttgttggaggttttttttcttcttttaaattccgtcagtaaactaagtagtcaattttttccctggggaaaaaaatgataactctaaaaaatgttatctagctatggatcctgatgggctgagagatagatgctgggactatgcagatttgttttctccaaaatgatataacatttcagttttctttggtgaagtgtctatttttattacctacctgaggtggcactatcattattcaaacagcaagaatggtttaccaagaaaagagtgggttgggaagtgatttaaattctcctgcttcaggccctaatgagttccaccacatcaaacaagtcacgtgtccgctcagatctgtagtttgcttctttaaaatgggattattgaattaactaacctgtaatcatcttttctggttctaaaatgtgatggttttatggtgctataccttacagtaccttcctcggatgtttgcagttcttcagtgaaccaagtctttcatctgattttcccatagtattgggtactgcacccactaagtattctcaaggttaggagcagagccaaatgaaggagacaggaaagcacctttgccttgttttgaggaaggtaaaattgaaggtttttacacatggcaaatcctgattgtcaatacaattcatttggtattgctggggtttctgtggtacgtactgaagatgaaattaaattcttggtttaatttgttgtatctatatggtggcagttaacatacctcgctatttggtatataatgttattttattaccaaaatccttacagtaaaatatgatcttaaaattaactctagagtgtgattacatagcactcgtctcatgtttcattttcacccaaatcagcaccataggttgtgcatttttgctgtgctaaagttacattcccatgttgttctagaggactcctgcaggaaactcctgtatctctatgcactaagtacattgttcatacataagactgtcaattacttatatcttgtgatcagcagaaaaagtccactgcagtgaattcactgaaatacaggtttcctagtcttacccagaataaaaatcagggagcatttaaatttgtttgctattgttatgtgttcattttcaataaaagctatagtaatacaaaggtaaaattgttctgtattgaagtgattcatacagattttttcatcaaaattatgagcacaactttcacccctaaatgtttccccacgccctttcataatttccttcctccactccctggtccctgccccagagcaaataatttgcttttttatctggtttattttatgtagaacaatttattttaaatttcattaatgctgttgttgtgtatcaagtgattttattgctaagtagcattccactgtatggatacaacaaaatttgcttatgattttatttacttgttgatagacatttggagtggtcagtttgggcttattacaaataaagctgcaatgaatacttgtgtataagcctttatatgaacatacgctttcatttctcttgcataaatacctaggagtggaatgactgggtcatatggtagatgtatatttaactttaactgccaaactgtattgcagagtaactatatcatttttcattcctaccagcagtataggagatatgcatttcctccacatcctcattaacactcaggatggtcagttaattgtagccatttaagtaggtttgtacaggtattacattgtggtttgtatttccatttccctaatggtcagtaatattgggcatcttttcatgcttatttgccatcttcatgttttctttggtgaagtgtctattaaaatattttgcccagttttattaggattttacgttttctgattatagagttttgagagttatttttgtcttctggatacagtggaaataccatcctttctcttttttgtcatctctgcatttttatcagatgtctgttgtccatgtaagtagaggtttattttgagactgtccactttgggtcattgatctatacatctaactcaatgccagaaccacacttctttattagtgtaattttgatataagtttgagagtcagatagttctctacttttttcttattcaaacttgtttttgctactctaggtcaagggtcagcaattatatttttcctgtggagggacagagagttgatatttcagggcttgtaggccatatggtttcttttgtaagtactcagttctacacttgcagtgcaaaaaacagccataggcaatatgatatgactgtgtggctgtaaagctttatttacaaaagaaggcaacaagctggaagtataccgcaggtcatagtttgctggcatttgtgctaagtcctttgcatttccacattaactttagaatcatcttgctaacttatatatatttttaaaagcttgccaaaattttaattggctttccattaaacctgtagattaatttgggaggaattgacattttcacaatatagggttttccaaccaatgaacaagttatatctcattatttaatgaggtcttctttaatttttcacaacagtgttttacaattttacacatacctttggtcatatttatccccgagtatttcatattcttaattctattgtaaattgtatccttatttcatttcctgcttgtttgatgctactatacagaattgtaactggttttgtattttgttttgtactctgcaacattgcaatactcaattactggttctgatagttttttgggagagcatcagatgttctacatagaagattatgtgatccttggattaagacaataatattttttggctttctagctggatacattttttttcctgccttattgcattggctaaatctctagtaccatgttaagtagaaatgatgagagtggacatttctgtcctgttctcttctttagatggaaagcattcaatctttcattattaaatatgatgctagttttaggtttttccttcccatctgtcctgagtatgctaagagtttttaatcacaaatagatgctggattttctcagaagtttttctgcatctactgagatgaacataaggtttctcttttctagtctgttaatacaacaactacattgatagatttttaaaatgctaaatcaaaactacattcccagtacaaacccacttggtcatgatatattcatttttgagtttcattaaaattttctttagaattttcatatctatatttataaagcatattaatctgaatgatttttttccaccttatatctttgtatggttttggtaccaggacaatgctggccctaattgaatgagctacgaagtactccatcctcttcaattttgtgaaaaaattttaactagaaattcaatttctctaatagacacaggaacattcctaatttcaaggaatttctccatttcatctattttgctaaatatattggcataaatttgttcataatattttcttatcattcttttattgtctatggaatagtgatgtcatctccctcattcctgactttagcctcaaagggaaggagaatacaaatatttaaggaactgattaaaacttaagaaacatgaaataaaagagatgagaaataagtcttcctgaaggaatactacctgccccccatactgggtcggcattccttatcgcacttttcttaattgtgtttgtatagtctgggatgactagccatttaattcctgttttgtttccatagtgccagaacagggcacagtacctggcatataataggtgccaaaagttattcttctactgtgttactgtgttatgaatgaattagtgtagtcacttcccagattctggaagtttttctactattaagtttttatcctgaaggcaattaaaatccactgaggattttaaacaagtacatgacatgattagatttgaaatattacgtgtatatttagagaatgcaagggggtagacaaaaaaagactggggctagggagtcagtgaagaagctattggttatttaagcaatattcagggagtagaaattttagaatgggttggccaatgaccatcaacagtagagaataggggtattagatctagggattgagagaaaaatacagaacagattctcagaattatgatttggaagatttgttggagtgtggtgccattaagtaaattttaaaataatggtataatagaatgctttatatttcaaaatgacaggtgcccagtttgctacctatataaattggctctttgatgatttcatccctgcaatcatcctcagtgaggtcactataacttactcaaaaaggagttgagaaaagcataatatacttaggtttgtgataatgtttcattatcaggtatagcactgattcagccaaatcactacaattgatttatgtaagtgaattttgcaaaaagtgaaaaagccctttaaatatgaaatcttttggtattaatttttgtatagaaattgtgctaaaatgcatcacatacttccctaaagtattttcagattttgccagtcattctgagaatagatacaagcatcctcatttatccaattaataaattgagactcaaaaaggttgactgacatttctagtgtcaccgttttgaactgtcagtctgaaacccaagggtttttattctaaatctggcttctttcccccttgctaaactacctctatgtatattgtgatattatccagtaatgttctcttgaatatatggaaattaattataaagacaaaagaacaaccaaaagttaaaatatgacctgagaggctgaggaggcaagaggattgcttgggaccaggagtttaagattagcctaggcaacaaagcaagacccgtttctaaaatataaaacagaattggctgggtgtggtggcacacatctgtattcccagctactccagaggctgaggtgggaggactccttgagcccaggagtttgagaccagcctgggcgatatagcaagactctccatcaaaaaatgttaaaatacgaattctgataaactcatggcaaaggtaataacttatttccctggggcagcattttttcccataagttattggggtacaggtggtatttggttacatgagtaagtttagtggtttttggtgcacccatctcccgagcagtatacactgcaccatatttgtagtcttctatccctcgaccccctcccactcttccccccaagtccccaaagtccattgcatcattcttaagggcagcatttttcaatgaggaagtaaaacatggtgttatggagagaatatgagccttaaagtcaggtaaacttgggtttgaatttgggccctgctacatactgccagacacagtgtggtaatcaacaggatttcaacacatcaattttctcatctttagaatgaatctgttatctaactgataggattgttttaagtattaatatcttttgatgcataatttctagcatgaagcctggcactgttaaatgttagttttcctttcttccccatagtagagttgattttaggagcaaggattttagcttttgtatattacagccttactaaactaggtaactgcctggtggtatgaaggactttactaaccttggtaaaaataaaaaattaccatgcagtttggaagaactaagtacatagaccaaaaacaagaatcagtgttttcctgcttctacaaatccacagtttgactcttggcagtcagcctcaccaaggttgccccaccttaacaagtgatgccaaaaaaaaaaagttccaaaaggagaacaagacaactcagcattcggtacgtccattttccagatttatgtcaacaactagagaatatcatttggttttcttctaggatcaaaaagccattagcttctatgcagtatgtggtttttcactcactgcagatcttgtttaagcacattctcactctgaactgattaagtgctgcttgatttctggatggcagttgcttataagttataatatttcttagttataatagtttcttagttattgtgcagaatccacaatgatgcttaccttgcatacaagatgatgtttttatctgcagaagtcatctttgaccacactacccacagatctagagtaaaaagacaccacaaatggctgaaagtgtcaacataaataactatcaataaatgttaaggaatgtggcaaagcatttggcttcttgtgtcttcccaacctatcagagctaactatggctattattgtcaaaagtgatgctcccggtttagttatatacagtatttataaagtgcccatcaccatggtatctaaacacttgggcagtctaattaggctagtcaattacttgtgcaaaagtagaagaggtacccttccttatatcccactccactggaaccaatttgattgtgtttttaaaagcaagaaaagccttctgtgagaatagctttttaggccccttgttccaagatgaaaagactgtctgggtaaagaaatgactgtttcttattccttgaaggtgataatgttctgaatcaagcaactctccagtggtagaaaacaccacagcccagagatcttgattgagaacattttattcccttttcttttgaacttcactctgggggcaggtaacggaaaagtgctttctaaaagcagttcacctgcatgtgaattatttccaaagccttccttggtgagaaaactgtgttctctcctggcctcctgagtcagagaaagagtactcctcctcttcaggacatttaactgggtcagacctaaagcagaacttggtcacaaagacctcccttctgacttctattttggacagacatggacaaggtttctaagacaaagtttctggtgtgtgtgtgtgtgtgtgtgtgtgtgtgtgtgtgtgtgtaggagtgaggacatgttatccattagtaaaatcactaataaacatttttagaatttattgttgatcaaatactttaaaaaagctatttgtggccgagcgtggtggctcacgcctgtaatcccagcactttgggaggctgaggtgggcagatcgtgaggtcaggagatcgagaccatcctggctaacacggtgaaaccccctctctactaaaaatccaaaaaaattagccgggcgttgcggctggcgcttgtagtcccagctactccggaggctgaggcaggagaatagcgtgaaccctggaggcggagcttgcagtgagccgagatcgcgccactgcactccagcctgggcaacagagtgaggctccgcatcttaaaaacaaaacaaaacaaaaactgtttctgtacaaatgaaatactatgtttatgtgtttctgaggcaaactgaataccacgcttattcagaaaaatagtatgtcgctgatgtacacttcaggctaaagaacagttgtctttttgtactagcaagatttcttcctggaatttattatgaattcaatttgatatgaatctaatttacatgatatcttatttcataatgtttttcatagctatgcaaaaatcaagtcaacatggcctgtaatgtttcaaagtataatttaaaagttcagagaactagcattttaccttgaaaatgagtaaactattgttttgttctctagtcattccacctatgtctatcatatcgcttattgcttaattcagattttaaacagtcttattttcctgtcatttcttcatgtcacagtctctcccctcctgatttgatttgttgatttgtcattgatttgttcctattgtggccttgggacataatttcgagactttgttcagttcaaattatttcagtacctcagtccttctgattctgttccttcagtttggtgttcctgttttgtattcattccctgtcataacagttctctcctatctttcaatatacattttttgaaaacatccctatgcggccacatcagttccttcagtaactacttttctttctcatcagaatcatttgaaattgtaattcccagaatttcatcttttagagcactggattcctcttgagccatcttcctgtacagaaattcttaccaagggatcttaatttgttctctggccattaaaatgatggttgcaattattgaacatctacttcatgacaggaattttatgtgcattatcttgtttactctctaccactctcttataagctaggtttatcttcatcgtaccaatgtgaagactagagttcatagaagacatgtataggcagtaatggacagagcagggtagaacttcgggtgtatttgtatcaaaagcctatactcttaaccattatgttcatatcttgtatctcagaattaaactttcctaattattttctcctgtaaactactgagagacttccaattattcttatgttggtatcaagtactgtgtcagttggatagggtttagctgtaattgacagaaaatcaactcaaaagggtttaaggaaagaggcaattttttggctcatggaactagatatccagaggtagggtaaattacagggtttgttcatatggggattcaaagatggagatcacagactcaggcccatttttttttctgctctgccacctgtagagctggcttcatcctaatgctgattgcagcattgtggagaatgctcaccagtagcaacacaaaccatgtccttcctctgtcacttctggtaagagatagaggagggcatttttcaggaatctcaaacaaacacttcctttcacttaattgatttgacttctatcacgtgcccatttcttaatatagctaggaaatttccatttgagttaatcacagcttaatctcgaatcagggactgagttcggctaatgatgagtcctataatagatcactgaacaataccagaattctctttagaaagagaaggagaagaatagatgtaggatagacagtcaacagtatctcctgcccaactcactgactacctatcaagcacatgcacccttctgttcaacatttactttcacagccctcgtatctacttgaaaccactcactgctcatgcaacctcatacagctactcttccatatatgttccaaatatagctggcttcaaaaatcagaggtgtgatgtgacttttctatcttaacaatagctatccgccaccaaagcacttaaaatttgtaagtagggaaaaaagggataacaataactaaaatttctatttggtggggatctaatatgcggcatagggggtgatggacatgttaattactttacttgtggtaactattacacagtgtatacatttatcaaattatcacattgtgcagcttaaatatattcatctttattcattaaatttttttaaaaaaaattctatttggaaaagtgaggagcttatggtagtttgtgtgatattctgaccaagaagagtgtgtctttcatgccctggctgggtagtgatttcctgggtcagccagtctgatagctcttagttctactttctgaaagattcttaggtatccattgctttccacagtcacgggtgagaaaggaggacattctctagcagtatcccttccaagccactaccgccctaggggctagtggagacattaaggagttgtctgcccttcctaggcaggcatgggtttatgtggtaatacaggcccttttaaaaatttagaagacttctggtttgtttctagtctatttatcagctttcattagttctagaagtcttttgtgggaattctggaaatacccatgtcttagcaactagtttctgtgttctgcccatttctctggcacttggtttagtcaatgctttttatcttggagtttttttttcccccaagagaatttgaagtaataagtgggtgttcatcttaaggaaacatgctagaagtagccaccatgggccaacatcctgaattttgaatttttcctaccattgttcctaatctgtgggtagacacgtggtctgtgttccaaaatacaacagatgtgagtctcaaatgttttgctgccatgtgacaagaataattgcaaacttcatagactaggatgatggggtccttcatcccttccatgctaactcttccactcaaacttacctctctgtaaaacctattacttaaagtgtaccaatttgatctgttttttttaaattgtatcaatacattcctccttcctcctccacattctgtataattcttcaactgttgaatgtctttcctattctgtaatcccagaaattttaggagacaatgggaattccaattgcatttggggaaaagttgtttttgccgatactgctttcaagcagataccaacgttccatagtttttggcagaatttgggaaccaacaaagggaaatgtaccctaacagattaaagcagggttagtggtttaacctgtctaagaatcaaagggttggaaacaaggaagactttattttaaaatcgtaagaataagaatgaaccctaaaatgaacactttatgaattattaggagatcatttcaggaaattactcacttagcgacagacctgtgtaaaactcaatgaactgtacatgtgatggatctccactggggtcatcttgatttgagtaccagtatgataaattgaaaagtaagggctatgtgcttaaagaaaagattgggcttaccatacgtttccttgagataaatcttctcctaattaatgaccttttacctaggagtagaaacaacaaagagagtttgtgatggccagcaaataacacaaggctgtgtcctcattgtatctcatcccacgttctattagttttctattgctgttgtaacagattaccacaaacttagcaacttcttacagttctgtagtttagaagtctggcactggtctcactgggttaaaatcagagtgttcttagaactgtgtttctgtctgaaggctctagggagaacccatgttcttgccttttccagtttctagaggcctcccacattccctaaactgggaataaccagcttcctgcatcttcaaaaccagcaacgttgcatctctctgacattcttccattctcatgtctctcactgaccacaacaaggatttctttgcttttaaagaccaatgtgatcagatcaggcccaccccaataatccaggataatctcctcacctcaaagtccttaacttgatcacacttgcaaagtcccctttgccacgaagatagcattttcataggttccagagattaggatagggccatcatcattgaaggtctattattctgcctaccacgttaagtcgatataacattgcttacatgataaacacttgaaatgtgacattgtttttatatagattaataaaacaaagaatgttcaattaatgtcaattatgaatagagggagaaggaataaatgagagagacaagggtacaaaaaaagtatgtcttcttaaggagtatgtgttcttattaagaaaataagattttaaatgatgactccttgaaaataagtgctcgggaggagccaagatggccgaataggaacagctccagtctacagctcccagtgtgagcgacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctggaaaatcgggtcactcccacccgaatattacgcttttcggaccggcttaaaaaatggcgcaccacgagattatatcccgcacctggctcggagggtcctacgcccacagagtctcgctgattgctagcacagcagtctgagaccaaactgcaaggcggcagcgaggctgggggaggggcgcccgccattgcccaggcttgcttaggtaaacatagcagccgggaagctccaactgggtggagcccaccacagctcaagaaggcctgcctgcctctgtaggctccacctctgggggcagggcacagacaaacaaaaagcagtaacctctgcagacttaaatatgcctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaagagaaaactggaaactctaaaacgcagagtgcctctcctcctccaaaggaacgcagttcctcaccagcaacggaacaaagctggatggagaatgactttgacgagccgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaactctacgtctgattggcgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatacccagccaaactaagcttcataagggaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaatgagcaaaatcaccagctaacatcataatgacaggatcaaattcacacataacaatattaactttaaatgtaaatggactaaattttccaattaaaagacacagactggcaaattggataaagagtcaagacccatcagtgtgctgtattcaggaaacccatctcatgtgcagagacacatataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagaactaacctaaatatatatgcacccaatacaggagcacccagattcataaagcaagtcctgagtgacctacaaagagatttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacaccacacctattccaaaattgaccacagagttggaagtaaagctctcctcagcaaacgtaaaagaacagagattacaacaaactatctctcagaccacagtgcaatcaaactagaactcaggattaggaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacacattcaaagcagtgtgtagagggaaatttatagcactaaatgcccacaagagaaagcagtaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacacaataaaaatgataaaggggatatcaccaccgatcccacagaaatacaaactaccatcagagaatactacaaacacctctactcaaataaaccagaaaatctagaagaaatggataaattcctcgacacatacaccatcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagagaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcataaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaggcattcttatacaccaataacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaactactttaaagttcatatggaaccaaaaaagagcccacatccccaaggcaatcctaagccaaaagaacaaagctggaggcatcacactacctgacttcaaactatactacaagactacagtaaccaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggataactggctagccatatgtacaaagctgaaactgtatcgcttccttacaccttatacaaaaatcaattcaagatggattaaagccttaaaccttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcagaaagtgggctaaggacatgaacagagacttctcaaaagaagacatttatgcagccaaaaaacacatgaaaaaatgctcatcatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtcgggggaggggggagagatagcattgggagatatacctaatgctagatgacgagttagtgggtgcagcgcaccagcatggcacatgtatacacatgtaactaacctgaacaatgtgcacatgtaccctaaaacttaaagtataatttaaaaaaaattaaaaaaaaaaaaaaaaaaaaagaaaagaagtgctcaagggaagtttgttaatttaatctttgggaaaatgcaatttatcataatttgtgataacttattataaaatttcagaaaaaaaaatacactgatggcagggcacggtggctcccacctgtaatcccagcacttcaggaagccaaggtggattgcttgagctcaggagtttgaaaccagcctaggcaacgtggtgaaactctctctaccaaaaatacaaaaattagccaggcttggtggcatgtgcctgttgtgccatctactcaggaagctgagatggaaggatcacctgaacccaggaagttgaggctgcagcgagctatgtttgcaccactgcactccagcctgggtgacagagcaagaccctgtctcaaaaaatacatatataaaaatatattttttaaaaatacatatttttaaaaagagaaacatttaaaaaaaaaagttgaaggagaaagggttgaagcatgttttgtagatttagtaattttagaatgggaactaggtaacactgttcgcaaatctgaaatgaagtctaagtttcaaatctcataggatagaaagtactgtgtagatattcagatttatctggatcttgacaatatgttgatgtaacactcccatcacttcctaaagggttaccttactgccttgattctattttctttttttttttttcttttttgatcattgcattgttttcagcatacagagcaaagttaggcggcagctttcagctctgaatggctaatgaattgttcatctgtgtgtagaatctccctggtgcaagctctgtgtgagtctctattcctccctattcaaagatgacatcgtcaattgtggtgatcctacccatgtatgcagatccagctgaaaatacaaatgagagactagcattcctttctaaaacccatgctttaaactatgtcctttgtttgcaggtgcaattagctagtttgacaagcctgttatctgactcttcttttttatacagcctacatgaccatctcagtctaaataagtcaccccatttctttttctgcagttcatctgtcagttattttcttgtcttagagaagcctgaagttctgatatacttgtggttcaaatcactcttattgcaatcctttgatgagtaatttcagctttccatctgaagctaaatacatagacaattccaatgaaactcttcaagaattctccataaaatcaaggatctaggccacaaaattattctgatttataccacaaaatttggttccaataatatttcccaaagaggaaggatgggagaaaaattaaattcatttagaggtaaaatataatttaaaagaaatagtcttctctctataaaagaatcagaattttaattgttttttaacattggaattggtaaccaggttgaaagtctaaactatcaggcctcagacccctgagcttaaaccttaaaaccttaattatagctaacattgattgagcatttatggaccaggtgctaatctaagcacactaaaagtatccacttaaacttcacagcaaccctaggagatagatagtataattgtctctatttttcagataagaaaatttcaggtatagaaaacttatttaccttattcagctgcccagtagaaaggcttgtgttcaaacttcacctgtgtaatgtcaaagccagcttccttacccactgtactatattacctctcccatgtctcctattttgaggcatagttggacatgaatcacttacctataccaagatggaacccagtgaggaaagcacaaacttagatctaatgcctagaacagtgcctagagtacagcagattgaatgaattaatgaatgaacaaactaaacctcccatgttatggctcagacctttgaaggacagccacaagtataggtaccatgtggaaattttaaaaggtaatgatagcaacagccatggtttgttgaactacatttcctagttcacagatgacaccttctagctgtgtccccacaatgctggaaggggcaaggcagctctctggggcctctttcataaaggcactaatcccattacctaattaggtttcaacatacgaattttgaggaaacacaaacattcagatcctagaaaatatattttataatccagcaaaacacttgcctcagggtattctgctagtctgggaaaatgagagttctcagacctgaaggacagggagatggccacagggctccagtatggagggagccaggatatatctgatctgagaacaccaaaatggaggcaaaagggcaccaagtggaagtccagtgtatcatgctgaagttaagtttaggctgacacaagcaacaagggtagcatcctgttcaagctgtgtgtgcaaggcatgtagactagagtttcttaaatgcccattagtgcttaaggtaaaggcagacttcagacaccagggaggaattgagccccagtgtggcagtccatgaattaccatggaatagacagaagaggcttgaaaactctaagaatcagaccccatacagaaaagctcttgctgcttctcaacatcctctgagcaaacccacttctgctcccaaccacatttcagccacctttatttatatcttctacttttattcccctcataatgagaagacctcacctgtttctctgtatttctagtgctactgtattttttcctggtgtcaacgtattttctgtgtaaaacatgtatcttatattggaggttgagccaggccagatgacaaaatctgggtttgaagatcagcgagactgatgactcagacttttgcccagcaaaaaggcagtgcaaaggatgcggaagatcagggatctacctaagtgcactctgcccacccgtgccaattcttcacagcagcataccccatgttccagagtgttcgcagcctgacagagtaagggacccgataggtcactggagaccagaagcctctgttggcatcctgctctttgttcagccagtggtggtgaacacatcaccattcaaacccaccctaccaccttagaccaaatttctttttgtaccccagtaacatctacccaagtcctcattgtctcttattccatcatcaggtccactgcaggcaacagaacatgccctggcctgttaaatttacaggaaaactgtgttttatatgtaaaactatttctaagtatatattttaaggaaaataattgctttgcatattgtgggcttccaaacatgaacactttatctctgtttaatcagcaggtgaattgatgcactgaactgaggctaaacagcaggccaaggacaaagaaagctattggcagaaattactgaaaaagtactctcaggaatactcatttgttcttctggctttcattacactacacctcctttctatagttatattttctttaagaaaatctgctaatggcataccatctgagaaaatcatgtgtcagaaagctaaataacatagtctatgtaactagttgaacaacaattgaacattagtatgaacaaggttcatgcaatataatgcaatgaagacacagctttcggttttcttttgaaggggtccttttgcaaaattattattttgatttggtggttcaaaagttaggcttttttaattagttttttttttatatcgctgggggatttgcttctaggtatgcatgtatagtactctgagtatttctacttgagtggctgcctggaagagtagctccttagaatctgtcatgagcaatggctctttttgacacatcagaggagttagctaaagtgcatcattcttgatttaggagataattttgcctttggtgagaaaagtgaaggattattgatttgactaaagaacttcatctttatggacatcttagatgagattattttagatattgttttatctttgcaaaattttagtgtgattaagcaaataacacacttataggtgtccaattaaacaaatagtggcaaaaaaagtcattgcatttacttcaggaatgatctttagttgggtcattattattgaacatgaaaaatgacctacagctgtactgtaccttcagttcgttttgctggaggtactttcatgaaatccagttacccatcatttatccctatctatctctgtataatctttaaagatgtcattatgcagcatattcaactgtctcctaacacattatttgtaaagtttttgattgtctttatgtattcctttaaatataatgtagcatatccatataggtagcttcataacagttgcttaatgtgaattccagcctgcactatcctcttataagctgaagataagagaattgtcattcttgatctattcaggttccataataggaactttacagaaggttttatgtataaaacagacaaatagtgtgtacttggtgctatgaaatgcccattgttaataaattttagaaacatatcagtaattataacttaggtcctgtcatgcctgctttaataaaaagaatattttacctacataaaggtagatgaattacattatttggaacaaattggtagattttcacttcaagagaggtataaaatatagagagagtcattaaggtctggtaaaagtaaagcactgagatatagtattaggcagacttatctgaggtgggcttcagtgtaaactgaggttctcagatatgaaaaaaaatctaagtggaacataaaaacacacataaatgacagacaaaaacccataaagtggctcattgttagaatacaaagaactatcacaattcatggatgtaaagagcccaactatgagacaaatgcccataaacgcataatagaaaactcaaatgatgttaactaatggatgtcactacagatattttgtgatacattttatcacataatatctgtgataaattttgattccaaaatttagcaaaaccgcactcgagttaaactggttcaatttaataaaaagtggcagaaactaaactcaggtccactgatacatgtaaaatggaagtctggcccaaaaagacagtccagtatgagactgggccttcctccacttgccttggaaccttgtcacactctagtttgagaataagttaaataaaatgaatttccacattatttgctttgccgatggtagagatatccaaagacaatggtaaagcacataatttagagttgattgaaactatagtttgaataagcaagcaaatcaagaagttactgagacacaacaattttgcattcctgtactttcaagaattactgaaaagttgagttaaaaaaatatgtcagaaaggaagtatttacttctctccataatagagtgtctgctaataaactttccctcctattctaaagagctatgaaattggacacaatataagaggcattaagaattatacagaaaaattaagaaaagggaaccacacaatacgagccccatgattgtgccagctttccacctgggcacacttgatgctacagcatggggaagattcaatattggtaataaattaaaaaaaagaaaaccttgattcttactttacaacatatacagcgtttgagattacttaaaggtaatattcaattctatatagcatctagaaaacaaacagagtgtagactacctttgagacctaagaagtacgcagagacacagaaagcacgtttatgggcataacacaatcttttttttagacggagtctcactctgtcacccaggctagagtgcagtagcatgagctcggctcactgcaacctccgcctcctgggttcaagcaattctccttcctcagcctaccaagtagctgggattacaggagtgtgccaccacgcccagccaatttttatatttttagtagagacagggtttcatcatgttggccaggctggtctcgaacccctgacctccagtgatatacctgccttggcatcccaaagtgctgggattacaggtgtgagccaccacacccggcctaccacaatcttaatgtaaaaatataaattggattttacaaagtcaccattaaaaaaaatgaaaaggcaagccttaagttgggagaaaatgttcatagcacaaatatctgataaaggccttatattgtgtgtgtgtgtgtgtgtgtgtgtgtgtgtgtgtgtatatatatatatatatatatatataaacaactcctgcaaattcataagacaaagtcaaacaaccctatacaaatggggaaaagaataatagtccttcagaaagaagatacacaaatgatcgatgaacacatgaaaagtttcttgatattaaaagtcaccagtggataaaaattaaaatcccaatgggatatgagtttatacccaccaaaaaggctaaaattaaaaagactattaatgtgaaatattggtgaaaataatgagcaactggaactcttgtacattgctgatgagagtataaaatggtacaatcattttagaaaagcatttgtaagtgtcttaaaaattgaacatgctcctaatccatgaccccaaaatccttctcctaattgtatactcaagagcaatgaaaacatttgtcaaccaaaatgacttgtaccagaatccacaagcttttttcctcatagccaaaaactgaaaaatgactcataagctcatcaaaagggagatttgtcaacaaattacacagagcactcaaaaataaggaactgcctctattgactacaatatggatgaatcgttaaaattttttcttgagctaaagaatccagacacaaaagagtatatacctacattattccgtttataaaacattcaagaataagtgaaattaatctatgactaaaatcagaacaatagttgcatatgagggagatggagattgactggaaagatgtatgcaggaaatttcagggtgagaaaaatgtcctgtaactcgactactgttggttatgtgagggcctacatttatcaaaacttacaggcatacctcagagagattgtggggtcaatttcagactaccccaataaagtgaatattgcaacaaagtgagtcatacgaattttttggtttcccagtgcatataagaggtacgtttatactatactgtagtccattaagtatgcaatagcgttatgtttacgaaaacaatgtacaggccttgattttaaaatgcgttagtgctaaaaatgctaatggttatctgagacttcagtgagtcataatcttttcgctggtggagggtcttgcctccatgttaatggtcgctgactgatcagggtggggggttgctgaaggttggggtaattgtgacaattacttaaaataagacaacaaatagatttgccacatcatgggcccttcctttcacaaaaaattgctctagcgtgcagtgccgcttgatagcattttacccacagtagaactgctttcaaaatgggagtcaatcctctcaaactctgccactgctttatcaaccaagtgtatgtaatattctaaatcatttgttgttatttccacagttttcacagtatcttcaccaggggagattccatctcaagaaaccactttctttctcaaccattaaagttttgtcatgagatttgagcaaattagtcatttatcttcaggctctacttctagttttagttctcttgctagttccaccacatctacagtcacttcctccactgaagtcttaactcctcaaagtcatccatgagaattggaatcaacctcttccaagctcctgttaatgttgctattttgcccttctgcctatgaatcatgaatgttcttaatggcatctaggatggtaaatcctttcaataaggctttcaatttacttcgcccacattcatcagagggctcattctctatggcagccatagccttataaaatgtatttcttaaataatcagacttgaaagtgaaaattactccttgatccatgggctgcagaatgtatattgtgttagcaggcatgaaagcaacattggtctccttgtacacctccattagagcggtaatacattgacagtgatctgcttctctgagcagtaggactcaacagagggcttcaacattctgtaaaccatgctacgaacagatatgctgtcatccaggctttgttgttgaatttatggaacacaggcagattagatttaacataatttggaagggccctaggatttttggaatggtaaatgagcactggcttcaacttaaagtcaccagctgcattaacccctaacaaagagagccagcctgtcctttgaagctgtgaagctaggcattgacttctcttgtctagctatgagagttctcaatagtatcttctaacataacacgtttcatctccatttaaaatttattgtttagtgtaaccaccatcatcaagtatgttagctaggtcttctggataacttgctgcatcttctacatcagcacttgctgcttcaccttccacttttacattgtagagacagctttctttttaaaacctcatgaagcaacctctgctagcttcaaacttttcttctgcaactttctcacctctctcagcattcattgcaattgaagagagttagggtcctgctatggattatgctttggcttaagggaatgttgtggctgctttgatcttctatcgagcccactcaaattttcttcatatcatcaagaagtctgttttgctttcttatcattcatgtgttcactggagtagcacttttaatttccttcaagaacttttctcctttgcattcacaacttggctaattctttggcacaagcaacctagcttttggcccatcttggctttcaatatgccttcctcactaagctcaatcctgttctgcttttgatttgatttaaaggaaaagaggcatgcacctctttctttgacttgaaccacttagaggtcattgtaggttttttcattggcctaattttaatattgctatgctgcagggaacagggaggcctgagaagagagagagacaagagaatgacccattagtggagcagtcagaacacatgcatttattaagtttgctatctcatatgggcgcagtttgtggcatcccaaaacaattacaacagtaacatccaagatcactaaacacagatcactataacagataaaataataatgaaaaagtttgaaatactgcaagaattaccaaaatgtgacacagagacacaaaatgggcacatactactgggaaaaaggtgccaacagacttgctcaaccaaagttgtcacagaccttcaatttgaaaaacaaacaaacaaaaaaaccctcaatatctgcaaaatctgcaaagtgcaataaagcaaggtatagtcaaatgatgtgtgcctataattaaattgtatatttaagatttgtgcatttcagtgtctgattaccacctcaattttacttcaaaaaaaggaagtgattgaaagaccatttatggtatgtttcagtttgtgttattgtgttttgatcatacatggttccagtactcatcccattcattgtgaatcttcatggttccagtaattctaatattgacccagagtgccagttaattaggcttaaagcaaaagagatgaaatagggaattcagacctgatgagcttgctcagggatttatgtgtggtgaacagcaagtgttttggaatacatggttagtgtatctgttaactgaaccatgaatggaaccatggaatgtgtattgtttatcttttgacattggtgtagggaataaaacaagactccttggttgttggaaccctcacccctacttgcatacggcttttctggattttcccagaaagatatatttttcttcctcaagtacccacagaaatttgtaccatttttctgtgccttgcattttaattatatctgtgtcatatcacccctcctagttggtgtggctaaaaggctaaactctgctcactatctctgccacccatagcacctataacattctttaatttagatcaagtacttgttgaaagttttaaatatttgatggatttgatttgattggactggatgaaataacctttgtatttaatggaaccacagaccaggaatttgaggaattgaattcatttgtgccttcatataatgaagttattgagtacttatcacatgcaagacactgagctaagaaatcttaaaactcaaagatacataatatgtagtacctgcatgcaaaattctaccagtctgatagggaaaagacaatgtgtataactgatacacaataaaaggcagaaagtcatgtgaaaaaagagaggaagagaggctttcttatgaaaatccaaaagaggtcaggtgcggtagctcatgcctgtaatcccagtactttgggaggccaaggcgggcagatcacttgagcccaggagtccaagaccagcctgggccacatggcaaaaccctgtgtctattatacaaaaacataagaattagccaggcatggtggtgcatgactgtaatccagctacttgggaggctgagataggagaatcacctgagcctggggggatggaggctgcagtgagctgtgatcatgccactacattccagcctggctgacagagcaagaccccgtctccgaaagaaaaaggaaagaaagagagaagaaccaaaagaggaagaatatctttgcctctatttacactttgaaacccttactttcttttagaccaagcttaactcctatttggagtatgcatcttgagaaagccaaaataaatactagcaagtagtttttgaaattttcttgtcaataaaaagtcaagaaaaaacaaacattccttagaggggaatattcagtattccttctagaattataagtgaatgggaagtgatgccaacagttccaaccaagtttgttcctttcttcctcacaacagcgagcattagcctgtgagaagccctggtttctaatttcatctctgcccaaaactacataggtgtcctggtcaattcacttaattcctctgcatcatagtttttacatccataaaattagagaagagaacagaatgttttccaaggtctactccaactctaaaaatgtcatgattctatattctgtggctctgtgatcctaattacttttgataagatcatttatgtgattttggggattggaaagagattgtcaagtttcccaaacttcattgatccatatgctaacttcactgattgtattttcagtagtatcgatgttaattatttttcctaaaagcaaatgacttttatacttaaatatatttagctttatcctaagcaataatatctatgaaagcatacattttttagtgttacttatggttttttaaatatgcattaaactaaataaccattaaatttgtctcttatgccaccaataacatatatgtattctactttaagaaacactgctttgctgtagtaagtaggaaagtctgatccaatatctttgctagttgattagaaaagtcaatcataaatgctatcagaataggtcaacctatatgcaccagtatccacaaaggctaaaaaaaaaaaatatgctgcactcaaccagaatcttcaaaaatcctgggattcggctcttaagtgggtttgtgcattacctggaaaacaatttgcaaaacagatttttaaagttcagagtaaattggagaaagggctacattacatttgaaccttaataaatacttaataacccataagacaaatagccatgaattactagaatgatttcaagcacagtgcttctgcagagtcaacctgctcttatttttgctcattataaaacaggagttataatattgcaaagtttattagctctgttgatttgtgtgttttataaaacaagacatttgaataatatagaaccagagccattaggaaaatctatttcctttttcttctctatctagtctcctctgcccaagatagcttgaaaatgtctttctcgtagaaacagaaaagcatgaagattcctccaactctgtccttttttatagatgttgtttatttcttgaatgagggggtgcgtgtgtgcgtgtgtgtgtgtgtgtgtgtgtgtgtgtgtatgtgtgtgtgtgcaagcttaggtcctcaggtggaaccgtggttcctgtgctttcgtcctcgaagctgtttttctggaagggaatggaggcagctgtgtttacagctcaagtcttggcatacatttaccagaatctattattcatatcattcagtatcagggagagatctcaggccacctgtctatctgacaaattcacccttttgtgagctttctgttcatagcaaattatgttcacattgatgaattgagtttttatgagcattgctaactaacattctcacagaaggccaggggcaagagcctgcaagtgtttctggtccataagtaaatgattaaaaaaaaaaaaaaaaaaaaaaaaaaaaaaggaaaaaaatggtagtgtttaaagacaatttgccatggaggaatagttaaatcatttggcaatgccttaatatttataattccaagactttccataaattattgcaaatactcagcttataacaaacaaaaacatggaaaaaatccacacaatatttttctctgtagcacagaatattattgaaaaattgttctgcattttgacaggtaaccattgaccagggcaaaacatggggtagttgaagaatgcccagcattaataaatctagcaattttatacaataatgtggaaaacttgcagcaattgtagcttaaattccagcttggtatttccatagatacaaaatggatttccttttaatctctagtaaccctatactggttatggagctaagccatgtggcttgagttaaataaatgagagcaatctttcacaaaaggctaacagaaatccttctaaatggtgggtggggagatacccagtgttcatgacagaaataaaaattttctttggtttacatgtagaattggttcttctcttgggcctccatggcccttgcatttaccctgactcttagtctgcatttcatttaaaacagctgaaaaagagaaggtggtttcaccagagagacacgttctagttttcctgtacccacatttcaaagcgctaattccaaatctccttaaaatgataagcctgcataggtggcagagccactagtcagtatatatttacataaaaagcaacaaaacagaaattttacagggcagtgagtaatattatcaataaaaatccatgacttctcagttcactcaagaactgtgatcctatcctcccaaaagacagattactacctttgataagggacaatcctattctctgaaatcttagtgaaagtcagtagaaaattctaaatctcttcatagtagcctgccaaaatgtgtcagacacatcacctttcagtgcaaagacaccatagcacaaagaacacttggcattatcccttgaaaatgcacacctttcgaaggagcaaatgggaagtgtagtctgttaaacaccatatgtgatggagctgcaccagtctcatttccccttccaaacgctacaagctgctacctcattgtggtgtgtgtgactctagggggaaatcagtgacagctgagtgtctacctggtcccaatgtcagttggcttgttgaccacttaagtatgcagttcaatgtgatactatgctttagtgacctctgagaaatagaatccctgggcctttatgttaatttagtagcgtatgtgaaacttttgcaaactttccagtagctgcccttgccttcagatttgtgggtaaaatgaggagactggatttgcagtccttaaagtatggaaagatgcagacgggcaaatttctttgaaaatttgtcttgacatttccttccagtcctaaaactactatggataaatgcttctgttttattaaaaataaatttgtggagagtcatggccataaaagtcttcatcacaggtttgatcggaattttctgtggtaagcatagcgaccattcatccagattctctataaatagttcagtttccatatagttcttccttttatccaaccgtatgttcctatttttgttcagacaatatggtcaatgaggctttaaggcaacaggaccaatttacctgcaagaatttttcactctaagattacagaaattaacacaggagatagaaatcgaggtgttttgtctctaagcaagcaatttgagataaagaatgcattctttggtgccagaggcatggcaagcagcactctgcagcttggtgccctattcatagtgtcaagcagctacaggaccaccattttgctccttgaaactgctacagcattttaagtaatgctagaaggctaaaagttgactgcagctagtagagcattgttctttttttaacccatgtgataggtatcttcagcagtgtcaaacaaatttgtagagctggtgattagttgcccaaagagcataatgtatgcattattaattaaagaaggtaagtttggctaattgtcatttctatacagtagcagtgcactaagatacattttaacaatctataaataattgataattttttttctttcatcttccttcctagtttgcataaaactaatgacttggtaaatgttactctcttcaaaatattccaccgcttctatgaaaattaaactaacgctgtaaccttagcaaataaggagatttttttttttccttttattgcaggttaaaaaaagataggaattataacacttaaaacaaaaatgtgattctgtggaaagccaaatgagaatcataaataatataaaatcagcaatgaatgtgactttaagaaatagaattgactttaaaaatgtgaaaatgcaaaaacatgattacatatatacatatatacacatatgtatgtgtgtgcatgtgtatacacacacatgcacagatatatatatatgtacacgcacacacacattccagcagccccaaagtcttgcttgttcagctttcaaaagcctaaaactacaaccaaaagctttgctccaggatatcttccaagtctggtgctggtgtttcagtacttaccaatagctacatgaataatccttcaatctcattagcagaggacacaaaatttttctcagctgaagtatttgagtttacttcctatatactttgctaatttgatcatagcacctagatggatccttatgagaagagatttactgcagcaaacctacccacttctcctttttcgcaggagttctctgttattcttacgaatccacaatctgccagtctggtgtaatagcacaagagcttgcttactctctaattttcagtgcaactgaatacattcccggagttattgatggcactgtaattttacgtttattttgtttggaatacattgtggttaaaaaaagatttctttaagaagacccacaaactaaagtattgcctaagtgacatattgttatttaagccttcgtcgagtcttacatatgcttcattatgataaaaaacaggttgtaaggactgattctgtgacctttttttctcattttaaccctactgatatgtcacccatggcaaccttaaactgattttaatagagtcgatcctattattcatttaaattgaggtgcaagagcacttagaccagggaaatttgcattcagcaaatggggatttgatgagcaaaaatgataagatatatgttgtataacatggcctattttgctagcaaataaacagctcttgaaattgataaacttcagaatattttatcctcaaatgtttatacataaatgattaaaatgcattagcaattctgcttttgaaaaaaaaacatattgggaaaacaacacagttgtgttgcttaaatttgtaattaacaaatttattactaattctgttcagttctttaatatgctgcattcctgaagaagaacattaatacacaatggcagaaagaagctaattttaagactttggagaaatgaatgtcttttaatgctgtgtgtttctcttatctacatgccacattattgtaataagtacattcaggaataatttcttttcaaatatttttacaaatcttgctcttatttgcatgcaagtaagttgtcagcttaaatctttgaaatgcaaaatatatctcatttctatatttcatcaaggagcctttcatgtttaataaattacaacttagatcctccaagactttgtttttcattaactaaaagcaaaaggatacatttaaaatcttaatcacaacctgcaagggtatttgcatgttgctgatatttgtcttgatgggacttttaatatttgcaaactaatcaggatagcaaggttataccaataatttctgaagacaaaaaactttctgcattattttattatattgaagaagaaaacttaaaaaaaaattccagtgtcttagcctcaataatctgtacacttttttgcacacatttatctcctaaagattttaattggacaaatggccacatctcagaagcactattgaaaaatgtgtacaagaatgtcacatctgggttcagtctagtcttttattagtgcttgatcagcatgtattggacagaatcgttaacacaaaacaagcaaggtaaatcatccactacacactaccaccctgataaccaccttgtgccactgaataaaaatgtggatccaggagaaatcaaaggacatccttcactcatttgatttgattccagtttagacagggggttaagggtgtttctgcttttttggggttttagtggttctttttagtttaaccaaataccctagctgatcttgcagaaagtcttctggactctgaaataggatggatcatctcatctcagcaaaaacaaaaaaaaaaatcttgacagcataatatccttattggggggtcccatgggccacagcaatacaatgtcacagaagaggcaaacttctgctgaacttgctgcccagagaccttcagttaatctttctctctagaatggaagatcaaaaaaccccgagcagcttaaaaaatatgcagctaatgtcatgtagttaaactgatgtagcatgcatgttgttttgcaagctaaccggttaaatatggctttgctttaagattcccatcaaatttcgtttttatagagaaatctctgaaagcagtaggggttgagggaaggtgaggtaaaaagaaataaatcattgtagtctcaggaacagtaatccttgttgaggattttggctgattgatataaataacatcgtccccgccatctgtccgaagagagacctttccagtcagtgttaagctgcaacggcagaataattaatgaatggtgtcctttgtgctggtaataaagacaagacaaattatgttataatccaactgctgctcatttgtcacagccaaataaaatgtcaaataaaagtgaggggggcactgtgtttgtttaatggactgcaagctacctgtttctgttgttgacagacaactagaatgtaagttttgaatgttgcaggaaagcaaacctccacaccgaagtcgcatttgctcgggagaggggggtgggcttgtagggtgaccatgggggaggcctaacacatcaacattgaagtaagttttaattagagagctataataccaccggctcctctgagtaagttggttgtgattacagtgcagaagcactgcctggaaagtccaagttcaaaacacagtcgagctatttgcaaatctgtaagaatttggtagggctctcatcttgcattttcaggatagacacattcatccagttgctaggaaagccaaataatgaaaacatagctgggatttagcaagttccattgggaattacctatgatagagggcagggctgcacttcctcagaacatgctcctgctgtaaaaattcacaaacctggcattcatacaggcatctgtcgcttgctctaatgccagttcatagtatacatacaaacatctgcttccgtgcacaaagggatacagagcgcttgacaggtctgtgttagcagggttcgcaatgccagttctttatgcaaaaaccctaatgcttcccgtcaagccattagaagtgatacaatcagcccaggccccattaagccatcagtgtccacctgtgataaagatggccatttgttttcttaaagcccacttaatgtctgcttaactcaatttgtcaggaaatgtagaacaatttcctcacagcctgaaatttggtagtggttcaaagtcaaaaggccaggtctagtcctattcaaatgatataataaacagtcttcaaatcgaaatctctcttgagaagctgatgtttactttaaaaaaaaaattatgttagctggaaaagaataacatttgtgtccagtattattattttttatttctaaagtcctggaatatgtctaccagtgaaaaggtccattgcttgattgtatgagaaaataattttattctctttacaaattcagccagaaattggatgtagaaaaatgaaagagggcctggcgcggtagctcacgcctgtaatcccagcattttgggaggccgaggcaggcagatcacgaggtcaggagtttgagaccagcctgaccaacatggtgaaacccctctctactaaaaatacaaaaattagctgggtggaggctattcaggaggctgaggtggagaatcgcttgaaccctggaggtggaggttgcagggaaccaagattgcaccactgcactccaccctgggtgacagagcgagactctgtctcaaaaaaaaaaaaaaaaaaaaaaaaaaaaaaaaagcccttgcaaagcactactctcaatatagcaatcactcccaacccctaaggaatcccactgtaatatgcacacatttactttttagtctaattctatttaaaatatttcccaccttgcttacatttgttggagattagtattgtctttttatatcccttaaaagtgaaaattaaatgactgtttttgaacatattttattgtgaaaatggtataaatgccatatagaggcttactttgcccccatctcaaatcacttttaatcacagggccaatttcctgtgcttaaatgtgtctggtcagaaaggaatccgaagacacttctaagattaaccaacagggggctctcttaaatattccagatacactgacgtcctactgtttcaaattagtggtccatacaaatctaacaccaattttgacttaaaactgagccaaaaaccttaattcttgtttgtccaacaacttctgcattcaaaatatttaacttctggttccttgtgttcccgtggactagaactgggagctatcaatgttaattctaaagaatattttctcagctcattttgcacataaggtacactgaagaattgagtcaactgtctggactagttgatcgacagatattaaatgggcatctaatacttgtagaacaattgaggcaaaattaaagtttagggatatgaatcagctgggtaactatcttatttctctacttttctctgcaagtagagaaaactttaacggacctatttttcttaaagaaaagagggattgatatggcttaaaggctcaggtatgagaaaaaatgtgtgtttcaatacaaatattttgaaatgaacagctgactattttcttacttagaaatgttactgtgacttctcatccatgaactagtgttatgtgtataggttttattttccactctttggaggctcagtccaataagcaatacaattccctaagaaaggatttgattgaggaagagccagaaattagaatatgaaactagaatatatttacatacatggcactgcagggtccttagtcctccttcagactgcaaatatatagtctaaaggcattttatatcttctgtactctctctgcaagtgcccctacgcccaataacttcacccaggagaagatagtggcaaactcagactttgctttcttgattctagaatatattcactaaataaaaggttaactgcaacagaaatacctagaggaaagtctagcacacaattttccctgaagtgatttgatctgtgcaaatagtttatctttcttttggcatagaccaaactaaacgttatcattttaccaacacagagaattacttttattatcaaaataacacaaactcattattgaaaatgtggaaaataaattttaaaaatgaaaaaagaatccatactcctattatttaagcataacttatcagttaatattttggtatattcctaccagtctttttaattaactgcttagcaaaattatatggtatctaaacaattgtacaaaattatttttaaattgcttctttttacagattaaaaaataataaatatttattgaagttaacttgaaatttacagaaaagtgaaaagaaaaattactctaacaataaccatgttttggggctatttcctttgacatgttcattctgcatttgttttatcctagcctgcttaattttaaaacatgtgtaacataggaaaattcatatgtaatacctaattgcttgattttctagtttttatcactttaatagccctccactcagttttttcaataccattattatagatacaaagcaggtttaccaagtattcctacgaagagaagtaaacattatgccactctctgcagctttgatatttttgaaaggaataaaaaacttgtttagtatctctccagagcaatgttccaatgttgttttctagcaaactccagaatgaacagcaccagtcattgttttaaataatcatcaaatgcccccagagctttcacctgaaccatcaagggtggaccacaagaaaggcatttcctgtcaccaagagctaagtggaagccagagagaagtaatccaaggaggcctttggagttttagatccaaattaagtaaagaagatgcttagttttgtttacagtgtctctattcttgagttgtaaattttgattcatcacttagtagaattacataagccttcacgtaaacttttcaagaaagctgtcctattataaatctttgcatacatgagaatgtctttgttattttaacatgcaaaagacaattttgagtatgcacacaatttgagggccacaatttctttcctataaattcaaaagatactgccttgttttcttttaggatttagtgagaaaagtgttaggaaagactaaatgtttatttttttagtcttctttttctctgaatatttgtagaatgatgctctatccttgccatttgaaagttttgccagaatatatcaagatagtataccacctcgataatattttcttagaacctcactgtcattttcaatattgaggtagttttttaactcacaggagttttcttaattttgtgcttgacttgcatatttttcaaatgttctggtttcttcctcaagtatacttataagctgtagataatctcttcattctttgacttccaacatgtcttctttctcatcattttttatgtctccatattctgggaaaacttctctggtttgtcatccgtatcacaaacctaatttttctggagtaacaatttgaacttcagtgcaaaatttaattttgttttgcatttttagttttcacactgtccttcctcaaatcatctatataattgtcatcttattctagtgatcttttcatcttccctgtcctctcctatggcttgctgatccttctcattccactccctgtgtcaaattttattagagatactaagtagcttcttaattgtctagcagttactgtaagagttctaagctttttatgagcattgttctctgagttctttcataggtcaaacgttgttggaaattttgttatgtttactcatctcaaaatgtagaaatgtatgcaacattctatgcacactgatttttaccctctgcttcagctccagccttagcattttgtcttgaagctatactcaaatggcaaatttataatcacagctcttacattaattcttatctagcatacttgttctcttaaggcactagtatcctgacatcgaattttctcccaccctaattccttgactctgtggcactctaaaagataaagtgcataaagcattagaattccaagaatttcttcctaaagaattttgccagtctccaccctttcttccctttatgttttacatatgggactacacaattcctatggggatatgtgccattatcaggactttccttctgccttctacctacaatatcctcagttatacttcatggaaattgctatctttaaatgatcccagtatgaagagaagtcttgatgtgtagcttagaaaggaaggcgactggtgagaaggggcagaagggaagcattcacactacttctaaacagcattaactgtgtaggaaaaagctgcccagttttttggttggcataggcctggaggctttgattctaaaaatcagacacttgaagaaatataaggatgcttctatctgctttcaggaaggcagactctctggttcagtacttcaatagctcatgcaccactggcactttccaattaagaccaacatgtcttcgagtaagttattcttaaatttttgtcactatgttactctcagtccctgtttaaattattataagaattctattatgttttctttgctttgaagcaaatttagtgacaagtttcaagaggtggttaggtgttgccaaccagatgccatttaaaaccaaaagtcatgatttgcatcagctctttgcagagggcatcacactgaaagtttgcaatcaaattcttccttggggtgtgacctctgcctatggctacttctttacagttgctgttgcgtctttacctggaaatgataacgggccccagaggggaatgtttatttttagtcctgccatttacaagggcctttgagcttctaagaagatgcttagagttacaaaatgtaaatcaatcatttcattgtaatgatagatttcagagtattattttttccatttggggaaattttttttcactatctaaaccacaccttggttctttataaaaagaattttggattttacatcatagaaaaaaaagtttctcttggcttgacttgctggtaaggaggtgtgcgaatggtctcaagttatacatttgcagagaaaataccatccagatgctcaagtcagccttttttttggcagacagctaaaaaccataccaaaactgagtctcaagtctttaacaaaagaattccaaaagctcttacctttggaacggacattaattaaaagaagcagtcatatcccccgtgatcagagtttaactgctattaatcagagttcatcacacaattaacactttgaactgattagcaaatgaaattatagcaagaaatgttgaggttaggacagcggacggacgtactctcttgcccaactcacagtccctcatcttttaaaagaagggaaaaaaaatgaagcactctggtcataacgaattgtgcagattttgttttcagtgaggtgtttgccattacatattgcacataatgtatggcactgttaggaggaaaaaattggagtcaaagtggctggaaagttaggtctgctctgtagcactgtgagattgttgacatctgccgaggttggagcgctcagtaagcaggaaatggggtgtcactctgagtggtagtttaccattatcctggcatcctaatgaagtgtctgcagtgcacagagcttctggatggcatcttaacgcacggctaagcaaaagcacttctctccctgtcactgtcatccatctgcctgcaccctactgtagccaatgggatggaaccatgctacaatgtgctataagccatttagagttgcacattgcataatcagtcccatcaaatatgtaaaaaatggctattattggttattctcctcaaactggcacctggagtttgatacatgaaagttcaactttttcaagtactgtttctgctattaattccactccccccaacacattatctaaatgggaatgagttgcatcttcattgtcttaaggcttattaatggattgaaagtgttgtatgaatattcattaataatttcactgtacatcacacttggagaattcatcaatttacaatataatggaatggtcattttctttgtgataaccatttttaagaaaaggacaactcccattgcagattggctgttttcatcttagttggcagggagagtttgaggtcgttcaataggttttctttttaaagacatagagcacttcaccaagtacatttgaattttaagctattattgccaatgccagatgatggaatttggtgttttaatattacctccgatgaaattaaaatgcagtgcaaaagaggatatctgttgttaggtgacagaagtagagcagggtgtgtgtgtaatcctcccgaaacttctggataggttttgcaagcaaggctgcaaagcagctagactctcatggtaagaattgaagtagtaagatggtcacaaagttgaggaggagctttctgtaataggcaggggcaacaataatctgctaaattggggcaggggggcagggagggtagggttagataaataaaagggcataacataatttggttgcatcaggaattttttcacagacattaaaactatggtaaacataacagcggggaagcttgcactgccgcacagtgggaagcttaaagcgtctgcctgcactgtgcctggctcaactacagctagaagtctccgactttcattagcactcaacaattcacccagttccccagaaaaggaggaaacccaaggcagcaaagcccctcgctaattattgtaaatgctcccaggttacagtatttgggtgacaataatggcaagagggtgtgaaactagaaccaaagagtcattctgaaatgaaaaagaatgaaggagttgtttgttgcttgttatttttatttgttttaaaccagtgtagcccttcgtttgatgggtaaagcagtatgttggaatattaggccaccattttacaatgaaattttagaagactgcaccaaattgtgtgcaacttcttttgagcaacggaagtacaggttaatttcacaaatgacctcctccccttggcctccaaatttatgtgagtatatttcacaagtctctgcaacagaaactgtttcctttgaaggaaatttgtaataatacaaaaaattacatggaaccaaatgttgcaaggtaggcagactaacacacatcactgcaagatactgcacctcaggttaaagttgatatttttttccccttcaagaatggagtcatttgagaaaaatattggacttcttcaaaggaagaggggtctactttggatgcctgtaagcatttaaagtgatagtttttttttaatggaatgataggtgtttattcttgctaaatccagactcgggaatctggtttcttcattcatatccccccagctgctgtcagcaatgcagcacaccagcgttccttcatgtgcgaatatttctccagcactcatttgcaagagagtcgaagcaatattaaacaccacatctaaacctcttttaaacacacaaagcaatgggaaaacacatcagaactagaccattgagaaaatcctcctttcaaatttactgtttgcttcacatgctagtataaaatatcccacaaagtcccgtttgtgatccatttgaaacaatcttgatttgcttaaattgtcacattcttcttgcacatttctttctaaatgcaaaaatggcaaagaattctactccctcttcattataaaagtacagaatttctggcttgtttattcctaatggaacacttgagaaagaagaaaatatataaatatctttttcagaagattagttgtctcaatctttttaaaagggaggatttgttcattttttctccatggtaaacaacttgggctttgcactgtaattttccattgtcaaattaatgcatttcattttactgacttgaactcatggttttaaaacatcagaccttttaatatctttatttcttccatactacgtattaatgtatgtcattaggacgttgatagttagggatagaatccaagcatcttataaaagaaatttgttggaggaatcttctactccattataacttactaacagtctgaaagaactcactagcaaaataaaactggtttacttcttataagaacatatttccaagctaaggatttcaggcttggaatgagctgttttgagtatttcaaatcaagcataagaaattttgtctgatctactggtaaatattctattgacaaggtcaagaacagagaaagtctggacaccatgtcagaagagagaataattattttttttaagtagacagtctttcaacttcaatttctaaagtactgcgcaggctttatacagaatgtgcaggaaagtttcttaactataatgaaagaatgttcatatttacatctgccatatatgtggtacttcaaaaattaaaggcgtgaatttaaaaatggctaatattttcaagaaactataaaaagaaaggggtgggggagaagaatacaagctgtggcaaaaatctaggctcagcagctttctgggggaaatggtgaaatgtgactatgtgatttataatgagaaaaggtatctacaacatacaattttctacctagctgcaaataataattcatagtgatgtcccttccagataaaagacctttgctatgtaggacccatgtggtaaaatgatcatgataaatgtcagaccagtgcaggtaacggctttacaaaccattaagattagctggcagttttttttccgatgataacagtaaccatgctgtgactctatgtggtaataatatctcagtcctgataaatgccagagccaggcagaggtgtttatcactcccagttcagaaatgctgactaaagttgccacatgttgcctgtttttcttcttttacaatagtctcacaatttaaaaagctgaatcataaaattattttataacctatttttaaaggattttgatgtttgtttaattaataactctctctgctctcagcgtcactatgtgaccatgtcagatgaactagctggacagtttactatactaaccattatctcctcttcagaggtcttttgttcaaaatgaatggttaaggataaagtttaatatgccttcttcaaaaacaatatttttaacccaaagacaggaaaagtgtttcttaattcacatttttcttaattgtgatatagatcctagttgttttcaagtgagttttctaatcccttataaatttaattggtctaccaatggaaagacacacattgaaaacctcaaaccttgaaaagtatttgtaggatttccacccttatgaaaatgtacaaagataatgcttaatgtaaatagctagttgagtatttgaattactggcttatgatgaaaaagatttcaaatgactcaaaatagtaaagactttttttaattaaaaaaaaggttgtaaaaccagatataaatgaataaatatagtttcaagaaaatcttcacaggaaaattgaattagagaaattcagagaaataaacccatgagctttattttctcagcacagactatcgcctaaggatgaattagtatctttgtaggttacagaaatgtacttggccaccatgacacctccaaaattactttgaagagcaagaaattctaggaaggacaataggatcatgcttttcctgtgaagattgctgctggagtgtcagccactgccttacgctccaattcagacaaatagaggcatcactacaaaactgaggagtgcaagtttggtttaagaactggtttcagattggttagtctgaggaaatgttatcatcctaaaattgattggaccaaagcaatatcccctttattaaaagttacttaagcaggatatggtggctcatgtctgtatcccaacactttggaaggctgaggcgggtggatcgcttgagcccaggggttcaagatcagactgggcaacacggtgaaaccccacctctacaaaaaatacaaaaactagccagacatggcagtgagtgcctgtagtcccagctacttgggaggctgaggtgggagaattgcttgaacctgggaggctgcagtgagctgagatcatgccactgcactccagcctgggtgacagggacagaccttgtctaccaaaaaaaaaaaaaagttacttaaagactaagacttgaatacattttccaaactcgccccaatgtgagatcatagtgcatcataacatagatagatacagccacatgagaaagaaaagatattattactttcctgaatgtatttgtgaatgtatcaagaagttaagcataataattttgaagacttccagaaattgattaaatagaattttacactcgttgatttgtatcaattacacatctgaattattttggaatgagtaacatctcagaagctttttgagtttcacaattatcttagatgatcccttcagttagaagaaagacataaacttcactgacacctacataatgacatgccttatatttaaacatctattatgacaccttttgtaatttatctgcccctccagattgtaaaatgaaaagatagcaaccaactttgtatctgccacaggttgcacacaggcctgaataaatagggttttcttatttatatataagatagatatataatatatatataatttcttaagaaattatacctttatttttaataatttatggctagagagcagggatagaggtagaaggaaacagagattaccctttagaagatcattcttaacatccctcctaagagcatgctgtacatggtctaattccttcgggaccaggaccagaaatggttctggaaacagtgctaaaggggccagtgagttgaagcttccctcatttaacaaatccataaacttatgccaattaattggccagagtaatttttgatactgacaattattgactataaagagttgttcccattttttaaattcttcctaagagggcttgtttattcaaaaaaacagccaaaacatgaatatctcctggaaggagaaactgtgaatacaaggaaatctggtgtagaaaagaggtgatcagttccaactctcaggtgatcctccctagagaaagaaatgtcttatttgagtcagatagattcagttcctgcttggtctttcctgcaagtaatgtacctctcttctcaggttgaactgttttgacacagtttgtcaacatcaaaagccaaacttacaatgtatttgacattgccttccttttaattaaatataaatatggcttttctggggtttggggagaagggcacagaaccttgaaaaattgcaaattgccaactacgggctacgctcaaggcggtggtttttccttgtttatgatgcaatgacacttctatttatgatatactgtaactacttaggaattttaaccaaattctctgataattgacagcattccatatatttacaaagctacaacatactgtaccctgttcctacttttaggaaagcatactaaatagtaaaagtatgacttcatttgatttcagaaacaaccttgaaccaggagcagttatgtatcagggatgatagagaagacaatgagaaagaaatatgttttaagggaagaggacttacaggggacttacttaaatgatcacttactatgtgtacatttatgtgcactgaaatatttaattctacgaaaatccaataagatgtataatttttctgtattttcaagtaaagaactagaagcatcaatagttcaagcaacttgcccaaaatcatacagcatagcaaaaattctaacccagtcttttccagattcctgagaagtggtatgtcactggatataccgattttcttatttataatgtgagtttgaagcatgtgtatatttgtatctatttgtgagatttgaatttgcccccagagcatctcctcttaaagcaactatgagttactcaaagatatttatcaagcaattgttgtcatccctgagatgactcctcaatgggcaactcaagttttggcattaaaaagtgtatcctcagaggtttgtatccagttgtaaggcatgctgaaacaaataaaatgatctctggagatactccttcctcctgtaagcaagcacagtctctaactaaattcggaaatggccacagtacaaaaactataaattgaatagaaactagagaactgctattcttccaaatatagctctgacatatagggactaccatgtttttcatacagggtgcattagacatttcagaataactttcagaagcagaacagctgtggtaccactgacctctttaaaacaaaggaatacagttgtcctttaagaactgtagacaaatgagatgaatattactccctatacattgattactgggataaactggtcttttcttcctctgagtggacctatataacaaagcagaatttatttttaaatgtgatttaacatgaagctataagaacaataaaggcatggatgataaggacagaaaagtgtccagggacattggatccaaggttcttcactgtacagaactttttccatcatcatatacagctttatcttatctcttttctaaaaggcattgggttgtaaacgtgctttagtaacaacatttcatgcagatgaatgcaagtgtaactatcataaaccatattttgaaaaatgtgccctcaaaactataaagccacattcttatcataacattaaaggctatttcacatcacgtaggtgttacttctctgaacagcatggaatcattttttaaacttgtttacaacaatgagtttgatgtagtttgagaagatgggggcaggttggtgaggaatgggtattagtaagaaacagttgagaatcactattggatggaaaaaaacgaagcactataaaaagttgtgtgtgcaattgtgggttcacagcttagagattgaagaggctatttggatatgggtggagaactaaaatggaggtatttcatggaatagaggcaaaaataaatcataatagaataagggcaggagtaaatgcaaatgaaagagggaaagaattatggagttcattacttctggaaagattttgtataagtctcttcacatacagtttgcctaagagtacaaaaagttccttcctcctcccaccagtcataatgtaaaaagttagtgatatctcaaagtcttctcagaaccttcagcgcttcataatgagaaaaacatatgctgaaggagaaatattaatagaaaatgctgtctttcagatgctcactgaatcaattgaagacagttgacacatctttagtaagctgtttatgaatcttagctcattaaccactcctgtattatgtatgctgattccaattcctaatatgacacatcaataaaccagatctgaaaaggtgtcatttcgattttaatgtatccaattgtatttttagatgtttctccacttgaagtgtttgtgttatttcctgattttacaagctatggaagagtgggtgtggtattgatttgaatgaaaaaaaacactgctttactataaccttttcagaagattttgttctgattatgttgtaagaaaaataaattgttcctccttaatatttcagctctctctaagccatggtacacttccccatttagcacttaagtataacttggccacaaatatgcatgcaccaatatccaattgtctgattccccaagaatgtgtgaaagtggaaaaagagagaaaaatatttctataaaatattcttcatgtagaatgtttcttataggcaaacttggaaaccgacatgtacttttcataaggatacttatacataactgacctgctcaccaatcagaccatcaatttctcagcctatcacaaagtatttaggttgttgtgtaatgttgggctactatagcaattgtactttcaccaactggcaccaactcagttcatgaattagcaactacattttgaatgtccctgcaaccaaatagtatgctaactgctgggattaaaaggtgaacaagacccagtggcttgggcctcaaaagaggtgagaggggtgcaggggaaggtgaacatttatatagtactttgttttacttgtaattgtgcttggtacattacatactatcttgtttattcaacaaaactacacttttagatcttattcaaagagagtaagaaacttctccaagaccacacggctaataaaaagctgttacagaattcaaaccaaggtccacatattccagttcatggtcacaactttcattagttcactcactaattcctttttcattcatttaacccaccacatgctagcataaaaattgcctagctttaaaggaaaattccctatttaataggggaatttgacaagcattcaagcagtacaaataccatgtgaagtgttgtgtaagtagaatattctaaatgcaacagaactcaggagagggagagctgactctaagaaagctcacaattattttacctgttggcttaacggacttgactatgtcttaattcctgcccaaacaccatgaaagtgtccttgcaaatcagctctttctaattaagcaacggccaatcttttctaaccccaccctgactggatcatgttccctataagtaaagtttgctggttggaaccaacaagactactccccacttcttgcctgtaaagcttaatttatagctgctacttctgtagccctcaatgtcaactggtcccttttttggagactctggcattaacctgattattactttagtcagagacttcagtgaaattagaaaggtctcttctcctcctctctcctctcctctcatccccttcccagtttcatactgattgcttgcacctagtagttcaccagatcctcaggtaaactgtactggaatcatgccaaactgtacagaatgtatccacctcttgaatgaatatatatatatgagtgtgtgtgtgtgtgtatacacacgcatatatacacacacaattatggttgtgtggtattagcttcaaacggttggatagaaagcattcaagcatccccaatagctctgacctgggcatactatgccaatttcactctcatcttcattaacttgtactttttttctggtttatgatatttcataggccccagttggtcttgtgaagcatcacattttcttaccatcattaagctccaagagggctttttactatttggcagaaaagatgaggtctggtataggctatgatgttgcaactttcttttttttctctttctcgctcccctttgtttcttttttttgcagttgtccaagccatattatgttggaactcttctaagaataactgcaattttgaaagctttgactgtgggaggcattatttataggcctttgtggttttagaaggaaaaagaaaagcttccaagcagagttctactaggaagactgcccccatcccactttagccaaataccatcttctgcaggatattttcctgtaattccttataaaaaaattcttttgcgacaacatattaaagaacctgccagtttctaaactaactctttcttatcctactgtcataaagtttatatatctattgaattggacttttgtaagtacatcttattattaagaactgtatttggccttagtatcagagatccatcctcaaaggcttcagtacacagggcttattttcttatgtcaaagaaacccagtgggccaggcgtggtggcttatacctgtaatgccagcacttaaggaggccaaggcagaatgattgcttgagccctggagttcaagacctgcttgggcatcataaggagaccctttctctacaaaaaataaagtgagctgggcatggtggcatgcacccgtggtcctagctactcaggaggctgaggcaggaggatagcttgagcccaggagttgagactgcagtaagccatgttcacaccactgcactccaggctgcacagtagagcaagatcctgtctcaaaaaatacaaaagaaacccagaggcagacagtgcaggactagtatgactgctccacagattcgagaaagctctttctacctgtgtatttcactccacagagcttcagttccccagattagctcatagtacagccactccatctacattcaaagaaacagaaaggaggaaaggtacacaggctaaaagctaaatcagctcatacatgctctcccagaaggcctgaccaaccctgtcacttcagtctcattggccagacttggtcccatggccactccagctccaaggcagctgggtctattaccatcctcttaacagtgggattgtcttgctaaggaagaagagaatggttattgggtggatgtttgccttacatattagtcttttttatatcttattttccagctgtggcctgtttagaatcatcaagagccctgtgctagaagttaaagtatagaaaggaaagtgcatgaggtgtttaagttcaataaataattatacctctagatgataaggccctggttaaaactgtggaaagatgaattccctagtgtactaagtaaatcaatttttacttttccatctataaacaaaacaaaatgagagaaatcaatgtggtatgcagttttgaacaacttcctattttataaaatgtttatgaccaggaaatatgctatttcaatttttttttctgttttaccctcttattttaaagcaaaaacaaaatgtgtaagggaaaaaggataacatggaaataatttttaaaacaattttcccttctacaaaatcaagcaacaatagaatatttgtaatcaaatcacactatatgtccttgtttagtttcccattgctacttaacactcacacaaacttaaaacacaaacttatcctcttacagttatggagggtgcaagtctgaaatcagtttcagactgaaactgaagaggttggtaggcctgcggtatccctagaggctctgtctccttgcctttcccagcttttggagactgtggcaattccttagaaagcagcccctcatcgcataccctctcttttctgctcccgttgtcacatgagaactcatatcaccttttctgactctcattctcctgtttctccctaataaggatctttgtgattccactgggcccattgagataatccagaaaaatctccccatctcaaaatctctaactgatcatatctgcaaagtcccttttgccatgtgaggtaacatagtcacacattccagggattcagacacggacatctttggaaggcccttgttcaccctaccactccttgtaaaacaggacatttaagaaaaccaaatgttaagatcaggaagataatgtcaaagtcacattgttgttgctttcatgttaagattatctcacagtacagccattctatctacattcaaagaagcagaaaggagaaaaggtacaaaggctaaaagctaatcagttcatacacagcctcccagaaggcctgccactgtcaaattcagagtcaaaataaaaagaaactccttaataaccaggttgagtccacctattccctttgactactgactaggactcttagttgctagtctcagtccaaaattttctcaagaaaattttctcatgtacctgtacctatgaaatcttgttttttccctaaccttcctttttatttttttttccagaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttagggataggaaggacaatctacaaaaggaacttctgaaataacttatttttcaaggccctttcaactagtatatgtttgctgattgcttgtcagaaccatcgcctggaccctgggatgggtcatcttgactttgttatctaacataatgaaagaacatgaaatgattcagacatggattcaaaactcagccccaccatgtaccacgtgctggggccacaaataagttacttaaaccctctgcaaccaatttcctcatctgtaaaatgttggctcagattgataaggtgctatccatgtaaatagctaagagaggagtcttccaggaaaaaaaaaaaaaaaaggcaaatgtaaagccctagaagcccctaagagctggaagtatttgaaaagcagaaattaaacccgaactgctaggcccaaatgtggaggcaagatgggatcaggagctgaagtcccaagtatcacactagcatcagatcacataggttcttgtggtccacagtgagagatttggattctattctaaattcaaggaagaaccactgaagaatgctacaattgagggagtgtaaaagattgatctggctgctaagtggagaatgcattgcaaaggtgaagagaggaagacctaatggcagacaaccacagtagtacaggcaggagatattggtggcttgagtggagccctcagagagaaatgggtagagatattgtggagatggatcaggctggacttgctgctggttgggataccattgggaaaggaaaggagaaatcaagtgtgcaaattttgggtttcaacttgggcaagtgaagaagcgatagtatcgcagagatgggtaaaactgcagagaggaacaagttgagtaggaaaagcaggtttgagagctctattttggacatgttaagtctgaaatgactgttactcatttgccttctgttaacaccttcttcagataaggcagagtgcaacgcaagttatgaggttttagctttcatgatatatgcatagtaaaattgaagcctgacagaggttcaaatagattgagcagttttgcttttgtgagattaaatctccttaaacacctcaatcactcataatttgggatgagtcattcctacagattattcaactaatctattacatgatttttcattgtgaatgtaatacatgcaattgcaccccccaaaattaagcaacagtgatgcatttacatttaaaaactgaaatctgcctaccactcttagcctgctgaacagaagtaactaacatttttgtatgtatccttcctgacctgttcctaaacacatgcaaacatatgtgtgtatggttgcttctaatgttaaagtacatcatattgcacatattattatacaactattttgtaactcatatacagacttctatttcattaaacagacttatcttattatttctaatgatgtcaatagtatttcatggtatacacagtccataacttgctaaaccagttcattgcgttagggaacatgttttaatctgactcatcattttctgtcttattttactctcaaaaggggaactttatcttaaagttcagaaaatctcttactattagagtgttccttcttgtcactcccacatactggctacggtgagaaatccaatgtggtttagtgaaaggatcttgggctttaaagaaatagaaagagagacctagagtcaaatccttgctctatgctttactcccattatgatctcaggcaagtaaaatcggattaaatactatcaaccatatcttgtggttatgagaattaaatgagataatgcatataaaacgcctggcacaaggtaagcattcctcaaatgttaattcttttcccttaggatccagacacaccatgaaagcggtttcaagttacaagtaaatactggagtgcttatctcagtaactttaactggacaaagtcataaaacaaatggaaaagtataccctttaatgctatgcaataccttgtcttaaagttcttgagaaatatccgttactctgtcccaattattcccttttttttcaactgaagaaatagctataaaataaagaaactaagagtcagctaaatcctccttcaaataaaataaataaaacacacagaagagaatctatctagttaaaaaccttcaaaggatgacgatcgtccatgtccaggccacataatcccagttttaacaattaatgcctgatcctgttttttacatcccagttaatttcctaatcttgtcagaactttcatttagttcaatagagatggaaatagatgttttaaattaagatttaagatcagattattatatcacttcacagtattcacattttaagattgattattatacatgggaagaagtgttgtttgctagccaccaacctttcttgggtggtatgactatatttcaccctgtaccaatttataaactgggtttaattatgcacgagtgtgtgcacacaattatatcttgttaagcatttttttgctaagtttttgataaacagccaatcgtggcgtgtcatcaaagcctgagaagactaaataagaagattgtttaacaggaatttaaatatattcgtgtttgaaagaatcattagaatgttttccttagtcttaatgcatttggtagttcttcagaaaatctatcgtcaacccttgtatgtagtgtttattccaaattgttgcaaatatatatattttgaagtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggtaaatgcaaatcctatccacaaaagccagaatttttaaaggattgtgattatattaagcataaggttgcacaatggctgcacaggctgactagtctcagagtccagagtcttcattcttaatcaaactcagggtcaagttctatgcatctgctatcatagcttaagaccaggaattcggaataagctatcatctcaagatcccgtcagccagaaacctttattaatagccattttcacaaactgacattacagtgataggccctggaaggtcctctggtaccttctgaatcatcatataaatggcaaaactgtctctataaaatacaagtgtcaaatgcattttcctatagcctgcttctttggaaaggcagagaggcagagtgaagatgaagttagtgggaaggaggacctagcaagatggtttacttgctgatggatagtagctggtggttgagagccagtaaaggggttaaataataactagggaatcgttaaccttttatgaaccagaaaattgcatgatgtgctcagtgttaatgtaagagtcatctgacagcagagtataggatgaaagaggtagaaagaggagagaacccaggaggtcccaggggagttgcaattggattggagtgatggacgtcaaaaggaaagaaatggccaaaatcttgagatttttcaaaggaaaagtccacacagttttcatttgtctcccatatccagtcagccatagagatacatctgagatttcaatgataagtacttatgaaaatagtccccctgatagcattatttttaaaagcaaaatgagatattgtttagaagggtgctcttttctctgttttccaaaaacagacatgggaaagaagatgacgaggttgtagcaaactaatgaaataggatgaatccgattttggcaggtgtgtattaatcaaggcctctatatgctgctggttgggatggacagctaacatatcggaaaacccgtatatgcaatgtatctcgagaatgcagacttttcaaagtttcatacctttaaaaccagtcacatagaggtgaaaagtttatgcagataaaattgtccatggtagcactgtttgcaacagtgagcatttggagacaatgtaagtgttcagtgataggggagggttatgtagaacaggatacatcatattgccttagtaaagtgtagttcatggtttttattttctttctgcttcaacttggagaaatgctgtgttaaatgttaaataaaatcagagatacagtcttttgcatattcaaagagagcataattataaatatgggggaaaaagttgtgaatgtagaaaagactataaaaatatttactaaaatgttgatatttctttgagttgttggattgtgagagtttcgttcctgtgtttctttttaccccctaataatggtataggaggagacattgaagttaagggaacaaagaaaccaggctttggagttaggctgatctgaatgcaagtcttggctctgccacttactggatgtataaccttggccaattcattcaactctaagcttccattttgtcatctgtcaaagggagattataaaagaacttatttctgtagtgagaagtatatgaataatgcttttgaagagtcttgcatagtacttagcacctaagtattaaataaacattttacatcaatgtattttttaaatgtattatattacatgtattattattacagtattttatagtgagggtaatataattattaatgaaataaatatagcaagaattaccaaggcagtgcaggctaaattactgctaaatttcatgatttccagaaaagtctttatcccatctcaggatctttttccaaaacttgagtttccttactgtcctgactcagccagtttcccagagtcccagtgagactatttcacatgtttgacaagctacatcacacccccattctcatacccaatccccactcttttctgtctcagacaccctgtcagcctggctggcatattgtcccctggtcttagttccaactcttttcaccctccaagtgatagtttgctaatgtgatcatctagtctgccggcctttggggcaggcataaggaaattggaaataggcacaggtctctctatgcctcttatgaagagcctcctctgttagaagagtctccctaatagacttctagttcccttgctttgttgtataacttctcagagtgattttcatgatcagaatttcctgccaagacaaacagaacaccagctttatgaaagcctgataagtaagagattttgaagccagcagggccatactctgtgtcccagtcaccaatataaacactcctagaatcttatcaactacatatccacctagaatcttatcaactacatattcacctggaatcttatcaactacttatccacctaggcctggtgctgccctttggaagtactagaacttttgttgtcatgactattagtatattctagatattgctgaagtctttttccatattttcatttccatgataaaaataatacataattatggaaaatttagaaaataaataaagtctttccacagagctaaatttaactagttgaccagatttcctttgtggcatgcattttgcaagccaaaacaatctcaaatttgtgaggggggtgtaaggactcaaaagaacttttatgtacacattatgcatgcacacattactcagagaaaataaaatgtcttagaaatgggcaacttttaataatgacttaggaagtaatgttatttgttgatttttaaaaatagctttggaagaatatatttgctgcagattttacgtgcaaataaacattattgtaggagacttgcactttgtaaaataggttgaaagttaaaatcttcccttttgcattgactctaaggaagttgtccagctgttcatagaattccaaggtgaaaaaatgatatggctgaatagacaaatctcatggactaatgccaattgaatgcctcattgaaagtagaaactgttgagccccagaaactgttgagctggggctattttgtgaaagtaaaccaatatttaaagcttctctgtggtcttcatggatattaaataaaatattctacaaaagcatgtcagaggcaacttaaatgataatgacctagaaatataagggttgtatcagaaaacaatggagacaaaataattcgtccaccctgtctttaaaatgacactgtaggtatttctgatgttttggtggggagaaattagatatgcttaaagaatggacttcaaagcccacagccatcacccttctctctggtcgtcaggggccatgctggtgacgctctctgcctcccatccaggcctctgaatgctcagctctgctgtgcttttgagcacgttatgtttttctgtgctgtcttctggcactccattctttttctgtacactttggtctttcacccaaccacaatacctgatatccaaagacttgcagacatggatatttttactggaaaatgaggaacctgtgcaaattattattttcttttactctctcttttctttttttttctcttttcctgtgggacacgggttgtgagttgtttgaaataagccagaagcttcatagctcctttgcttttgtatttgaaatggcaccctgatcactttaaagagctaatgtacttcctatgggcctgaaatttctcaactggactcccatagcagaatttggcctggtagttaagaaaattaattactctgatcgcgagggtgaagcaatagttcccaactccccatagtaatcattaaaatgtcatctacttaggagacatcttggcatgggatttataaggtttgtgagctgaggactaaggttcagtgatccttccagcagtgcctcctcgttctagaggaaggctgtgggagataaggttttaagacgggagtgaaattattactttagatctttagatttaacatttgaatggtaacattcaccactgaaaaataggaaacaacaaaacctaaagttgctaccatcccatctatcattgttgtctctattgttaagtgatggccaactgtatgagggtatttccctcatgagaggtaaaatttttaagttgccccacccttctctactatgaatcttggcctttaacctaatggaaagaatttggaatcagaagacatagtctcaggccccattctcagcccttagaaactgtacaacattgagaaaatctttcaaagtctgtaaccgtcccttttgttcaggtgttaattaagtcaaataaattcatatttgtgaaaatgtttggtaactgtaaaattctacctacaaattccttcaggaagtctcaaatgagtgcctgctatattccagacctgaacaaaatcaggggttggaaaagtgtggcccacaggccacactcagcctgcctcctgtttttgtcaataaagttttattgaaacacacatctatttgtttatgttttgcctatggctgctttcatgctacaaaggcaagaggtcacaataagtcataacaaggtacacaaggccaaaaatatttaccatctgacccttcacagaaaaaaattgctgacccttcaactcaatgttaaatgcataaagaggattcctaccctcacgtatcttatcgtctcctgaggcagataaattagtaaacaattataataaacatgatgcaatatctaaaatgctaggagaattctaggcagcagctgaaatttagcttagaaaaatcaaaggatgccccccagaggacatgaaacaagctatctttaaggatgttggcttggcagacaacagacctactgtagggagagagaatactctgtacaagaacatggaagagaactgcaatgtggtaaagaaatggtgagtcctctggaaggattagagaattaggaattataaagagaataaacagtggcagattatgagcctctaacgttgtaaacaagttaaattgtgaagaataccatacagtctgataaggagcttgaaattctttctgtaggctaagcactgtcgctcactcatttaatcctagcactttcagcggttgaggagggaggatagcttgagctcaggaattccagatcagcctgggcaacatagtgagaactcatctctacaaaacattaaaaaattagccagacattgtggcatgcatctgtagtcccagctactcaagtggctgagacaggaagatcacttgagcccaggagttcggaggctacagtgacctatgattttgccaatgcactctaggcaacaaagcaagatcgtgtcaaaaaacaaaaacaaaacaaaacaaaacctgtagacattaggaaaatcactgaaggatctcaagtggagaggtaaggtaatgaaatttgtattcataaagaccacagtttttataagagtgaaggacagcttgtagaagggcaacaccagaagtagggaaaacagtagaatgctggtatagtagtccaagctagagatccccagctaagggagtgatagggagaatgggggaaagtgatggatacaagaggcattgaagcagtagatgcaacagaacatgtgcaccaagtacatgcgagaggttaggaagacgaaggattccaggatggcacccagattttgaattagctgaatggtgatatccttaacttacatttcacataggaaaaggaccaaactggaggcatgaaaaaagcagaaattttgttaacataatgtgacttgctcattgttatattctattagcaaaatccagtcaaggataagatatatatgtttggaatgcaagaaaggtgattgagatctagggacaaattttggagttgttggtttaaagatggcaatggggtaaggtcatgaatgcctccaagggaccgtgtgaacccagaagagagtcaagggtgaacccagaagagaatcaaggacagattcctagagacttctaacattgaatggatggtcagagaaagagataacagaaaaggagtctgagaatggcacgcatattgatagaaaaaacatttggcaagagcaaaggtatattttgtgatgaaaactactcattacacaaggaacacctagaataacctcagcttaacaggacactgggcagaatttataacaatgaccagttactgttcttaccttcacccttcagctttaaaaaaaaaaaaacccacaggaataagtataatctagcaggaaaaaaaatgatattctatagcatagccaggtcctgaaaatataaagaactaacctggcttcttctgctcttagagcactggctccagaagggcagaaatttgtgtcattttgattcctgctatatcccctagcaccgtgtcctacatagatactcaataatttttgttgaacaaatggaatcgcgttacttcattgaacaagatgataatctaatagccagtgagtggttccaggtaacatcaactacgtaagcctagtgtattagtccattttcatgcttctgataaagacatacccaaggctgggaagaaaaagaagtttaattggacttacagttccacgtggctgaggtggagagacctcagaatcatggcgggaggcaaaagacacttcttatatggtggcagcaagagaaaacaaagaagaagcaaaaatggaaacccctgacaaacctgtcagatcttgtgagacttattcactatcacaagaatagcacgggaatgaccagcccccatgatccaattacctcccgctgggtccctcccatagcacgtggaaattctcagagatacaattaaagttgagttttgggtaagaacacagccaaacatatcattccatccctgaccctccaaatctcatgtcctcatatatcaaaaccaatcatgccttcccaacagtcccccaaagtcttaactcattccagcattaacccaaaagtccacagtccaaattctcatctgagacaaggcacgtcacttctgcctatgagcctataaaatcaaaagcaagctaattacttcctagatacaaagagggtacaggtattgagtaaatagagccattccaagtgggagaaatcagccaaaacaaaggggttacaggcccccatgcaagtccaaaatccagtggggcagtcaaattttaaagctccaaaatgatctcctttgactccaggtctcacattcaggtcatgctgatacaagaggtgggttcccatggtcttaggcagctctgcccctgtggctttgcagggtacagcctccatcctggctgctttcataggctggcatcgagtgtctgcagcttttctagacagacagtgtaagctgttggtggatctaccattctggggtctggaggatggtggccctcttttctcatagctctactaggcagtgccccagaagggactctgtgtggggactctgaccccacatttcccttccgcaatgccctagcagaagttctccatgaggaccctgcccctgcagcaaacttttgcctaggcatccaggtgtttctatacatcttaaatctaggcagaggttcccaaacctcaattcatgacttctgtgcatccacaggctcaacaccacatagctgccaaggcttggggcttccaccctctgaagccacagcccaaactctacgttggcccctttcagccatggctggagtggctgggatgcagggtaccacatccctaggctgcacacagcacagggaccctgggcccagcccatgaaaccactgtttcctcctgggcctctgggcctgtgatgggaggggctgccatgaaggtctctgacatggcctggagacatttttcccatggtcttggggattaacattaaactccttgctacttatgcaaatttctgcagctggcttgaatttctccccagaaaatgggtttttcttttctactcattatcaggctgcaaattttctgaacttttatgctctgtttcccttctaaaacagaatgcttttacagcacctaagtcaccttttgaatgctttgctgcttaagaatttcttccaccagataccctaaatcatctctctcaagttttaaaatttcacagatctctagggcaggggcagaatgccaccagtctctttgccaaaacataacaagagtcacctttgctccagttcccaagttcctcatctccatctgagaccacctcagcctgtatcttattgttcatatcactatcagcatttttctcgaagccattcaacaagtctttaggaggttccaaactttcccacattttcctgtcttcttctgagccctccaaactgctccaacctctgcctgttacccagttccaaagtcacatccacatttttggatatcttttcagcaacgccccactctattagtaccaatttactgtatcagtccattttcaagctgctgataaagacatactcaagactgggaaaaaaaaaagaggtttaattggacttacagttccacatggctggggaggcctcagaatcatggcaggaggtaaaaggtacttcttacattgtggaggcaagagaaaatgaggaagatgcaaacacagaaacccctgataaacccatcagatcttgtgagacttattcgctatcacgagaatagcatgggaaagaccagcccctgtgattcaattacctcccactgggttcctcccacaagacatgggaattctgggagatacaactaaagttgagatttcggtaggaacacagccaaaccatatcacctggaatcttagaaacttggtattttcagactagtactaggaaatattccatcttaagggtattggtaagcaagttcttcctctcaagtttatctcccctcacctgatatttttcttttcatcctgacaaacaagcagagctcttctgattataaaaataataatacttttaatggggctgtttgtttttcttgtaaattcgtttaagtaccttatagatgctgtatattagacctttgtcagatgcagagattgcaaaaactttctcccattctgtaggttttctgttcactctgatgatagattcttttgctgtgcagaagttctttagttcaatcagatccaatttatcaatttttgcttttgttgccattgcttttggcatcttcatcatgaaatctttacccgtgcctatgttctgaatggtattgcctaaattttcttctatggtttttatagtgtggggttttacatttaagtctttaatccatcttgagtttatttttaaatatggtataaagaaggggtccagtttcaattttctgcatatggctagctagcactatttattaaatagggaatcctttcaacacacattggggcctgttggaaggttgtgggggtgtgagatggtggatgggaggaaggagagcatcaggaagaatagctaatggctgttgggcttaatacataggtgataggaagatctgtgcagcaaaccaccatggcacacgtttaactatgtaacaaaccggcacatcctgcatagttactcctgaacttaaaggctggaaaaaagagatactcttaatattaagactgcatgttaaaagggtgcaagcactacaatgaatgagttctaaaagaggctggccacaccaagggagactcagtcagggaatctgtgaccacccatcagtgatgggtggagcctattagatcaattactgcagtacatagtaaaattgccagttcttctggtttcttatctgggattagtagcagatcttgaaatacaaaaatttatttctacatcttctgtcataattctcactactaaataacttctaccacttctagctcctatcaggtcaaccccaacttccttgtctatcatttgagatccaatattgccatactaccttgaattatttagcatcagctgaagaaaaaaaaaatcaccttgacttaaaaagcttgccctctgcttttaagtgtataaagaaatttggttcccttgttttatggagcaaacttcaaagtggaagggagaaaaaaatcaagcagacctcaagtcacctgatttccagtccactaaaccacactctgctttcttgccaataccaatactcgattgtgtttccagggaagaaggaatggtaaaacaaagagtgagaaagctgagccaactgtgatagaggcacaggccaatccctcagactccttttttctaattgaacaccagatataatcccagccctttaaataaaattacctaattaatcctaattaattagtgagcccttatatttatagaaggggttttcttagtgtctgtcttctcaccctccccacttccctgcctctactacatttctttccatctaaaaagaaaagtttcatttttaggggtcctttttaaaaacaatttccatgtcaacatttattaatgcttgtgtgtgtgcatgcatgcctgcatatatacacttagagcacgtttttttagaaggcagtaatggtgctgccttttatcaccttctttctcctctttaaatggaaagcactgaacccagatgcccaaccacggaagatattcttccagaagcagcatctggcttcctggcaagcccttcaggcaagttgtttggggagcattgctgttgtctctcggtctgtcacgtgtatcagataccgtggcctctctggctggcatgtcccggtagctgccaattcctttcagttcacctttaattctgagaaactagtttcctcattttcatttcttactggacttatttttctccccactgcccataggaattccaggacaaacctaagtcctcactgctttctgcctgtcaagctcctttccagacctccgtcttttgaacccaaatgaaaacctcagccatttactcctacattaaaataggttattttaaataatatttcttagccacttcttgtcagcaaagctccttgtaaactgtggagttgttccctgaaaagaaaaacaaaacattccatccgagtcatttattctggtctgtacacaagacatgaaagtgttcttgacatttgtgtattatttagttaaatcgtattggctccctacatccttgtcacaccatgaacaaaagagcatcacggggctgggaaagacgagaccatgctgcagttagtcaaggctgtgcagcctttacacatagcacccgctccaggaaactgcatttcttaaagtggcttttttttttttttacctgttaatatatattttttaattgtgaaggatcttctggggttttttatggataattgttaagaacacagagtccgatggtagcccacgcaacaggaagccgtgacaaggtgctgacaagtccggcagcagtacccagaatgcagaggagaaagcagaaattagagctgcagggtgacatccaggaatacttaacacagggtatctgcaaattttcatgtcgttggggtttttttttctcatgcaagaaaaaagtacatattatatatgagatttcagttctcaagactgtaatgtctaggctgagaaaaggctgaagttgagcaatggacaggaggaaatctcagccataaataatattttgtctgtagctagtagcagactcaacccacacttgactttgaagcagtacataactagaaccctaggcttcacttgaatgagagtccctagggggcaaagaaaggaggttaggggctgtcttggtcaggccattgggaaaaatcttttttggaagtagctacaaaacagtagagctcaaatttaaggttagcatttttgagcctattatgtttctgcctcaatgacattttttggtctataatttttccccagctccattcattaatatgtaaaaagaaagtttaaaaatacatgccaaactcacaagttttacactacattattgcccttggtatagaggttcctgtatcttatttctggtcatttcttctcctcttctatatcctacccatattctttttaactaaactgtttcctcatacatttttccactgttctctacctttcctcccaatattcatcatcctctgcagattctttctcttgtctgtactctgaaaactcacttcacattcaaaacattgttgcctacatcatctgtccacacatttattcatgaaacaaatacaggttgagtacttactgtgtggtagatgctgagctggaaatgaagacacttttaccaggaaagcaataaagctctaggatctggaagcttcccttcccatgtctgggagtgttcacatccctcaatctcattcttaatccccattttctggctctatatccttccacttctaacaggaatttgtaaaccagcctatttttaacaggcattaagtcagtccttccattggactaagtaaaccccttctcttctttctcatttcaaagagacaacaagtagaacacgttgggacagaaccgctgtaaggggtgggcaagacataggttggttctctggcactgaaaacacctcttttcctgctctccatgaactgatggtcaatagacgcctcttcatagtcttccctatatcaattttgtacattcatttctttacttcatttattgattttcatttacctcccatagagtttgtgatacgaaaagataaagaaatcactccaaatgaacttttgtctaattaatctgtgtatatgttgttgggcattaaaacagattaaatttgcttacatagtgaaaaggcatgtaaagtgatatgttatctaaatcagaatttttttccatctggacacttcatagcaatcatttcacatctcagaaagattccattctcaaacacatctcttctttgataacagcacaactctgcccttgcaactctgccctcttggcttcctgctcacccatcttttccacttttctttcatttccaactgccattccagagccacgtacttcccctggtgctaacttttaagtcaacagaagggaattccattctctctcctggtgccacatttcctatttagggccagatattccccacagagatattgaggcattttactgctagtttacatgtcctactatatttttctaactagtgggaaaaaagaaataaatgtacgccctgccctctctgacctcatcttcctttcatatcacatttaaaataaccaattcctggagtggcaagctcttaaagcaattcatacttccctggcaatcacagaaatgtacccttcatcttggcagaggaaggcctatttcttccacctgttgtcacattctttttattctctgcatgggtttcccacacatacaccctataataagttagataaggttagaagcaggtggctacatagagaatcaaaagaaatgttcattgtcatgtacgagaaatttctgatcccaaagcacttttttttccaagaaatggtaatatatagaaaattggcctgcagttagttgtatgtaggattgtggatactggggagagtgggggcggggaagatgatgaccagagagagcgttttgttcgtcatgaatgcagctacctgaaaaacactagctaattagcagtctgtagccacacaacacagcagtttagtataagaagtgaacaatactttacctaattgaaactacagagcagacttaggtaggctgaatgtaattacacagattggaagtcagccaggacgccgaggttaacaatcccttcactcacaaaaagcaccacgggaactttaatgaccacaagtggtaagggccgctatcctgcagcccagcgaaaggcctcacctctcgcaaccgagactccatcagaagagcctaatggcgtcaactaattgctagaaaaaaagactgccctctatcgacgcagatgcacctgtgccgtgtgactcattcaccaagcacagtaaacacttttaagtactagggcgaagggggattcgaatgaatgagggcatcgagggggtcaagtggtggacaataggaactgtgaagtctcctctgcctgccggtcctgtggccagcacttctgctgcactagcttccctaaaagaggcacacgacttcccaaacttcagtgtgctcacaaaccaaattacctagcaatcttgttaaaaaatgcagattctgggtcgggcacggtggctcacgcctgtaatcccagcacttttggaggccgaggcgggcggatcacaaggtcaggagatcaagaccatcctggctaacacggtgaaaccccatctctactaaacatacaaaaaattagccaggcgtggtggcgggcgcctgtagtcccagctactcgggaggctgaggcagaatggtgtgaacctgggaggtggagcttgcagtgagccgagagccactgcgctccagcctgggcgacagagcaagactccgtctcaaaaaaaaaaaaaaaaaaatgcagattctgattcaagaagtctgggatgaggcctgagattctgtacagagaacaagctcccaggtgccactgctgctgctggtctgcagaccacactttcagaacaggatctaaagacaagaaacaggaggaggaaagaggttctctgtggccaagaaatcaaagtctgggctaaaagaaagaggactttaacatggggtttgacacccagaattatcaggtttgcatcatttgtcctaggaactaaatgaagcagaaacatggagtgtccaaaataataatccaatccaaaacccactctcagaatggctttttccatggggagaagaaaaggtaaagaacatggtctctgaatgtgctttataaatgaggtgcctactctgcaaagtgtccagctgtagtgctgtggcagggggatatcagcagtggtctgtcaggacctgcaagagccaaaagtgtctgactctcaagatgaatcaagagaagacaagatggcagaatgcaaattgtcaaagcttaacctatgaacaaggatgggagtaataattttccttcaaatgtttgcaaaataaaatcaaagttgctgaaaaacgtggacctttttaaactttttttttttttggaaacggagtcttgctctgtcgcctaggctggagtgcagtggcgggatcttggctcactgcaagctccgcctcccgggttcaagcaattctcctgcctcagcctcctgagtagctggaactacaggcgcccaccactgcgcccagctaattttttgtattttagtagagacagggtttcactgtattgcgcaggctgttctcgaactcctgaactcaggcaatccaccggcctcggcctcggcctcccaaagtgctgggattacaggcttaaacttatgttatgcaaacatggtttactgctgtgctacctagacttccataataaagcctcagtatagcattaaaaacttaattgttggttagattaatttgtattctttagttatttcctcaatgctttttatactaatttctatgtattttgtgacttcttaatgacagaattcactttagatacttgaaaagaaacacacacacacacacactcacacacacacacacggcaagacccaattaatcactggttggtgcagtatggttttctacgtttagacatgctgcaaacatgttgtaaactagataaggctggagtttaaatatacatttatcctaatatatacctcatcagtatagctgtaaaaaatgccgttacttgccaacaatatataaatttaggatatccttcaaaatttatcatttgaagtgttcagctacctgaagctggcagggcaaagtacatatacaagcagaagcacataagcaccaatgaatgaagcatgcctatggagtgcctgctctgtgttccatactatacgcaggaaagtggagaagataaaagtgtgcaatcggaagtctaaggttttgcctttgcagtgctactaatgtaacaggaagggaacaaaacacttaagaaaaaacagaacagagactaattaactgttaaacagtatgtgcagcctgtaattcaaatgagaaatgggctgaaagagttgagaagtctccagtgaaaggtggagctggtgagatttggatgttccatggagtggctggagaaaaaccaagagggaaccaggatataggtgtgagcagcctgtcctgtggccagaggcaaaggagaaggagagacctgagtgcagggtggggccaggttatgggtggggctggcagaaacttttcttggaatctgacatctcaggctataggaaaccaaggcaggttactgagcagttgaaaaatttctgcttttgtatttaagtacagtcacacaccacataatgacacatccatcaataatggaccttacatatgatggtggtcccatgagattatgacactgaatttttgctgtatcttttctatatttcaatacacaaataccactgtgttaaaactgcctgcagtatttagtacagtaacatgctgtgcaggtttatagcctaggagcactagcctaggtatgtagtaggctataccatctaggcttgtgtaagtacaccctataatgttcacataactgtgaaattgcctgatgatgcatttatcagaatgtatccccctcgttaagtgacacactgccatctcaaacaacctatccattggtcctatgtgaaatggacttagggatggaggggctgaaggaggaggctggggctgaaggaggatgctggagcaaagccggaaagccaacagttctcttaacgtgactacggagcaattgttttggtgttggctgtggagctcattgggaagagaggaattcctagggcagctttgaagtaggtcaggagtattcgctggtatttttgatatgaatctccacaaaggactggaaagagtcccagacagtgccacagggtgcaatctatagattaaagagagtggtggtgccactgataaaaccaggtcatctgtgtactcttactgagcacctactgtatgccaggcactgttctaggagcttatcacacatcggtcaacttaacaaaaaccatccttgccctcatgcaggttaaaagggggagtcagttacagccttttgcgtaggaatgacatgaactgacttccgttttaaaggatcactgtgttgatagtacattctaggtgaacaagagtagacacagagaaaaactgtaaattatccagttgccaatttaattagaaagcagtatttgtgggtggacagtgctgtgtgcatctgcctctgataggttaagagaatctaaagaactgggctccagccccagcttcagtatgaggttccacagtgacttcaggcacgtcacttcacgtctcagccactgttttatcaccttatcatagaaataatacctaatttatccaccttcatgtgtgtgtgtgtgtgtgtgtgtatgtgtgtgatctaatgacataaagaaagtaaaatccaagagtacatactgttgcttcaagtttgccacaattggaaacccaagcagagaaattcgatcttacattaaatccagtagctggagtggagaggtcactggattcagaagcagaaaacccaagtttgcatcctaggtttatgactctaaccgtgtcaccttggataacagcttctctgagtgtcagtttcctcttcagttacaatacctaatacctcaaaggacttttagaaaattcagagttacatgtgaatgaaagcccactataaactctaaatcatcgaagagacaaagttgtttcttaccgccctgtcaggctctgactgcaaccatagagagctgtactactacccctggtgtaaaattgtaattaatccttcctcatatgtgggttaactttaatccttcagggcaggaatcattttttcctggaccttgtagtgttccattgaactggtagagagtcaagcaataggaggtatttaacaaatcattttagcaagtgggtaagtggaggtgtgatattaaaggaggaaatgtaggtttgggaattaggtttttagaggaatatttcaaaccatgaaagtgcgtgcatttaccaagcatgttcagagcccctgaaaaaaggatggagttaaacacaactttcggacaagcatagtaagaataactagccagcaaaggaaaaaaatgtagaaaataaaattcacaacgatcagcattataagagtctgaagagcatcatcaaatagtaatacacaacttctgctccaaaaggatcaaaaaacatttcaattcgctatttcacagaaatttcaatcagaaatgtctaataacctccacccacttatctaataaccacactctagcacagagataactcaagttcctcaggagagcttcaagattcagaagttctttctgaattaccaaaggataacaatgtggtgtccattgtaattttaatactaattttgttgttcgattattgttaatccacatatgataagtgtttttgaccagagcatttgcttaatcagaaccttctatactccatctaagtaaaagaagttttattgggaatgaaagaaaattgcacataaaaccttttttcatagcctgtttcttaaggacacagcagtcaatcttgtgacatacctagccaataatctccactgcctctccgaagcccacttctttgtgtctttttaactgacattttggaattcacctgaaaacaccaagaatttgccaagacaaatttggcctgtggagaagacaccatattcaacaccaatctggagaaaacaacgtactctgctcttttaattcattatgattttaacatttattatcacatcattatcacaatttgaggattataacttgttctcagaaaactggcccctaggcaataaagagttaagaccagaaagttcactccctgtgcccttccttttttcttatcacaacccctccttccctgtggttccacaaaatgaataatgccttagacatagttatggcaatgctaatatttgaacagtaaaagataccttaagaccttcctcaagattttttaaggactcatttaatgtcagtgtcaaggttctgtgaggaataattaatataacaaaacaaggtctatgtgcccatcgattgccagggaatttatgcaggtaactcattaatgccggtgggggttcagcatgtaaatcccgaagcctcgatgaggaaatgggaccaaatgatttttccccctataaaaaacacaaacaatgacaagtataaaagcagataacctgaatatctatacaaacagctatatggcttgtaaaagttttccatttacatcctgtcacctcttctttgtgcatgtataaaagatgggacaattatttcaacaaacctacccatataaatcaatgcagttttgctgtgggaagactgggtgtttaaggcatttaatatttcagcattgccagattatcaccaggatccatttcgcattgtggtcaagtgcatgattagcactgtgacagggtattggccattttcatatgaagatctgcaaatcctagtaaacaaataccagttggaaaaattaagaacaagtctgtggactggaatgcaccctacttgtaatgggaacaaaaagctggcaatcaattttaaagaaaaagctaaatcacagcagaatgacctactttaaggcatttgccaaagaggcagtgtttttagacagctcttctaaagtagcgtctttctgtctatgccatctgcagatttattactctgcctgaaaaaaacaaccaaaaaaaaaagaaaaaaaaaagctttatttgaatgatactgagagcctggtctataggaaagattccagtattgtgggtaccacacccacacctactgatgtggtccaaggttttgctttagaggcacctaattaagaaaccctgactcatttacatggagacgtttgatctaaattacactccaaaccacaccaaattgggagcatctgtgaatgtgaaatgtttgttccctgtgacggctagaacagggccagctctggacggcacatgttcaagtgacgaaaaatatttcacatgtaacgtacttctgagacccacttttccactaataattcatagtgaacctaaccaagtatctgtacctccacaattatttcaggctgtgaaaaattatgtcactatttttttcctgctgcaagaaagaagtagaagaccacctactttgtttgctgtcattgataaagggccttaactgcagccaatagcaaaaggcaaacctggatagcacaaaggctggtcactatatagatatataaatctcagcttgggatccacagacacagagcagtgatctaaagggctaagtctcagttaccccctccatcactgccctaacctcttccagcctttccactcggcttgctggttctcagcaaagctttgccttccaactccactgaggctgtacttgtatgcaaaagagccagcccttaggatgaggtgagaatattgatagggtagaggtagcatcaactgcaattagaggacatgtcatttccactgggtaaaatgtctaagaaagtaaaaagaaaacatttctgccattggatgtgatgaacagtactcagcctacagttcacacgaaagagtgttgtatttcaagtataataaacagagttttatagatacagtcaatcctgcactttggtacctgatggccgctttaccttattcggccatatatcacctatatttcagtgggagtccaaggaaaaagaaagaaacttttaaaaaaataacctcaggttcttttgtttaagaaagatattaatgcatttatctgatgtactgttttttgcagtagctagaatgagatttgaatatattaatattttcagcagcagagcccagggactccagttaataacttatggatggctacatagatatactttagacagaggtaaggttttcagctctcatgttggtaaggctcagacagatcgaatgaacggggctgttctccatgagtctttgttgtgggcatgcattgtaatggtatggagacagagttcttctggttgtctacacagcctggattcaataaactgttatatatgcatattatgacaatgtggtcaaggaaaccagattttttttactctaccttcaaatgcctatggagcctaaatctggtgcttatttttcttgtcctcattcaatatgttaacatattcataatttgacacaggttacgtttgttttataattaaagttatggagttagctggaaaagcattcagactatactgaattttttaaaaatgtgtatcttttttctatattatactgcagtgttcaatgtgaatctgaagtctggataatcccagactgtgttagtttgctagggcagccataacacaatacgacacaccaggcggcttaaaaagcagccatttatgttctcacacttctggaggctggaagtccaaggtcaagatatcagcaggtttgttttattctgaggtctctccccttggcttgcacatggccaccttcttgctgttttacccttcacgtggttttacttttgtgctttttttccctggtgtctctctgcgagtctaaatttcctctttctataaggacatcagtcaaattggattaaaatccaccctaatggccttatttttaacttaatgacctttttaaaggcccagtctccaaatgcagtcacattctgagctaacggtagctggtgccttatcatataaattggggtggggttaggtgggataactcagcccatatcacacacaaagggtatattcacatccaagctgttgacatgccccgtaccaatgatgtatttatttgagccccaaactaaaacctaaattaatatttgtaagtctggagtattcttctagtatgatttttcagtcacatcctctatgggaatgaaacaatgatgactttgtaaggtttaggggaacaagcagcagcatgactcttctcataccttcttgctagactggaaggaagcagttcctgtgtacagtaagtgttaccacagtgcccgaccgagccccaccccgccttcagggaccccggtctagaggcataagtgcctccctctccattactgccgccctccattaggagcagataatgcgtgagctaccactctcacaataaaacattgcacttacaccacacctttcaactcagcatttccaaatgcttgaaaaatcattattatttttattatttatttgtggaatcccagcagtctactcagcactgggaagtgcagtgaaagccacagagctatggtctcagttacgcagacttaaaccgacactcaagtttcctccgcgatgtaccagtaaaaagtctgaaggtggacgtttttgcatgtgcatgcatagcaagaaaaaaagtgaaaaggcaatttaggtctgagttacccctgcggctcacatacctgagaaaagagccatttgttagtattgttctgataaatgaaggacccaagcaagaacaaagcaagaaagcaaacacagttttagaccctacagctcagaaaatggaaatgcatttccctaatcaagggcatctacaataacacttttaaaaggattattaagcaatgcaggaagtagaaatcaatcaggctctgcttgttgttcactggtcattatttcctgggtcaaatctgcttgacattcaatttaatacagtctttcatcaagtcaaaaggccttagagagaaactttcactggccacccacattttcagcagggctgttgcctggtccgattcacttttgttttccaagtctttaccatcattgcatattacgcctacttctattgaaacagctactgcttttgatgatttccacagtggtgaacatatattgttcatccctgtaatgctagaagctggtccagtgcttggcatgtagtaggtgctcaataaatatgagatctgtgaaaaacaaattttcaccttacaaaggcattctcaaaatgaatttgacacatcctgctctctctacaaagttacaagctaagatagatcacagcaaagcagagatattgcagacacagattgaaaaccaagtgaaataatgatttagattgccttaaatcaaagtgactaaatgcatttttagaaagtacatgttgaaagttatcttgactagtcttccatttagccaggaagttttctggaagaagtataagtttagggattttttgtgaggtgagagggagaaatcataaataagtatgtgttctagaaagtggggtaagaccacagaggagtcctaaaggtattaatagaggtcaggaattggactttagaaaaacagaagaggcaaggaattgagaacagaggaaaatcagattacttggagtgttctaatgaatggctttcaaagaagataaagaccaccatatatagaaagctactttgaagatataaaagggtttgttagtaacatgactgggcatatactagagtagaaattccaaaataagagctgccacaacgcagccaaagtgagaagatatttctctggtcacctgtgcttggtgccagccaccatcctctactgttcttcattgtccctagagctggaggcttagaaaggcctagacacacactgtaatcgtatgtctctttcagtttgctggagagtgactcacaaaagggtgtttcccgtgctgacacaaaagtatgcaatatttctttgtctttcaaactggtaattcataaagactgtatactattccgtattggacaatgttgaggcttaaatatcctaagccccttataagaaggatgctgcaaacatgagaataaggggtgtcttctgaaaatgagtgaactaagccacttaggaagttgctggcctcatctcgaaacccaccaaataacagcagtacagctagaaatagagttcaaaagtcaaaagtgcctggctgccctaaaattttctcattgcatgacttggttcaaggggcttcattatattttgtatttagatttcacacgtttatattccacagtgcagtgtctctttaaaaatgtaactgttgagtctaaaaatcaggaagtagtaaagtggcttccagatacatatagaaggtttttgtttgggtggtgtgtgggaaggggttggttttgtttttaattttgtgcaatttcagtccagtcaacacctagagcactcctttaaaaaaaaaaaaaaaaaaaaaaaaaagggaaaaaggctttttttttttttttttgattcagtgtgcacagaatttattgcagacatctgggagtttaaccagagacatccaagaggccagtagaagtggagcagcaatagagagtaatagttgacttttatcctcatttttaagagggaaatggtctattggttttagaggtgaaacgctagaaaggaaactgctcaatcctctcatttcaaagatgagcaaacttgggactttcccaagtcatctagccactttgcatgttctataacccaaatttactttaaattgtggaaagaaaatggaaataaactaccttgaaggcatttgagctccaactgactaattattctaggtcgttaaatacagttagagttgttagattttctggtttccaatgggggtaattccatcacagagattccttttctatcaaattgttggtgcttcattttcttagctctgcctggtggtctctattacctccatataagaaggcttttcttttccaccaaatgaatgaattttctcatcaattccagtcatgcctcatacatctccctctctaggactttctccacactcgtccctccagttcaggttcctctgtgcgctctctgcctatcccagattctaccacttcttcagaggacctggctcaatatcctgctcttttagatctgctattcagagatctggtcctaactgcagagacttttccatactttgaattcatagcctttcttatgaatagctgtaaaggtgaatttgatgcttgcatatagcatagtgaatttagggcaaaggctatgcttattattttttgattcttgcagaatagcacgaatagacacaacttattgaatactaaccatatgtcccatatcttgctgaaaaattttaaatacatgttctcaattcaacaaccatgtaaagtcattattatcctcaatttatggaagcaaaatctagcatccagagagaaggtgttattttcctagatcaaccaactaaaagtgatggggtcagtatttaaaatgcaagtatgtctgaatccagagcccctgtggccagcttctatgcaaaattgccttccttctcagagttacttgcacataaaaatcactaaatatttgtgaattagacagatgaatgaatgaatgatttggaacctgttcctttcaccaatttgacttgcaaaagggaaaataataagaaattctgaatcttgttgcctctggacagatgtggtcagttagcacaagcaaagcagaaatgttctcacaagttaacagtaaaaatcactggacacctacatggaggtaaaatgactcacagggaatgaagcaagcctggaataaaatttggcccaaatccaacaagcatttggaacctcatagcatgcatttggaatactaccttcatcccttattttttcttcacctttattgtcttagtcattttaagtatattttaacttttttatattgaatgcatttttaaaatgcagtatattctttgtggaagtattaatcaggttaatatgaaataaaataagattgatgctcatatttacaaagtaagttcagaaacgtttactgacagggtagaagtaggtagctcacaacctcacatttaattttagccaagcatagaactataactgtgaagctgtatttcagggaagatctaaaatgtatggatttccaggaggtgtttaaataatacaggttgtcagtattaaaatcagaagtgtttaaaggccaatggaaaacatatgagattttcatagaattaaaaaaaaaaactcactaaacagtacacatagctcctggtttgaaaatgattttatctttaaataccccataaggtttgcaaactttaaaaaacagagatgagggttgactaaaagacatggttttcttgaagtttcttggtaaagtaatatcaagataataaggaaaccctccttccccatttttgtttttgggttttttttttttttttttttgagcacaccagatggcatttctctctgttgccatcactgacacacaattatgttttctaatagagagggaggctgggagccactgatctaccccagtcatgtcacatgaatatctccactttcataaagaaagtctttgtccaggatttctccagtggtggtaaaggagcagtaatgttgaggcaactctcagttcatgggaacaaacttaggtcaatggatgagccatggtcaggaggtcagttgggagaagagaaagagtacttattatcaaatcgtcattgtgccctctgctccatcagcgagcatcattgtctaagacaagttctcaaggacctctgaagaatctgagttgagccctttctaggaatgctgaaaaggatggagatctgattcattttaacggcaggcatgtgtgtgaccaaataaatcagatccctgaagagtctttttccagatgcatatgtagcatttgtacttcatctgagcccattttggagagtgaaggcccttcaaaagtaaaataatctgtgtggattgaggatttggtacccaagaacccagacttcaattcccagttacatccatcaactgtgccttcagttactgatttcatctctaagctagaaaaataaaaactgtcccaacttcgtttttcagaaaatacagtagcaagtttaacaaacttatttcccaactcgtgttgtaagacaagctaccatacattttcagtcagaagctataatttattcagagattaaaagaattcatttgcatttcttcatttgcttagtctatgagattatgaggaatttttctctgtttcaggacattgacccctacctaataagataaaaaagtgtgtgttttggggaggacttgggggaatatgtacaatacctaagatggaatttctagagtctttaaaatctttaagtccataatctataatatctacaaaattttcttaaaaaattatttaagaaatttcttatctacattttttactgaaaaactacttctgcaaaaaatttgttttaagaaatttctcttttatctaaatttgttttataaaaatcttaactataaccctgcccccattcatgttaatatttgatcttgatctttttgtgaagcatccagtctagtctagcaggtgagggccttccctaccttggtttagatgtgcatgaatgctaagttctcccttcgaacagtcacggtccttttctcatcagagatagccaggggcagcagcaaagggtgaatgagatccatcatgaaatgtccagtgtcaatgtgctctcccaatttacttactgaccttcagcttgcagccacactcctgaccctcatgagatggagcctaagggggaaatggcactgaggaccaattcctgtgtcctgttggtctgtggtctcaattaagtgctaattaattaccactggcatctttggcatcgcttgtcaaattgcatttaggagtatattttcactgtttaaacatcagtagtccaaaacccacgctaaaaatcccatgttctcataaatccccctttgttccctcgtaaaaaattgtgttttaaaaattcaacaaatacatctatagccactgcaggtagctttcaaatacaagaaacaggaattggtattgtcgattttgattaattgtacttcattaataaacatcctgttattctgtctccacctgcagttgctgatgttgcctggaatcaattaactcatataatttgatttattttacaaagacattttgggatgtgctgcgctgatgataaaggtcctattttagcagttcttgattgcaagttagattgtacctgaatggatttctgtttctacatggatatgtatacatgagtgtgtgatttgcaagtgagtaggaagaaaatactccttgaagaagtcttgaattaaagaattcattttaaacatggtggggggtattcctcctgaatattctgactttatctgaagactcctaagaaatacagatcctgaaatgtcgtgtcctctctcttaatcaagaccttttatttagcagattagcaaatattccttcaaattaaaaaacgaaatagtagtactaagcaccaaagttaaaacacccactagaactatgattttagagacagatattcgattcagcttcatgtataatttactttgctttgttttaaacgtaatttctttttctctcctaaatatttataagccatggtttctggatcaatctatttgataccattatttactatgtgaaaacctatcttaggcttccataggtatctaagaaatgctaagtttagtgcaagtgacaaaagcccaactcaaacagtttagacaaaaaagagaatttgctggatcacataactgaaaattccacaatcagacgtgactttgggcgtgactagattcaattgccaaagggtattgcatagaatttgtttctttccatttctaaactctgcttgcctctgggttagctttgacttaaaaatctttctccctggtagcaagatggcaacaccagaattgtatcgtatcagcttagcgtactcaggggcaagtaagcttctctctcactgtgtgaaaagaaaattctcaaaaaattattcttcttgtcctggattgagccccttattatttgttcgttcctgatccattctctatggcagaggactgcatggctctcattagtcaggcttgagacacaggcccactcaaccacacagactagaagtgagggagaagcagttttccccaaagatggtcttagcaagaagaagaagaatgactagaagtcaaaaaaaaatccacttatccacagtagtaaagtataactacaatattttttgtccaacaaaactatcctgtctctgcaacaatatttcaatcaatagacataaatgaaggctaactcacattaaggagcgctggtgcctataattagaaaaggttgcctatccctcattctcatttgctactactaaattgacaaggcttatgaagaatatcaaagtactatccatccatctgtgcatttcttcatccatgtaacactcatgagcacatgtgatgagacaggcactaaactgggcactgggactacaagaataagtaagccaggtccttaacctatatgtgtcaggcgcagtggctcacgtctgtaatcctagcactttgggaggccgaggtgggtatcaccggaggtcaggagtggatcacctgaggtcaggagttcgagaccagcctgaccaacatggtgaaaccttgtctctactaaatacaaaaaattagccgggcatggtggtgcatgctataacctcagctactcaggaggctgaggcaggagattcatttgaacccaggaggtggaggttgcagtgagcccagattgtaccactgcactccagcctgggcaacaagagcgaaactctgtcaaaaaaaaaaaaaagcaaaaaaacaaacaacacacctatatgtggagacagtagagtacagtgataggagataaggctttggaattaaatagagtagggttccaatcccagctcttttacttacacaaagtgtagagtgtatagttatagacaaagtgtagaatgtagacaaatttctcatttcttctaagcttcagttttcatatctacaaattattataagaattaagtgggtaatatatattaggtgtccagcatagagccaagcacataagttttcaaaaattaacagttactactctgtatatcaaatgagataatgcaagcaaattgctttacacaatgcctggcacacagtaagccctcaggaaatgatagctggaagctattgtcatatgaaatagaatgaaggactagatctaaaagaaagcaacatttcaaaacccaaccaacatctatcatgataaatttggaaaaggccttgagagttcacccagatctatccctaccctcagagaaaacactttagtaattttagacataatagaatatttttctctccaaagaaagtgtttgcaaagcaactctcttccttttgtgctcatatttcatcagtttacataatatttaattaaattacataattacaataataagtacaactggcataaacttgtttgggactctctcctgggactttcctctagtgggaacagatgagcgcagttgagagtcattaactagccgggaacattgaatatgttgtgggcattggtcaatatgttttacggaggagatagagagctgattaagtgggagtcagccaagagagtttctactgcattgcagcagtctcctgcattctcttcatttacatgaatgctcctggttcttaaaactttgtctcacatttgacctatttatgcattttctaaacatccttcagtagctgatatgcagaaagctttattactagaattgtaaacatgccttatagaattgttttgttattctatagtcataaccatgtattgggcagagaaagcaatgtaaactgaaaatgtagaacatgaggatgaatgctgggcactgccctttgtacatttcttctgccagtcataaacaataggttttaaattcattcctaagaagaaaatgatagaaacatgtctcgcacgtgaaaatgatactatcaattgagtagaaccaaaaagattcgaacatgcttatttaatgtcctctggctttctgactggccaaatgcatgaacataaggaaccattcttcccatccctaatggtaatctcatgaaaacttttgaaacctatttattttatttatttatttatttatttatttatttatttatttattttttgagatggagttttcactcttgttgcccaggctggagtgcaatggcacgatctcggctcactgcaagctccgcctcctgggttcaagtgattctcctgcctcagccttctgagtagctggaattacaggcatgcgccaccacacccggctaaatttttgtatttttaatagagccggggtttcaccatgccggtcaggttggtctcaaactcctgacctcaggtgatctgcccatctcagcctcccaaagttgaaacctgttcgtttactgcattgcaatcctcagaatcagagcaccacaaacctgagaagcatcggcagcatatatatattttttaacttgggctttggtgggggattcatgatgccattttcagttttaaataatattcactagcagatgaaatctattgaagttcttatttataaggtacttctgctgagacaagccttagaaacagctcaatctgtgcctcaggaagttaaatttttttttatcagagtagcaaataagctatcatatagaactggtcaaatccagaaggaatatgcctttcactagtagtctgtggagtcatttagcgttcttacgaataaaggcacatttcaatcctcaactgtggatttgaacatttggatttttcccaagtaatcactggccatcccagcagataccaatattgtataggttggttgactggttaaagcagacttgagccagatcaattcctttgacttgaacaacttccgggcctctcttcgaacatcatggagactaactgatcatcattatttatgtgagataggttctctgtagtcacgataatgtcaagcatttttggtgttaataacaatttaaagtttaataattacttttggtgagaaaaagatttgtgagcaaaagcatcatttttacttgtttctatttcttttcttaatccatgaattgactgagctctaaaatccgcaaatcacatgctttgctttgtaaagaacttacattcaccagcaattacacagactgatatgtccttaacgccaggttaaatgtccttaacgccaacaaaagacactctggttggtcccattccttggttcaagcctccgcccatgattcaaacagccgtaacgaaaacaaggtcaggtgtcctcaattgggagaaaaaggaatattctggtgaatgatcatggatcattttgaatgaagatcactggaaagagaggctagaaccaggttatcaaaggaataatgtgtcctattatggagctgagattttaccttatggacaatagaaccagctgctggtttttaagcagagaagactgacccagtgatgaggctaagagagcccatctgcatgcacactccatcttggaaggctctgtgacctgtgcttaggggcaaacagtgatcgcaggtgaagtatacttggaagaccagaaaaagacagcagccttagaagaagatgatagcaaaaacaacaagagggaatcaagctccctagcaatcctgctggggttcaaagctagattctggtcctcatgggaaatgaaaagtaaaaccgagaatcaatatcacaagcagaaaggccatttgggaaaactggccacatacagctcagtcctgctgcatcctgaaatcacaatcctgtgagctggcaaggtccataggctcttataagaaacttgagtgcagctgaagcaggcaagaaatagcgcccagagtccttgggaattttgcatcatcattccacttaaaattaaaatttgctcaaagctccaactcttctaaaattagaaccccagtatctttcaggttatcagaaagggttgatattttcttgaggtatttctggtctgatttcctgctacccttgaacccacaactcactcatgccttcccattggccaatgttctcttatcttgacaattccttttcattgttttccaaggctcactctaggccatagcattcagctgacttttactgaagattgacagaggatagagagatcacatcacacccagcctagctgataatttaaaatgcaaactatgtaaacttaaataataggtgcccctgttactaaaatgcaccttgatcattctccccacacccccaactaaggaattttcatagattgtcatttccatttggtctccaacttcccaccgtgtcattctgccccaacactctactttcataatctctctttttgcacacagctctcataagtccatttttgtgttttatgcagagaatttggttctctttttttctagctgtgtttgagagattatgtttccacaaccaaaatggtccatcaaaatgttttgctaagcaaaacagaaaaaaaaaatgattttctccactaggaggaattttgctgtcagatattaaaatagcattttccctcatatacatgaatctacaagatgagcgtaattatatctcttattagcttaggcaaggattgatagatctaaaccaatctgcagagaatctactgggctatatgtatatgtcctgaccgttgtggctaccactgtctgtctgcatattaggaacaacagatacatcagaatctacctcttgactttctgtgacaggtagaaatgtagtgtctccagcaaggcaattcccttgagccattacacatgcaaaatatttcctcaattgaaaaatgctactggaaattttcacagagaactctaggaaagaaattcctgaaattgcagtgtaaaaactcataaaagagctctgcaataagaagcaatattctcaccaggctgttgatactgtttgagaaatttacatcaaaacagcgtcagcggtggtgctaacaagcgcagtgtcaacgagatccgccaggtctgtcagttgatgtagtcccaggtacagcaggggcagtttgctgtcttattgtagaataaatgtgggccccaaaactgtcagtagcacagagctatttagtgccttaaaagacaatgaaattctctcaggaaatgagaaacacaggatctactcagcttccagtttgagggccatatttatgtgtttcagcatggatttacactgccttttgttttgcaaatgctaataccatcccatccatttttttccagaaatattgaagctgtggttaattgaaaaaaaaagaaaaagaaaggcgaggatttagcagctatattcaatgtactgtattgctataaaactacttcacatcctgtcactcatctccctcctccattcttgtcccacccaaaatcactgaaccaaacaatgacaaaaatataaaaggaccaaagcaactcacccgcattgcccagtagtggtcccttggcaaacacggtgaaaacatcactttggcagatgacagacacttgggccttggctagggcattagtgaacaatgttattaaggactaattagatggcttttgttgaaatatttccaaagaaatgagcaaaataaagctgacctaaagaaaatattttaaaacctcccactgagcatgctcagagaaagcattttgacttcttttatttttaaaatgctcaaccattttcttcaaaaacttggcttgatcttcctgattcagtgataactgaagtcatgccaactttgatgtttttagcttcagctgttttagagctatatgtgatccccccaaaaaggttggaatgaattttttttctgagtgaagaaggaagcatatgttttaaccctcatgtgccttttttgaaaaggatgaattaacatcctataatattttatctttgagcttaaaataaaagagtttagtttgaaagtcaaagagacatttttcagaaattgaaatggagacttgggccttcaagaattaagactatgaattgtatctgctttaccgaatacatttggagacttgcatgtctgctgctattgttttaaaatggcagcagagaccaggcagcctggagacttgagcaagatggaccacacacaaaccaaatttcaggacatcaaaaggacataaaactaatatgcagaaatgccggagcatcttgaatacattttttttccaaccagatatatgacatgaagaatgagaaataaaaatgaactcagaaagctttaatccacctgatgatcttattttcccttctaagttatagaaaaaggaagggaagaaaaaacaataagcagctagaaactgattggtaccaaatataattgatcccattaaagaaggagctacatagaggagacagttatcagttatcaggaagatttctgagagccaggtctatattcttttttattattgaccatgcccatgatttgtcagatttcccctgggaccaactggtctttggatctccttaggacacaccagaggcaataaaaaaaggaaatcacactaattatagcagatctgatcacaagctaggaaggtagacaacaattctagtcatgcacagagctatgtcaaatggctccatggttggtgcaaacctgaaatgagaagtggcttctgacttagggtgagacatttcccacgtgactgcagatggaaacacaggatatccgtgcttccagatcagacataggtcatttttgtggaagaccgtgcaacgccaagtctagaagtctaataatatcaagttaaatttcttcaagtcagaactcctactacattctggtacgtacccaaaacactggaaaaccaacaaaaggaaagaatcggtaaagaaatgacaaatgtctccctcttatgtcagaagaaatttgggcagaaaaattgaaaccagaatgaaagaaaggtttaaaaggaaattgagtctgtgtttacaaaacgattccaatctgaggtgaactgtccaactcaaccagttgctttggagaaacatgattaaagtgatgactgaggtgttttgcgtgctagcctcagtttcctttattcccctcacagtccagtgacagccaatcagaaaagaacctggcccggaggcttgtcagtgataataattgaaaacatctgtccatgcagcaagtgtgggaagcccatgcagctccctgacagagcgagttctcacacagcaaagccataaccacgactgctcatattctccttcacagacttttctcactgccagctgtctttattctcctgccaggaaagcaaggggcctggggctccaacccaggctggggttaagtgagctgggaccaggggaagaaaggggacaggctggctcccagctctgggtctagagacaagggatatctgattgggaactaaagagagcggcgactgaggaaaaagaatagcaaacagagaaaccaaacaaactgaagaggacagataggcagcgggataagaagcgttcagattctaaactcaggtgagccgggtttaaaccttggcacagcattttcactatgtcactgggcaacctccctgagcctcaggtttttcgtctctaaaatgggaataatagtacctgtctcacaatgttttcatgaaaaataagataatgcacttcagtagaacaaggcaaggactgaatacacattagctcctttagaagggggcttcccagacagtcattaaggtgtagaggtagaagacctctactgaggggcatgctacttcggtcatgtgtagggaaggccctactgatggtgttctattgacttggacagtctccatgtggttcccgcagatgttctttccctgcctgtggcctgtgttaagctgctttatcaacctgtgcctcttagtttcttgcgatctctgtactgactcctgtggcctctctctgccatgaaagccatgttcggggacagcactaggttgtacctggtctgtcttcccttgctcctcgtgtgccaatgcctcgttccccgtttcagcagtttgccagatctttcagcttggtataaaacatatcaaggggatatctggttagaagaatgccagcaaaacattatttcagccaactgaggagaaacttccagattgtaggttagagagtaatcaaaacacggaaagttggagtaaggggaagaaagaaaataaagtccttagtagcaaggtttggatgttctctctgccttccagaagaaaaaaaaaacattattaagaatataatgaaccaatagatttacaaaggaaatataaacaaaatgccataaaggacaatattttaaaatttcaaattatccagatcatttcattgtttaagataccctgtgtacataaattaatcacctttggaaactgcattaacagtcacatcacaattgtatttatagctaactcacaattatttgatgtatgatgttcacttggaagctggaaagaataaatccagcttgcaaagaagcagaacttacttttagggtggggcttaggtcctgagaaaatctagctcaacacatgggtggcaaggaataatacaaaaggagagacttggggaggccaactttgtatcattagttaagaacagttctgcattgtatatgtatccaacataaacacttggctaaggatgttattctactgacagtgtttggttttccttatggtcatcagctggatgactaccgctacttggctgagaagcacttcatccataaagaaaagcaccataagtaataatgagtgcgagtttgtgttagttgcagagcaagaattcagattcaacaagggatttttttaatccaattgaaatgaatcaaactgtttaacctaattgagcttctataaatcaggagtgttgtcatattagtaatccccctagataaggcactgcaaagaggcgccgcacaagagtgcgaatgtataaacacaaaatacagggaatctactgaagctcctttattcagcatccttgtacatctcccctctctttataatcactattgcaataaaattatcacttaaccaccaacattagtacatctttttaatcattgagagactattatagttttcctatgattctgtcttcaatatccacctacaaccatggaaaggcctgatcttttcatgactataaaatcaacaaaatatagggagggagaaaatgtacatccgttgggaactgggatttaaaaatacgtactatgaatattgtaaagttattgttttaaaaatgaagcagatctatatgtgctcacctgaagggatcaccaagacatatcccatttacatagatttctctaaaatccgcttcaaatatttatctttgtaaattacttctaatatattcctaaagtcactgtttgtctactttgatacctctattcctttaaattttcccttctttctatactcacttaagggcaacgtggctcaaaacccccaggagcttgcctctcaagttcgcagattccttctcatccaggaataccttttgttgcttccatagatgtatctggttaccttttgaaattacttttctgctgaatggcacattcctggcatacatgccaccattccccattcctgaacccatgttgacataactgagtgatcatatcacccttttacactgtgacttcaccttcagggtcctttctcacagagcaggcagccaccatcagccaggtgaagcaaatctgtgtgccatcccttctgccagagcaggtctctttgtccaatgccaccattcttttataagtgtaagaaaacaaaaactcagactatagacacaccctcatgcttccaagagatggagactcatgtctgtttccttaaaaatcttgtttctgcctttctatttcactcatcactttgataaataaatgtaaaggtacatataaacatcctataatatataaatgtatatttaaaatattcatatatatgcaagagattactacaaactttttacattttagggttcacttattttgcaattgatggctgtgcttgcaatgtgtttctgagcttgtcaactttccttgcaaagtatttcaagttacaggaaggaaaaggtgtttaaaattgttaataggatttgcagcacaaggaaattagaaattcttctgcccaactgtctgatattcaaaatgaggaaactgaagctgagcaaggctaagtgagtgcccagagtactacaggtagtaagaagcgaagccagaagagaaaaatcaggctttctgtttccttgttcaagttgatctttcgttccagtaattaaaactggtgtgcagtaatgaggcaaaagcagcttcgtcaaatcagcttttttctccaacttcctatggtattgtgggtcagttgacctcacgaatttccacacaattctatatgtcagtgaagtagattatttagacattctcttctgtatatattatttggattatgtagaaattacccgtaagaaaccaagacttttcaacacgaacctcatgacttccacattctatttttgataccttaacctaaagtaatttcacactctcataaaacctttgaaaatggagcatccacagatgatattttgcacttaccaaattcctttttcaaaaaaaaaccctctaaatgttacattatattgttgtatttgcaaattatatcctccagtcatcctctgtaattttttttcaaagaaagtaaaacacagaagataggaagaacatagggagaaatgacacagaaaaagcctcaacatctaacaaacatgaatgtctgttgacagcgttgttctgactgcagacagaaaaatattggggagtacctcacttctgttcagacagtcccttttgggtgagaaaaagcttaatctgtcagccaaacataaaacaaaaactatttgtaataagaagttactgaatgccctaacttttttaccacaaatgaaataggaggaaagctgaaggtaacatatcacctaaatgcaaagagtttgcaatctaattgagagagtaaaacatatgtgaatgaaataacttagcgataaaaataaaacatatcaacaacaatgtaatacaatctgaatgcttaaatgccaagaaagcaaataagcaagtgatcagaatatgattctaaaagtcttcctagtagagacatgcttaaatatgtttttgagtagcatgattggcataaatgtggcaataaaaatagtagtaatataagtgcaaaacaactcaaatgtgtgtggccataaggatacatgagcaggtaaattgacctctaagccctgaatggatgctatctgctttatcatcttttaactttttttttgttaatagatttttcaaaccagatttaggtttaaaaaactgatcagaatcaccactggggcctgtcagggggtggggagaaaggggaggaagagcattaggacaaatacctaatgcatgcagggcttaaaacctagatgatgggttgataggtgcagcaaaccaccatggcatatgtatacctatgtaacaaacctgcacgctcagcacgtgtattcatgtatcccagaacttaaaaaaaaagaaaaaaaaagatcggagacttcccatatacttcctctccacccaccacatacacacaatttctcctatcattaaaatcttgtgttggtgtggtatatttgttgtaacttatgagccaatattgagacattaattaaagtccatagtttacattaggcttcactctttacactgtacattctatggattttgaccaatgtgtaatgacatgtaaccaccattatagtgtcagagaatagttttttactaccctaaaaatctgctgtgttccaccttttcattcctccctccctccccaaaacctctgcaaccactgttctttttctgtctccaaagttttgccttttccaggatgtcaggtgcttggaatcatatagtatacagcgattttagattggcctctttcacctggcgatatgcatttaagattcttcttgttcttttatggtttgatagcttatttctttttattgctaaactatattccgttgtatggatataccacagctgtttatccattcattatccattcatttatcagaggacatctagaatctttaacttaaaaacaaaaatttttaaacttaagtttttaaccaacatatttctcaggtagaaaatatggttctcagaacacatatactttttaccttgagacttccttgtctgaggcaatacgttgtgattttttggaacacaatactaaactatcatttgtgttcttaaacttgaatcaaagtccacttcaccttcttgcttctgttcttaggcaacgtgagagcaattaattttagaatatagaacaaaaagatgagaattacaaaattaagttgtgaattttcaaatgaatgtggttactatcaaacatctactagaggtcatgtctttctttttctctgcaactacaacactatgttgtcttcacagtgaatcagaatataattccaaatttgaaattatgcctttttctctcttctttggttacactgttaattatgtccaaaaagcaattttatgatcttttcaaaagtgacatcctaagctgttgttgattctctaagtggaaacaaatgtcacctggcccacctatgtctttgtttttgatgtcaaataacattgataactaaatcactctaatatagggggaaagaaaagctgccctgccatttgaagggaatttgcaatgaaattttacttggccccacgattatgtatacctactggttttaagacagcacacaggaggctttgccaagaaaattttaaagttcaagcagaaaaaataatcacaatatctttcagtcatttgctgcgtgtatttgtttccttaaaatgcacagctaaatgctctctacacacagatatcacttggtaggcggagtatatcttattactgggttattttccagtacatttggcatagttaaggtaaagtgtattaactttctctcaaaataaagatgaaaacagagttgtagcggccgtgaatgcttcagccattgtcaggaagttaaaaactgacaggaggcccaaataatcaactcagcctgctgcatataccatagttttcccctgggatatctggtctaatccaacaatgtatctgactggcatgaatgtagaattactttcaataaagattttatttcaagcttggatgatttcccccaaaacatcttgtcactaaggcaaagtatatcatagaatatctgattttttttttccccctacaagtcagcttttgagagggggaaaaaaatacacattacaactcaagtactcaactcaggtcaattcactgtaaaaaatcacattttaacatatctacactgattaaagatttgctgtgttaaagaagtcagggtgctgtcaaagagagcttaccctaaagtctggaaatgtaaaaaataagtaccacacttgctccactccagtctgcattctgcctgcagtggcctccaatcgaagggcaggcaggacagatgagtccaccagctaacacccggctccgagaatatttgtctttttgcaagtaaggaacatttcaaggtcacatcttccaataagtatgaaattgtttccaggctataagagaaatatgaatggcctggtcatgatcacacgaaaacgatcttcatttctctatgcatccttctctctctctttattccattctcttccttcatgatgccacattaagtcagcatgttcaagataggggaacagtaggtaacagttcattactctattttgaattcccttaaacgtttcatttagtacttgcgtacattatttcagccttggtgtcacattgtttaatttatgcttggttcatataatcttaaaaatagcttgtgttacctacagagtttcaccccttactaaaagcacacaaatcatatgatttagtgctaatgggataggagtaattattttaacatttaataatcataacacattatatttatatgttttaaattcaaaatcccttttatctctattattatattttatgattaacatacaatgttacaataagtatgtacacgaaagagcactcagcatggataatagtagataaaactctagagaagcatggaaagggctagagttgagtccctggttctttgactttattagcactgtgtaacctttggacagatcattaaccaagaagtccctaaccctggctgcacaccaggctcatctgtgaagctttttagcaactctgagtcccgggtctcaaccctgaactaccaaatcagaatctctgtgcaattcctttcctttattaaaagcctgagccagagtggaaaaccagtgagttctaatctccctttccatgtttataaaacaattgacagaaagaaatgtaatcacatataataaaaattaatgtttctggctgggcgtggtggctcacacctatgatcccagcactttggaaggccgaggtaggcagatcacctgaggtcaggagttcgagaccagcctggccaacatggtgaaaccccatctctattaaaaatccaaagaattagtggggcatgatggcgcatgcctataatcccagccactcaggaggctaaggcaggagaactgcttgaaccagggaggcagaggttgcagtgagccgggacagtgccattgcactccggcacaggcagcaaaaacgtaaatcagtctcaagaaaaaaaaaatgtttctctagcttgcaaagggttttcacatacatttttaaatttaatcttcaaaacaacctatgagatcagttttgccattaacttcactttctaaatgaagaatctgaggctcagagaaatggtagggcccatctaagatcacagtcagtacctatagaactagcacttaagattttgagcttccagatcaagagcaatggttctttccctccagttagaagagaatcacatgcagagcgtttaaaatgtacccaggcctaactgcaagccgtttgcaacagattttatgtggatgggtcccagaggttaatatggttttgaatgttccacagatgatattaatatgcagtctggatagagaatttctgccctagaatgatcagaacaagtttggaaaatataaagtactatacagatatagcgtgatgattttatctcagttttgctgataattaagcatgaattcaaagggggagggaaatgatgcgtgaacacaaggctgttcagatctaggctccacattagatgtcaggtcttccctttcatgagccagctctatttctattggaacttctctgactccccagagctcatggttgctgtcacaggttagatttaacatggcgccagttacctattaacaccaacagaagtaaagatggagcagcatggggtagaaagagaagtcaaactatgacattgggccggacaaagcctggctacccacagaaggtctggggcatccagggcccatcacagttgtctccgggaggatgaagatggcttggccttgatacactcactgtgatcagtcattggccgtgggctgtctccaagagtcccctggggtgaggtggctctcttcagctgaggcaaaccctgcaggggctgacagctgaagctgcctgcggacttgacacttggaaactgggcaacaagtctttcctcaaagagagacctgggtagcacatcaagggtccagcacagtccaccctttgtggtgctcggagtgtgttcttcatgttcatttgagaagcagctcccccaggactctcagggagagaggagatctttgaaggggaatctttagaaggatgaactacaagctctgcagctacagctggacctgagcccagctcattgtctccatcctccactctctattcgagactcccctcatcctcaacaatggcgtctgctggtcgtggtggctgccctaatgtaatgtcccagaccctcatccatgggagatccaagctcctacataccatgtcttctcagacaagaatttctgccctgttaatgccccatcacaactgggcaacagagaacttggaagccctatgtggatcatctgggtgccactctgtccccctggtgtaacagcaaccttgcctccgccctttgatcacagttaattatacctgcctagatggtgactctttgccttgactgctggtgcctggacccaagaagctccacctggcaagaaagcaacagtagcttagaagacagtgatttgatatatcattcaaatacaatgatatacagagaatagcatccttcctgactgcccatttattttgttccagaggatgctatgttctagcgaccatctcataattctctgagtcgggcccccttggctgcccctcaaccctgccacttgttattaaaattgcatctacctggcttctagtaattaagccccaccagctggcctctattaccagtgtctcagcatccccattacaatcagtgagcctagttctgtaatggactctcctatagtcaaccctcatttacagagtaaaggcccctataatcacatacaacttttctgtagaatatcaacgatgcttagcaacagctcttcaattcattgaccttggagttactatccacaacctcccactattatttctaaatgcctcatactttacaccagctagtctcctccacagatctaatgtcctaattcaccaccagggtgagttttcacaattgggctgccaccttgtgccaggacccgcctgcattccacctgccaccatcgatggactcctcattgccagtcaggctgcgagtgacccagctccaaatctccatcttattgctggctttctgggaccactcatagaactaataatcatgggttcagttctccagaaggagcccctgaaacagagtttggcatccagggcattgttaaaggttaacccctgtggaaggaaggaggtgggcaacaggattgggcagaggaataagctgaactgaagtgcagacccaagaaagcttcagccagacccacaggaagctctggggcacatagagcctgtcaaagtcgtcccacagtgggcagaaatagtccaggctttatactgactgactgagtaggggccagagcagtggctcacacctgtaatcccagcacttcaggaggctgaggcaggaagatcacctgaggccaggagttcgagaccagcctgggaaacatagtgagaccccatctctacaaaacaaaaaaattttttttaattagccgggcatggtggcacacacctgtagtcctagctactcagcaggtcgaggcgggaagatcgcttgacccaaggagttagaggttacaatgagctatgattgtgccactgcactctagcctgggcgacagaataagctcgtctcttaaatacatacataacataaaatatatgttgacagatcagtcagtgtccttgagcaaggaggcttattgcaattgaggcaaaccgtgaagaagatagctggcagccatcagctatccctgcagctatgcaggtagtccttccttgaaaggagatctaagtggcccatctctgcaagcaaagcagccaccataattatcaaattgacaaatgtacgaatggccccttaacagactaagagccttctgttataaagcttaatataatgcttgatagtggtccctaaaagatgaggcatttcatgtagaaattcttagaacaggtgatcacagttctacgtaccggacgatagaatcatgagttagcccagcatccgtatttacagggacatatgcagaaactggcacaatccattccttcaacgtagtacagatgataaatttatatgtgtaaatgcaaaataaattattttctatctttgagcaaagtattacatacattttgaaagggtttatattcctgcagatgcatcgagcattttaccaaaaataaaattatatggtcaaattttagatggccaaaaaaatggcatcattatctttagcttcaatccaaccatagcataaaacagataaaaattactctctattctaaattcctctcaccagttttgttcaaattaggtacatgtttggaaactcattgtcagataatatatgcgaaggaaagacacactgaacaattacaggcccttaagttctcaaacagttgcgctttttatttttgccttcatcttcttgtcctctcatacattacaccaactagtctcctccacagatctaatgttctaattcaccatcagggtgaaatttaggtgtgcaggaaatgtaattattgtgccaacattaaaattaatttatttttcaggccctattcttctaaatgacttgaatttggtcagttaagactgtcttccagattttttctggtgatgttgttagttctggagggctatgtaaagccgaagcatttggtggaggggcagaaaggatatccattaatacagcgtttcaacaaatacttgttgagtacttaataccatgagccaaatactaatcttagtctatggatacagcactaagcaaaaacagataaagtccttgtgcttacggcatttatattctgctggagaaagataataaagcagattagcagcagagaaagtatctagtttttcccacctctgcaggctggtcttcattcccttttcatttgcagtcatcatccccaacttccaatcccaggtctggatctcagtcactcttcacagagtactctgtgagctatctttggccaccctgcctagatatacaaagcagcaatttctacttaactgctcctgatatactaggtgtaggcagctctggaatcctgccatactactaggtcttccccaaagagaagaatacagatctgtctgattctcaggatcctcaagccttctaacagcctgcactcccagggaacgggattagcaaggaccagggcctgggccacttacgtgggacctcatcaaagtctcacctttcctagaccctccctccccaagtccagaaaatctttctctagcctggcagcaaagcagcctggctctttatctaccttccaatctactgatcaggccatccatattttggctgcagctctgaggcctttggcacttaggcttttgaaactcaaaaacacagtcctttgcaactcaactgccttgccttgcaaaaattaaaaggacttctgcttttctgcatcacccctgaactgagggcacagtgttgctgactgaacattggggaaagacccaatgtacaaggaagggtagagaagaaggctcagtcattatctactatctcatcttatccccagatgatactttgactttcccagaatgctcactctttcatcattaatccggcagcccaaaccacacttcaaagattgttcaaccttccatccaatacaggaatctcaaacatcctgcctgaatacttctcttgatggggaactcatagccttttttggtataaaatctttaatatctttaataggtgctcccaatgctttgccagcatatatgggggggggggatctataccaaatatcaatagtggtaatatctaagtagtagaattatgagggattcttattgtatctttgtctgcattttctaaattttctgcagtacatgtaaatgcattactgttttgaagcagtcttttctatttttacaacactaattcttcatacaaaggtaaaatccatctctgggccaattccagtaactggattacaagaggaaagtttattctttctttcacatcatggctttttgcattgagtcatgacttccctaaatattctttcccccctgctaaccaaacaccttcagttcctgcgctcttccatttagaagccactctctgggcacattcaccttggtgctcactagttttactgtgtccctcttaaagtcactgcagaaagtgtctaaaactggccaggtgtggtggctcacacctgtaatcccagcactttggagggccaggcagattacctgaggtagggagtttgagatcagcctgaccaacatggtgaaaccctgtctaaaaatacaaaaactagctgggtgtggtagcgggtgcctgtaatcctagctacttgggaggctgaggcaggagaattacttgaaactgggaggcagaggttgcagcgagctgagatcttgccactgcactccagcctgggtaacagagtgagactccatctcaaaaaaaaaaactctaaaacttatttttcctcagaaagtaaaattaagcgcatacaaactgaatgatgatacccaaattgcaactgattctcctttgactatttttcagtcatttaaacaaggagacaattttcaagaaaactgctaaagattttatgtaggcgccctcaatgaaaagtaaagttgctcttctcttcacctatataaaaaggaaaaacaaaagagaagttgaggaatactttgcatactgaaaatattccttttatgtttatctaacgtcacaaggcaaatatttaagtactatatactccactaataacttataattaggtgcattattctgcttggcttaattaatgctgatccatgcacaacactcaaagttctgtctaaaatattactagcacatactagtttttaaatagctatattggactaattcaggtagaaaataatgacagtcttataatttttttattgcttaaagtactcccaacataatatatttgctagcctttctcccctaaatgcagagcgatgccttcccaggatgttgatattatcagtggttattggtgtatcagcagagctcagggaataaagattaagaattcttttactgctgagacagttaaatgcaaatggctaaaaccattttaaaagcatgaggaaaaacacctaaaaaaaaaaataactgaaataatcattgtgctaatagggcatttccatttacaatgagatatgaatgctttcagaagtttttaaatctgtgtgaatatggaaaaaaggtaatacatgttaatttggtttttcttccatctgaacacccttcttatctgtgcagatatatccttggatgtgaattaggtgattaaaaaatcaaaatatgtcacccaagacttcttgttgactctgactcacttttttcccaagtcttcctcaggtctcaggcctctccattaagaagtctcttgatgtcaaattcaaaattcttggatcttagctacttgcagaaaatacatttatatcacagagtaataaagatctgcatcttaatctaggctctgccacttactgcctgtgtggcttggatcaaattttcagtctttctcagggtcattttgttcatctgaaaaagttcacctgaaaattttctcttacgtctaaacaaaagaaaaaaaaaatgggaagagaaatatcccaatatacagtaaagttacagtgatttaaacagcagagtactgaatcaaaatacacacagaggctgggcacagtggctcacgcctgtaatcccggcactgtgggaggctgagatgggcagatcactttagatcaggagtttgagaccagcctggccaatatagggaaaccccgtctctactaaaaatacaaaaaattagccaggcatggtaacgcgtgactgtaatcccagctacttgggaggctgaggcatgagagtcgcttcaacttggcaggtggagatttcattgagccgagacaatgcgactacattccagcctgggtgacagagtgagactctgtctcaaaaagaaaatatatatatatatacacatacatacatacatagagattatcagcacagtaccgtataccagggtgtgtggctgactgcaggcaatctgcacaaaaaaggcagtaccacaaatcaatggagagtggtggtttattcaacaaatgtcatagggaaaatcagctggtttccagaaaaaaagtaaattcagagtaccatcaaatttcacacaacaaaaatatttacaatgaattagatgatatgcttttaaaatctaaaatcatttttaaaaacaagactttgataatagttatctgatctctttaaatggttggattttataataataaaaacaaagataaaatccaaaagaaatagtactagatatgactacataagaacttaagtaaataaaattaagaaacacaagaattgggagaatgtatgtgccacaaaagtaatgaaaagttactcttaagacataaagaaacttagaaatctacatatgcaaggatttcactgtagcattgtctgtaatagcaaagaattagaagaagcaacctaaaaaccaaccagcagagaaatggttagataaattaaggtatttccatactatgaaatataacaacttttttaaaagaatgaggtatttttatatgtactgacttggaaacatgcccgtgatatatagttaaggggggaaaagcaaattatagcacattatgtattttttatttcatcttttctaaaaaggaaaaaaattatttatatacaagtgtgtgtgtatatatatataaatatatataaaataggtagatggatagatgagtagaaaaacatccagaaggaacacccatctgttaattatagttatgaagaaatttgactaggaaacaggggaggtttttactttttacttttcaatagttctgattagtactttttttttcccaaaagaccatgtattagttttgctgtacaaaataaaatgggttaaacaaacaaacataaaagtatacactctaaataggaaagagggcaggagatattcacaggagaggaaacacacgactgcttgtttgctttattaacttcttccccatttcctaaattcaaagaatcctaagttcaaagaatgacagactatttttcatgtatggcagttatttttaaaaagaataataccaaattataatactgctaacaggactaataggccctcccacatgttatgttttaaggaaaaaagagccataacttgataatctggtgctggttctcaagatgtggttcccaaccagaccagcagtactgttaccacttgggaacttgacaggaatgctgtttatcaagcctctccccagacttgctgaatcagaaatctggaggtggagcccagcaacctgccttttaataccttccaaattatcttcatgaagggtaaagtttgagaaccacggatcgaattgttacatttctattattttacactaaggcagaggtcttcatctgcagctttattgccatttggggctagataattctttgtcatcagagctgcctgtgcattacaaaatgtttagcaggatcctttgcctctacccattagacaccagtagcaatttcccaccccacctgctcatgacaatcaaaactgtctccagatattgccaaatctctcataggtggaggggtggggcttgggacagggtacaatattgctcctaaatggggaaccactgcctaaaaaaatactccaaaatgtggaggaagagtacatgggaaggttttatttatttatctcacttataccacgaaagcatatggcacaattcattctcttccatataaggtaatgatgaagtgatatatattacatatataagtcataggaattattcctgttagaagtgaaaaatgccagatacagaattatataaagtgcattttctcaaagttgtatgtagatacattatacaaacatttctatcatctctaaatgccaacagtgtcattctcctgctcgaacccaaagaaatgatttccatcacccttagaaataagtcccagatttttaccatgacccctaagtccctccgcagcatttcctacctctttccctttgctccctggcctccagccagactatgctctgcattcctcaccaccagggtattgtacctaccattccccgcccagaacacttgttcccctgatatgtgcacctcgacaggactctgctcaaatctcccttccttagagagggcttccctgagcactccgtctaatacacgtagcacttcttaccactctctgctcattagtattacctgggggctattcaaaaatgaaggcagcctggccttgcccaatattcaataaaagagaatctctgggaatggattccaagccatcagggtttttttaaagttccctagggtcagtggaagaaccattacttctctttttcttagcttttcttgaagtacttcagggcctgaagtcacattgtatattgcttagtgtatggtttgttgtctgttttccccactagattttaagcttcatctgagcagggattttgtctgttttactcattgcactatccctaatatccagaatagtgtcaaacacatagtaagtacgcaatagatttttatgaactaataaatggttacatcgagttcccagtgtttattatactcttctaaacttttcaaattttctctaatagaatgcgtttatcatcaaaaaaagaaattaaagctgattttaaaatctgcctttaaaatttgtgatatatttgaagcacagtgattagcacatagaaggtattaatagtaacaaacagtaactactgtaaatgtttctttttggtattatctactatgtcagggttttggttctgatattccattttatctgtggttgttatcaccttacagaacatatattctaataagaaataaattataaattgaagcctgtgggccattcatttttttactttttagttctcacatcttattaaatattctaaatattgctttagagatactttagaatatcactgtaatgcccaatcaataaaaatatgaaacaagtgaattgaaaatgtttcaatcttctgcattgaaattcatgcagaggttcaataaatgcaaataatctggccatgttagctatcaaaattcaactgccatataacgctcctttgctataatgtactaagaattatatacacctaactttaaagctaattttttgcttttattcaaaagcaaaaatgtcagaatatagcaataattcctatttaggatgatagttgttttggaaaataagaatgacatgatgtttagatataaaattgaagacttttcaatttgtttaagctaatggatatgtaaactggcatataaaaaatggctgaattatctttgagtgaccacctcgaaacacactaatgttaaatgcaaaaacacttgtgaatgctcccctgcttttccaatacttgagaatgtttctggcatacaactataactttaaagaagaaggtggaatttctgctaagtcctcaatcttataaaaaggccagtgtagatagcagtacagtttgtgcaaattgagggtaggcaagcatatggttagcatagatcccccccgaaatagttatagcacataggaaacataagttgagcatattgaaaatttattctatttttaacagcctctctttagttaagtggtcaaagtcacaattaacatttcacatgcagtggctgagctatattttgcaagccaggtgtgacctgatggcaggaatacatttaccaccacactctccttactccgtaaaactatcctaaagttatgtgtgttggaaaatcatggcattccacagatagagaagggaacatttctaatacaccttcataactggagagttgtcctccaggcaattatgtgactttcaacacactttgcaagtcactatagtaacagcaaagcacaaacttaaaagaaagttcacatccataaatctgtttggagctgaactattattaaaggctttggtcttcttaattcagcattaatttttggttgtatattaaagttttctttcagttcgagtcatttggctgtgattttatgtgactaagaaatttctttgaattagcaattcagctcattttgggaaaaacttacccagcataaggcttttttgagaggatttcttttccgggggtccaacatctgtagcactggattataaattatttctaaaataaacttaagttgatggatcattgttcttcccatttgggcctgacaaaaggtagcactcacatttcctttttttaatgctgtaaactgtgtatcacttctcagctcctgttagaaaactgaattcttactcattctaagattttataaacttgaattttacttagtggtataagaaatgcttttactaggaatacatacaaagtgctatttcatgaacaaattcataaaatcatatttttgtcaggctatttaaaactaagcagtataaataaatagcctttttcaagaattgcagtttggggcctttttttctgttagttaagcattcagaggcactaaactttgagctcttcatgttgcttagaatcaggtatctttgctatgatttcttgggagtaaattaatgatgagtcaacatacatcaagaggaattcccaaatattgacataaggtctaaatattttggggcctccttgcccactatcatgctaatgtctcaaccacgtgttttccttacctttctcattcagattagttcttttgccttttggcctttgttttgtcataaaaggggagtttctttcatttctttgctaaaaacaggttaaatggtagctcaaactttacaacacagttaaggaatttaagggcctaatgaaacctaagccctaccagaggggtggaactagccggaatgaccagaatctgacttctgagttagctgctacagagctgtgaagccagggtggcataggaggataaaattcctaacattttcagacttgtatatggtaggtccttagcaaaacacatagaacagcatttcttcatatacactcttcagtgttactcaaaaaagagaacctatgtacaagattcaagtaatttagggaggacacaagttaaagattggcaaggattttttttttctgcaggacttttcagagcctttattatgcttttatgcattgtgaatatccaagaagaaaaagtggcactcaattttctccaaaacttttactttggaatgccatttttcgtgaagcatatcagagaaatggtgttttacagaacccactttattgaaagatattgccaaatccatggtaaaaatgtatatggtttctggatcagatccacccctccaacaatacaactcaactaaagctcaagctacttgaagtacacctgactgtttttgagagttttccatctaagatactaaattgagttatattattccatgaaagccttttatttcttccagcagcctatatttcttttctacatatgttttactagttgaaaccttcagaaataatctctagctggtccccacagtaggagtgaaattatggtttctattgatgtgaggttaaaaaaaaataggtaataattagatgtaaaaagagagacatataataatataattttgcaggatagtattctaactgtatatttgaaattgtggttgatttcctctgtaatcctaaatcaaccacttaactatttaggagtccagcatggtagggaatacgtaagcttccatttgaatcatgacatttataacagcattaatacattttcccagacattcccagtttgggggccttctttgctggaaatgtctatccccacataatttaaactttaatatgagaatgtattagtcaacatgaattatatagttcagtatttgatgacttctaccccaaattgatctttaccttcaccttttctaacctaaagacagtgatttcttcacacatgaactactgtttggttgatatttggaaaataaattgcatatatatatcttaataaattgcatatatataaataataaattgcatatatatgcaaattgcatatatataaattgcatatatatgcaaattgcatatgtatatgtatgtgtatgtatatgtgtatgtatatgtatgtatatgtatatgtatgtatatgtatatgtatgtatataaatatatttatatacatataaattttatgtatatatttatatagattacatatatacacatacatacatattttgaaatagtaaataagccagatagcctgtgttctatataatactatatctaactttctttcttaatgactcttaattttttttaaagttactacaagtaacttgattttcctaactcaggaaaaaaatttcaagctgctgaaaaaatttaacctgcaataatgcaaatataacaggaatacaaaactatgtgttattttttaaatttattttaaaaatttattttttaaatgagattatttaaaacgtgcataagttttattaaaagcaaatggaaaacgtgcagggaaatggacataaaggatagaggtttgaggcagaatgaatattttatattgacacatgcataaaagcacaaaatgaacatttttccacaggaaatttaggtaatttgcattcgcagaaattcattacaggagtcccccacggtggcccagtggctgagaagccttctcccaagggagactcagacatgcaggcacatggctttccccaaggaggtactcagacacgcagctctagcctccaactcttccttctataactgtatcttcaatcgtctacttttacataatctctttcccctttcaaacttccttggttcactcccccacatttggccctgctctggtttccaagaccaggtcttttgctgagcagggaaaataaaaagaatgctgcagaaatagtaaatagtccagccccgtttcagttttcctgctctcccttcaatgcctgagtcccctttgagagctgagttatccctccacccacccaagctcctccaaagctatagaccccttccagcttccactcccatagcctcagactatccctccactaatgagctctttcatctcccttgatttttagcctcacctttgtgggtctcagttttggctcccagataccttaatctcactgtctctgcaccaactaaaactatagccataattaaataggtaactctatcttcaatcctgtcaatgtttacatcatccttttgccctttcagatttcctggactccaagtcctaatgttctactaccctgttggccaagatgccccattcacctttgtaccttcaatacagtcttgcttttgcttctaccttctccatggcccatgacctctgagccctgttctctgctagataaatcttatcaatttaggcatttgctaccaatgggtaaagttattaaaagaacttttacctaataagtactcaattgattatttatcttatctatctccatatttgcctctaaaatatgtgtgtgtgtgtgtgtgtgtgtgtgtgtgtgtgtgtggtaaaattaatgaaggagttcccatcataaaaaggtattaatttaaaaccaaattgggaaaaacctgcattgcctgtattgtgagtcttactaatggcttttataataggcatatctgggagaggctcaggagagatcttaaactgaggtagatgggcatgttaaagagaagcaaaggtccattccacttgccctctacagacaggaggatgcttaattcactcaataggattttggcaaatgaaataacaaagtggcatagcttcttatgttccaaaagaaactttaaatttgaagtctcagataactcacactctaaaaatatgaggatcccttccagaaatgtagccatgccaacagtgctcacaggtacaaatgctatctgcttaaagcagaagaaaagggaaaatgggaagcagaatatcctgaatattcagtctaaatttgagtgattttggccacaagaaatctactatcaccaggctgtccattacaattctaagagtaaaaaacgaaaattcagaccttcttacgatggatcgtatagtcaggtggaaggtggcagagtgaaaagccggcccagttactagggccaggagtcattacagacactgacagtgatgcttccacaggtactggacccagactgcctgggcagtctgggtcagtgtcagcttgtgtgacactggctgtcacaccactctatgcctcagtcttctcatttgttgaacaagcttaatagaagctacttcatgggcttgttatgatgatgaaatgagacaataaaattgcttagaacagtagttgattattattaatattggtcaggtcaaatatgctttgctggccacagtatgtgccatgagcttgcttggtggtgggcaagtaccaggcagtacacacatggcttaggccctgctcaaactctttcaagagatggacggcatggcctcttggtcacaaaagtggttcttcagagaatcaggtttgtgaagggaaaaaaaaaatgcagcagtcccccttatctgtggtttcactttccacggtttcagttatccaaagtcaaccatagtctgaaagtatgaaatggaaaattccagaaatatgcaattaataagtggcacaccattctgagtagcatgatgagttctcccaaccaggacgtaactcctccctttgtccagagtctccaagctgtctcctctggtgccattattcagagagtagccttcctagttatcagatcaatgttgtggcatcacagtgcttgtgtttgaggattccttattttacttcacaatggcccccaacgtgcaagagtaggtgatgctggcaattcacacatgccaaagagaagccataacgtgcttccattcagtggaaaggtggaaggtctcaacttaataaggaaagaataaaaactgtatgctgaggttgctatgatttatgttaagaatgaatcttccatctgtgaaattgtcaagtaggaaaaataaatttgtgctagttttgctgttgtgcctcagactgcaaaagttatggccgcagtgcatgatgagtgctgagttaagatggaaaaggcattacatctgtggatggaagagaaacatgttccaatagatggcaatctggttcggtactatccaaggtctcaggcatccactggcggcgggatggggtttctggagaatatcccccgaagataagcagggactactataataccagtctttctgccacctgtaattcagagatatgtaggcccacttaggccaaacaaagagaggcctctaaagtccaaccacctcaacaatgttccacacggagctctgaagccagagaccccactgtcctgtaaaaaagtgttcctttgctttgctttattttctacactcttatttcccttgggtttggatgtctggtagaatgaagagtttgatatttcttagcactctttctttccatatgctttccttatttccttatcactaaaaccccactcttctgaattttaatataaaatcaagtaggcttcagctgtcagaatagcattacttttttaattatcagtttctaggatggggctttattttctttttaggagtcctgtgttggaacaggcaagtcattaccattaataaaaccaaatcctagtgtttcattggtattccagctctccatagggtcctcacacaagcaaatacatatttgattccaatggggctcttttcctgtgcaaatgctacaggattctgcattttattgtggcattaagctaaattggctgtccaaatgaatggagacacttagaattttaccatataccaaactgtctcagagcttatctcctctacaaaacatattccagttagcatttgccaggaatactttactcaacactaatcaggaaaaacttaatttttttcaggctactaattgtgcagacattgttctggttatttcatttgggttcttatatatatatttttttgcatgcctctcacctgtttcctcaattgtctctaagcattttaaaggctgaatcttattaatttcacagtcatttttgctgtttaatatactcattcatttcacaaatatttgttgagtacccacaatgctcagctattatgggggtaaaaagttggacaaggcaatgtatcctttccccaaaactcataggttctacttccatacagtaaagtatgtagggtagaagattaaataatgttataatgcagttacttttcctgaatgagaaaccttttttaatcactccaaagtagccataacttcacttcaaactccagtgaaattatttttttttctctctctccacaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 1570 - DNA, 20351 bp, Homo sapiens
gggcgggctcctagacggccgcgcgcccgggaacccggcgcccacagagccgcggcaccatggcacctgctggacgcccgggggccaagaaggtgagtttcgtcccctcgatcctcgcggagctcctggccgctgggctgcgagcgactccgttcacacccggcgtccatccctagccaagccctggggcctcggcaaaacacttggacgggatggccctgagcctcaattttcccctgtcacgggttggttagcgtttatggagcccttactcggtgcctggcgctgcacagagtgctgtgctcaagttatctcctcatcttcacaattatccccatttcacaggtgaggaaactgaggctcggcgagtcaggcgactagctcagggtcacgggtccagccccgcggggagcgaggatcagaagtctagctttcggacgcatgtcgcgcacacattttcttccctcaaccgaccctcgcccgcagctctttgggctaatccgtccgggaactcttcggactgtcccctcgcgttttggaaaagtcagcagcctggccaagcagcctggccttgcgagtcgccggctggtctgaaactagtcctgggcaaggacgcccccagagctgcggtgcagggtggagggtaggtgggattcgctagcacccctcaacctcctctcacccggtggtccccagctcctggcccctttcctggtctggtcaccagatgttggctttatgcccagccatttctacgtcgagtatgtgtgggggtgggatgaaggagtgactaagcaaaattaggaagggcatgagcttggacgaaagacatccccaggacccttcagagacccccacccgctccagccctgtcattcagaatgggaggaagggaggaggggcagtttatgcgtggaaatgtgcaccaccgagctatttatactaaaaagttagaaacgaccaagatactctgcaatacgggattctaaataaattaaggttcatctacttaagttattagacagttaaataacttagtatgagaaccagctaagtgccttggcaatgttaagttgcaaaaggaaatatatcacaaactgatcccaaccatatacaaatatttatatacacactgtaaggaaggacacaataatggtaatagttacacaagatgtggaatattggtttaaaaagcatgttttaggatattttttcaggttataaaagcaaaatgtgagcattgaaagaatacagttaataaaaataatcaaagaacattgtgcttttttctctcaactttctctaatgctatgttcatctttacagttcatatttttaaacgtttttaaaatgccctgtttttgttcagtgtctttggggcctctactgttacaacaccaagattatcacacactaatccatgtgaatgtgtacctgggagttaaggtgttaatgggaaggaactaatctcacctctctcctcagctagcaggtacattttaagaattcatttaattgccacagacaagacctccaattaggtcttaaatccaaaagagcagttctgctggcaaatctaggaaaaggggaagttattttagacagactgggtttttctgatcacctcctactacacagtgaagttgatccccactgagtatgaatagagatgtcttgaagccagatcttaaacccagaggtcttacgtagtgatatctgcaaaaagggggcataaatgcaccctagagctcgctgtcagatgcaaggcaggttcactgccaaactgatggggaggagggaatgaaaatataaatgtactgcaaaattaatttacagggttccttattttacatgttcctgtctttataattttacagttgactttagatcgtactagtataatggtgaggaacaacacacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaaactaaagaagggatcatactggtatagtaattaattgaggtagttagaatagcagtgaaggaagggctaaaagatgctctgatctcaaatcttgataacttagttattttgctaatggctatgtagaaaaatggcaaattggccgggcacagtggctcacacctgtaatcctagcactttgggaggccgaggcaggcagatcatctaaggtcaggagttcgagaccacactggacaacatggtgaaaccctgtctctactaaaaaatacaaaattagctgggcatggtggcatgcacctataatcccagctacttgcgaggctgaggcaggagaattgcttgaaccctggaggtggaggttgcagtgagctgagatcgcgctactgcactccagcctgggcgacaagagtgaaactctgtctcaaaaaaaaaaagaaagaaaagaaaagaaaaatggcaaatttaaaatggtggacaaacatccagataacaaatgaaaatgtcctccctttacttggtttcataaagacacagtcaaaatatatactacaattttcttaaaacctacctaattgtctgctaaagagtaacattttttcttcttcaggacaaaaattctagcatatgcaatacatctgacattttcaaaacagtcctgtttatttgctaattcttggcatagtttcttaagtgtctactcattttagttgttatatgtggtggtagggatatagaccaataagatatgtcacctgcccccaagcctcttacagtcaaactgaggtgacaagtaagtaaccagatactgctgtacagggggatgcatgaatgaaggatctgtgaagttaagcaggacacaaaaggggtataatcacaggtgagactgggtcagtgagcctgtgctctggtagcaatggaagacagttcagagtagggctggagagaactggagaccatttcaataatcaaatgcagtgaggatggtggggcatttgagaaatgtgtaatacacttggcataaccctgtgataggttggatgtgggaggtgagaagctaacctacaacatctgaattctgtgccaatgttttccctcgacaattgtttgagtaaatttgattcttttttttttttttttgagacagagtctcactctgttgcccaggctggaatgcagtggcacaatctcaactcactgtaacttccaactcccaggttcaagctattctcctgcctccacctcacaagtagctgggattacaggcacctgccaccatgcccagttaatttttgtatttttagtagagatggagtttcaccatgttggccaagctagtctcaaactcctgacctcaagtgatctgcctgcctcagcctcccaaagtgctgggattacaggcgtgagccaccgcgcctggcctaaatttgattcttaacatggtgaacctaatgaagtgtatgggattttcaggaaaacagtttgtacacagtaactgtacctctgactttctcttctgtattcctgtgtagcatttattggtcacattctgctgtgattatttgttgatttattggccttccccaaagtagccagactttgagcttgtggagggcagagaccttgtcttattctgatgtttatcccacttgcccacaactatacctgacatgtggaaggtctcaataaacgtccaaaatttaaggccttttttatatttcaaaagtacaaattgaaaagagtgaattgcatttgatgcagggaggagaaagaaagagatgagaatcagtaaatattaacatttcttctgcattcagctaaaattcagctttagatataaaatatggaaaaataaccagagttgagagctctctctgccaaaatagtgtttatgtttaacatagttcacacagctgggctccatttgcctgccctccaagtgcacagtaaaaagatgctgtaggtagagtgacctggtatttacctctagttaaaccccttctgatggaccttcttgcactgcagaggaaagaaaactaaccactttgccagactcctttgcagctaggatctggataagaactagcatccccaatcagatgcaccagtatgagtctgggaaggtggaagcatagcaaatgtggccatagtgcagcattccagggtcacgtgaggggcagctgaggtcgctggagcagcctccttctccctatatgacagctgtgtcctgaagccaacagttcaatagtggcttctcttagttgtggcagagggtgcagccccagccggccaattcagtcatgtttttctaggggtcatttctggaagcccagtgtaaattttttatgtacccatttctcaatattaaactcctttctgcttagtcagagtggtttgtacttctgcagctaaactgaacatggggagaaagctagaataagccccctctctagtcatgccattcgatggagattaagagattattcaagccatatttgacctctcatgtttggttccatactgttaacaggactgtcctgggaggctctgtgggaagatcctcacgtctgctttaatttctggttgcttttattagatccaggattgacccagctaaggacaaagactcctgtaaccaagatcaaattagcttccctcttattctttattgcctttatggccttccagcctcctgggaaaagattgaagaaaatagtatatcaagcaatatggccaaaatgtgtttgggatctctttgttccttggtatccaaggaagctcgctcctgacacctgggtgggtcactttgtgtggggagtaagcaaaggagaaatagcagatgccagacactagaacagaagcagtttctctccaaaatctgttccccctccttccgaaggattagcgttggagctggacacatggacattcactgatgatacttcctggcttcccttgcagcaaggtagagccatgtggctaaactctcacgcaggaaatgtaaatgtcaatgagatgagtcacttctaggtctgagctaaaaactttaggatgagctttgccacactgtttcctcatcgtttgagacagagtatgaacgtgactctgatccagtttcccccatgctgaggaggacagtaccctagggctgggttggcaaacgctttctgtaaagggtcagatagtaattatttttagccttgggggccatacagtctcagtggtaactactcaactctgctactgtagtggaaaagtggccattagacaatatgtaaatcaatgggcagggttttacctaagactgtttttacaaaaacaggtgatgtgccagatttggtctgtgggctgtcatgtgctgacccctgccgtagggaatggcaaagcaataagataaaaggactgtgcaatttggtgcacactctgtaaaaaagagtcccccacaaacagtggctttcctcttacagaggaaaaagaaactacttttatttaaagccactgttgtgggggcctcttttttacacagcttagttttaccctacacccaacacgtaggccagtaagctgcctatgtaccctgcttgatgtctcccttggattcaggaactgagggggtttatgttgatttcatagaacagataagactagttaaaagaggcatctgaggcttttctccctgatccattcattgctttgtgtccagctatgggcaggcctgaaatgaactggcctattatcaataaaaggttgcatcttccactgatgcagcctacaaaagagggatcaggattgctgtggggagttgggaggagtgggtggtttgcattgctcagggaaggcatctctgaaaaggtgacacttgaccaaagaccagaaagcagtgaggggatgaccctgcaggcacctggggagatgtgctttagaccaagtgaaatgggaaaagttcccttatgccccttgcagggtgtgtgatggaggcgtggatcacttcttcagcaccccacagcttaaacccctagggggagcatgcaggtaccccatggcagcatctaggggtgaatgtttacagctcctgaagccccagtgggtgtgtgttacagtgtgctctttcagcttagctgtccactggcagcttgtgttaatcagctcaattagaccctccgccttatcgaaaggacagagggctttctgtatcctggggttcttgccagtgtactggaaaaattggatcacacatgggcttggagaatgagtgcaaggttttatcgaatggtggaagtagctctcagcagatggatggggagccagaagggggatggagtgggaaggcggtcttcccctggagtcaggccgctcagcagccagactctcctctgattacccctggctgaattccacttcgtctgtgtcattctgccaccgatggcctgccagagtctgtgtgttcttctgccagtgtgttcctctcaacgtccagctgcttgtgtttgtgtttgctagggtcttgaggtttttataggcacaggatggaggtgtggcgggccagggtggtcttggaaaatgcaacatttgggcgcaaaaacaggagtgcctatcctcaccagggtctgtgggcacaggcctgaggcctttctgtatcaaaaggaaactgcaccccatggctaactgctctgaatggaaccttttaaataagttatgagtgggctaaataggaaggtggtaaaatagaaggaaaagagagtaggaatttagaagctagtctgattttttacttacttagctctgtgatcttgggcaagtcaaccattctgagcctcagtttcctcatctacacctgagaataaaaactgtgtcctgcctcactggcagagttgctgggagtgccaaatgataagacacgtgtgaacacactgcatgactacaaagcgttgtgtccactaccgttctgttcagtggctgacacgaagaaaaattatttttctcacctaacaagaggtccaggggtaacagcccatggctgccgcagccacccaaggatgtcttaagaaatctgcctcatatggctgtcagatgactgctgtattcccaggcattatgttggcattccagccaggaaggaggaaaatagacaaaagggaagggagtgggcgtctatgtcaggaaagcaaaacttttccagaaatcctccaccagcttccgtatgtgtctcactggccagcactgtgtcacagggctgctcccagaggcaaaggaacctgggaattttttgaaagttaggggcattgtccccccacacaaaaacaggggagagaatgcacactaggtagacaactagctgtgttgtcacaaacatgttgaaaagccaaaataactatcgtggaatcagtgctataatttgactcagattaaatgttatttaagaataaatagtctcagccctttcattgtacaaaataggaacctggatcggccaagaaatatggtatgctcaatctttctgaaatattattagagcacatgattttaacaaaactacagctctaagaacgtaataccacttcacctaaaattagaaaatgcttttaggaaaaaaaaaaaaagtagagcggagcttaggtgctttttttctcttcttcaggggattttggagcgcctggagagtggggaggttgtgattggagatggcagctttctcattactctggagaagagaggctatgtgaaggctgggctctggactccagaggcagtgatagaacacccagacgcaggttggtgtccacatccccaagagtgtctacctgagtggtattttatttaaatctgattgagagaagatcaagaaaaaaataacaactgtttcaaaggggtgttttgcttgctaagattgccaagatgtggagataatggcagtatacaggcggaagtatatggaagaaaatgacctctctctctctcatacacacacctacccacatcacacacccacccatccacacgcccacacacactcccacacacacacatccatgcactcacaccccaaccccacatccacacacaccccacatccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaagtgtaacagcgtttatagtgagggtgattaatggtagtcacagtgtaacagagcacagacagccaggttccagggttgggagggcaaggaagtcaacacagttttatatcatcctcctggctgggaaaaaaaaaaaaaaaaaagagctagaggtaaagaactatgatgggattagatagttacctgaaatgaaaactttaattctcttctaactctttttttgtgtgtttgttctcctaaattaaagtgagaaaataaagccaaagaatgaaatgggtgtaagagaacactagctgagactggaacttttgattcactctgattttatgtatattcacacagcgtatcagataaacctagggtcctgtcttgattcttccactgaccagctgtgtgaccttggacaagtcacttgacctctccaaggatccatatcttaatctgtttcatgggggcacaacatgggctaggtgtgaggactcacaagttaacccgtgtgaagtgcccgtatcatcagtacgatggccgttatgattggtgcatcggacacccagagttctgtggtagagcaggaccaagttttgttcctttggtgcttaacaggatgttttcatctggcccaagaagaacttgttcttaatgttaaaagacctttttgctaaactgggaagaaagtgctggaataacaagagtaaggataagggaggaggggcgaaagtggtgaaggagaggaaggaatgactttcagatagccaggaaaagcttccagactgctttctgatgttcccaaactgcttgctctgactctgatatgggtgccacccacatgcattctgctttctatgagaagctcctcactttactttaagggctgccaatgctgactatagtagaccagctctgtcctttacaacacaggtatagaataaacctctctagaccaagagaccaagggttaattggccagtcaggccttaatctctgcatgtgactgcaccaagtcattgaggcccatcaccagaacaatacaaggctgctctaaacagtacatcctgcctatgaattctactgaccttaatctataattttttgttactactaggtttgaactgaggtatgattgaaagagatgggagtcagtgagctactgctgcttttgaaaatgatagcttctgtaatatttctttattcatttatttcaatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtg

SEQ ID NO: 1571 - DNA, 20351 bp, Homo sapiens; identical to SEQ ID NO: 1570

SEQ ID NO: 1572 - DNA, 21767 bp, Homo sapiens
agagagtgaaaagaccgcttacccaatttgaaattggtgagatgttccttgggctggttggtctgaggacctgaggtcataggtggatctcttcacggagtgaaggtgaggacaagggactggtctcctgaaggagtccctctgacccaggtctttggcaccaaatgtctcacgcattcgtgtgaagagaccaccaaacaggctttgtgtgagcaacaaggctgtttatttcacctgggtgcaggcgggctgagtctgaaaagagagtctgcaaagggcggtgggattatcattggttcttagaggttttgggatgggcggtggagttaggagcaatgttttgtgggcagggggtggatctcacaaagaacattctcaagggtggggagaattacaaagaaccttcttaagggtcggggagattataaagaaccttcttaagggtgggggagattacaaagtacattgatcagttagggtggggcagaaacaaatcacaattttggaatgtcatcagttaaggctattttcacctcttttgtggatcttcagttgcttcaggccatctggatgtatacgtgcaggtggcaggggatatgatggcttagcttgggctcagaggcctgacaggtgggtgcagtggctcatgcctataatcccagcagtttgggaggctgaggcggtcagatcacctgaggtctggagttcgagaccagcctggtcaacgtggcaaaaccctgtctctactaaaaatgcaaaaaatagctgggtgtagtggcacgcacctgtagtcccagccagtcaggaggctgaggcaggagaattgcttgaacctgggaggcggaggttgtagtgagctgagatcgtgccactgcacaccagactgggtgacagagtgaaactccgtctcaaaaaagaaaaaaaaaaaaaaaaattggccgggcgcggtgactcaaaactgtaatcctagcactttgggaggccaaggcgagtggatcacaaggtcagaagatcgagaccatcctggccaacatggtgaaattccatctctacttaaaatacaaaaattagctgggcatggtggctatggtctcttttggtaaataccaaatttaggaagcatgtattaggtgaaatattctacaaatatcaatcagattaattggttatgatatttttagttctgtatctttgctgattttctgttctattgattactgagaggagggttaagctctccacttataattgtggatttatccatttctcatttcagttttatcagtttgtcttcagattttttatttttatttttatttaagtttttgctctgtcactcaggctggagtgcagtggtgtgatcacgactcactgtagccctgacctctggggctcaagccatcctcttacctcagcttcctgagtagctgggaccacaggtgtctgccaccatgcctggctaattttttttattatttgtagagacagagtctcactatgctgcccaggttggtctcgaactcctaggctcaagcaatcctcctgccttggcctcctaaattgctggattacagttgtgagccactgtccccggccttcttcagatgttttgaagctctgttaagtgcacacacatttaggatggctttgtcatcttggtgacccttttatcatttgcatgaacagtgaagggtgtggcattttaccctgcttgtaagctaataagtcagtctgccagtttcatagatgctaacaaaagacatagattgcgggaacaatgacacaggaccttatcacctacaagagcagtggccatggtagtcacgtctgcatcagctccttgagcttcattttcaaaaggatgatgtgaaagggaccagatggcacctgcacatgtcggaggatgcactgtgggaccgtgggagaggatctctgaggttaggaatccacatctttaagaatgggagatgggccgggtgcagtggctcacgcctgtaatcccagcactttgggagtccaaggtgggtggattacgaggtcaggagttcaagatcatcctggccaacagggtgaaaccccgtctctactaaaaaatacaaaaaattagccaggtgtggtggcgcatgcctgtagtcctagctactcaggaggctgaggcaggagaatcgcttgaacctgggaggcggaggttgcagtgacccgagatcatgccactactgtactccagcctagtgacagagcaagaccccgtctcaaaaaaaaaagggagctgagccttcctgagtttttccccaaagggagaagttgtctttattatgctggatggaaaacaaacccgcccttcgctccagagagaggcctatttctatttccagtgctgttgactatatagatatccttgaaaagatactctagatccaaggcagtcattgcctctgctcataaaacatttagaaatgtgagaacttttggagaatatctttcaacaataacatctctctttatcactggtcatttcttttgctctgaagtctcctttgtctgatattaacatagctactccactttctcttggttagtgtttgtatgacatgtctgtttccatcctattttatttatttatttatttatttatttatttatttattttgagacggagtctcgctctgtcgccaaggctggagtgcagtggcgcggtctcagctcactgcaacttccgcctcccaggttcatgccattctcctgcctcagcctcccgagtagctgggactacaggcgcccgccgccacatccggctaattttgtttttgtatttttagtagagacggggtttcaccgtgttagccaggatggtctggatctcctgacctcgtgatacgcccgcctcggccttccaaagtgctgggataccaggcgtgagccaccgcgcccagcctccatccttttatttttaaactccctgtataattatatttaaggtggattgtgtgtgtattgtttggttttgtagacagcatatagttcggtacttttttttttaattcactctgaaaatctctttcacttggtatgtttagatcagggtcagcaaactatgtgggtcgaatctggccagctgcctgtcttgtaaataaagttttattaaaacatagccatgctcatttatctattttcttttttgagacggagtctcactttgttgcccaggctggagtgcagtggctcgatctcggctcactacaccctccgcctcctggattcaggtgattctcctgcctcagcctcctaagtagctggaattacaggtgcccaccaccatgcctggctaatttttgtatttttagtagagatagggtttgaccatgttggccaggctggtcttggactactgacctcaagtgatcggcctgcctcggcctcccaaagtgttgggattacagacaccatgcccggctcatttatgtattttctgtggctacttttctgctccaaaagcagagttgtgtggttgcaacagagaccatatggctgacaagttcaaaaatatttactacctggacttttactgacccctggtttatatcatttacgttgaatgtagttattgataggtttggattcagatttttatttccttttcagatttttattttatttcttttcggtttatttcctctagtctttatttctttattatccctttcctgccgtggtttagattatttgaacatttttagttttccatctgaattgaactctagagttttagttatgtatgtatgttttagtggttgctctagagattacaatgtacatacttaacatttcccagtctaattagaattagtattttgtcatgtcaagtggaatgtagaaaccttatcaccacgtagatctttttattcttcctcctttgtgtttgaatatctctattcatttagggctttcatttctctcagaaatgttttgcaatgtttagcatagggattgggcacatttttttcttaggttttttttttttaaggtattataatttgttcctagatatttatatgtttgatattatacgtggtattaaaatttttttcatttaaaaaattttttgaggccaggcactatggatcatgcctgtaatcccggtactttgggaggccgaggcaggtggatcatctgaagtcaggagttcgagactagcctggccaacatggtgaaaccccttctctactgaaaatacaaaaattagccgggcgtggtggtgggcacctgtaatcccagctacttgggaggctgaggcaggagaatcgcttgaactcgggaggcggaggttgcagtgagctaagatcgtgccattgcactctagcctggatgacaagagcaaaactatgtctcaaaaaaaattttttttgttgatatatggtaatattattgatgtttgtgtactgaccttgtagcctatgactttgctgaatatatttattaattctcattgtggtttattttatattttctaagtttgtagtcacgttatttacaaataaatatacttcttcctgtccaatctttagacctttcttttgtacaggaggaaaaattgcttccttcttcatttctaggttctgtggctggtctaagaattaattattattattattattttttgagatggagtctcgctctgtcgcccaggctggagtgcagtggcagcaatctcggctcactgcaagctccgcctcccaggttcacgccattctccttcctcagcctcccgaatagctgggactacaggcgcctgccaccatgcccggctaatttttttttttgtatttttagtagagacagggtttcaccatgttggccaggatggtctcgatctcctgacctcgtgatctgcctgcctcggcctcccaaagtgctgggattacaggtgtgagccaccgtgcctggcctcctgtttttttgtttgtttgtttgtttgtttttgagacagagtttcactctcgttgcccaggctggagtgcaatggcgctatcccagctcaccgcaacctccacctcccgggttcaagcaattctcctgcctcagcctccccactagctgggattacaggcatgtgccaccatgcccggctaattttgtatttttagtagagacgaggtttctccatgttggtcaggctggcctcaaactcccgacctcaggtgatccgcctgcctcggcctcccaaagtgctgggattacaggtatgagccactgtgccccgcaattttttttttttcttaatggataagaggttttttttcccctattaacatcaatgtaattcctgtgtgtgtgtgagagatctcagaaagggagagagagtgccaaggtcttgctctgtcacccaggatggagtgcagtggcacgatctcagctcactgcaacctctgcctcctgggctcaagtgatcctcccaactcagccgcctgtgtagctgggactacaggcatatgcctaattaatttttatatttttagtagagacaaggttttgccatattgtccaggctggtctcgaactcctagactcaagtaatctgcccacctcggcctcccaaggtgctgggattacaggcatgagccaccacacccagcctggttcctccccttttaaaccatataaagtaacttctgggtttgccatggcatttgtaaactgtcatggtgccagtgagagtgtcttttagcatgctagtgcattataattaatgtataacaagcactgagagcaactagaggttttgcagtttctttacggcatcctcagaaaacaagtcctgctgacctcataccttaggaatgccatctctgcatttccaaaggcgtcagtgtagtcttttgtaggctgcagtcttttgtaggcaagggataggcagatgctcctaaactataaatgcctgtgcgcgtattaaaaacagatacttctttggtgagactactgaaaaaacagtgctctttgatctggactattgtagaccttctcttacctaatacactccacctggggagatacattccttcatctgttttttgttaaaggcttttaataacttttagtaaaactacccaatatatgcatggaagaaacctgcaatttcacccctaaatacataaaaataaattttttaaaaaagttattgaggccaggtgtggtagctcatgcctgtaattgtagcactttgggaggccaagacaggagaattgcttgagcccaggagcttgagagcagcttgggcaacatgatgagacccccgtctctacaaaaaaaaaaaaaaaaaaaaaattagccaggcatggtggcacgtgtctgtggtcctagctactcaggaggctaaggtgggaggatcacttgagcccaggaggtcaaggctgcagtgagctgtgatcatgtcactgcattccagcttgagtgaaagagcaagacccccatctcaaaaacaaaacaaaaaacttttggtaatgaactataaacgaccctaataggaaaaacacattaagtcattaccagcttgtaacaccattctgtgacttcattgacacgttattatgtatttgtcacttagctttctaatgaccctgcacaattttgttggcagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagataggtaagaagttaaaaagagacctgatggaatacgtggcatcctggtactgctggggtccatccccacacctcatgctcatgagagggagacaagcttcttggagctcctcctcatctacagggctctcctcacagggcctggaagttctgccccagccctgtggggattttctagagtcatttgcctctctttaaagccttggcagagggagccggtgtggggaaggggtggtaacgtagatggcaatgcttgtcagaacatattagagccctcttccacgctctgcagcccctgggcctagggctagcattattctccccttttatagccatctgttgatttcaccttatctcgcactaagcaatgggcttcttgtgggcaggtgctctctctcacccatcttatttctctctggctctttcacggggcctgctgcatggtaagcgctcagtgttcagtgagtgaatggacaggaaggggcagggaagtgaatcaaatctcctcaggttgagacatcagcaccatctgtgatcctttcctcatttggaccttcacatgcaattaggctctaaaatccagtgagtttttttttttttctttttgacggagtcttgctgttgcccaggttggagtgcagtggcgtgatcccagctcactgcaacttccacctcccaagttcaagtgattctcctgcctcagcctcccgaggagctgtgattacaggcgcccaccaccatgcctggctcctttttatagttttagtagagatggggtttcgtcatgttgcccaggatggtctcgatctcctgacctcaggtgatctgcctgcctcagcctcccaaagtgctgggattacaggcgtgagccactgcgcccggtcctaaaatctggtgatttttatttccctgtgtctgtttctacggctgcctccctaagttctttctctgttgggtagtgggcttcggcctagctttctcatcaccgccacacccttccttacccatcctgtacagacagatagatttttctaatgtacattttcagcatatctctgggctgctcagaccatttcctcaactcgacacccaaattaatcagctcactcttccatgttttaccatcctatccgtccttctaataaatacatcctgagcttctggggaggaggtctcatctcagattctctgcccaagccagatggtttcaacatagtcctgcctctgagcccttatgcaagccatctccctgcctgtcccaactacttgcttctatccagagcttggtaagcccacttctcccagagaagcctcctggggtcatcccaggccacttcgaattttctctttggtagcacttggtcacagcaaccttgggcaccaagctgagtatagaatggagtccaatcaatgttgatatgatttttaaatggtggcgacagtcatgtgccatctgaagcaggaatagggaaagagaagcagtgactagcctatacaaattagccaggcgtggtggcaggcgcctgtaatcccagctactcaggaggctgaggcaggagaatcgcttgaacctgggaggtggcggttgcagtgaggcgagattgagccactgcactccagcctgggtgacacagcaagactccatctcagaaaaaaaaaccactctgggaggccaaggcaggtggatcacgaggtcagtagttcaagaccaacctggccaacatggtgaaaccccgtcgctactaaaaatacaaaaattagccgggcacggtggcgggcgcctgtaatcccagctactcgggaagctgaggcagagaattgcatgaacccgggaggcggaggccgcaatgagctgagatcacgtcactgcactctagcctaggcagcagagccagactccgactgaaaaaaaaagagtctacagagcctttcttggaaactagtgtggaaagagaagagcagcatgaaaagccgaggccctgacagcctgatgtcccgctccctccttcacagctctgtgcccagggcctgcctgatgtgcagtgctgcagagaatccagcacactctgctcatgtatgtgcccgggcatgttttctttcttggctacctctttagtcatttgttatgtgttatgaagaaataaactcccagcaaaataatgtcttttgcacagtcttaaagtgatccattacctaagatcatcatagatgattgtgaattgggttgacctgaaatcacctaagaccagggcaggttgaccagagatgaagatggaacatggtatgttgggaactgttgagtactgtgcccttcttactagggcatgtagtttaagtactgtgaaactcaaaacattttatttttcttattgcaaaagtgatacagaattgttctaaagcgtttagaaaatacagacaagcaaaaataaaaatctgccataattccaccatattctagagtatatcttttattcttatttatttatttatttatttgagatggagtttcatttttgtcacccaggctggagtgcaatggcatgatctcggctcactgcaacctccacctcctgggctcaagcgattctcctgcctcagcctcctgagtagctgggattacaggcacctgccaccatgcccggctaattttttgtattttttttaagtagagatgggggtttcgccatgttggccaggctggtctccaactcctgacctcaggtaatccaaccgcctcaaaaaaaaaaaaaattcaatattattattgataagtagggatttactcctaccattttgttatttgttttctggttgttttgccatcttctcttccttctttccttcctgtctttcttttagtgcaggtgattttctctggtgatgtgcttcatttttttgctttttactttttgtatatccattgtatgttttttgatttgaagttaccatgaggcttgcaaatactatcttatagcccattattttaaactgatgacaacacttactgcataaacaaacatgcaaataaatactaatataaactctacagtttaggctgggcacggtggctcacgcctgtaatcccatcactttgggaggctgaggtgggtggatcacgaggtcaggagttcaagaccatcctggccaacatggtgaaacttcgtctctactaaaaatacaaaaattagccaggtgtggtggcatgtgcctgtaatcccagctactcaggaggctgaggctggagaatcgcttgaacctgggaggtggaggttgcagtgagccgagatcatgccactgcattccagcctgggtgacagagcgagactccatctcaaaaaaaaaaaaagaaaaactctacagtttaacttcatccccctgctttttttttttttttttttttgagacagagtcttgcacggttgcccaggctggtgtgcggtgctgcgatcttggcttgctgcaacttctgccttctgggttcaaatgattctcctgcctcagcctcctgagtaactaggattacaggtgcccgccaccatacctggctactttttgtatttttagtagagatggggtttcactgtgttgtccaggctggtctcgacctcctgacatcgagatctgcctgcctcggcctcccaaagtgctgggattacaggtgtgagcccccatgcctggccatccccctgctttttaactttttgttattttcctttatggcttattgtactgtctatgccttgaaaagttgtagttatttttgattggttcatcatttggtctttctacttaagatgagtagtttatgcatcacaatttcagcgttatattattctgtttttctatgtgcctactattcccagtgagttttgtaccttcagatgattccttttgctcattaatgtcttttttgattgaagaaatccctttagcatttgttacaggacaagtatggtgttgatgtaatccctcagcttttgtttgtctgtgaatgtctttacttctccttcatgctcgaaggatattttcactggatatactattataaaaaatttttcctggccaggtgcagtggctcatgcctgtaatcccagcactttgggaggccgaggtgggcagatcacgaggtcaggagattgagaccatcctggctaacatggcgaaaccccgtctctactaaaaaaaaatacaaaaaaaaaattagccgggcgtggtggcgggtgtctgtagtctcagctactcgggaggctgaggcaggagaatggcgtgaacctgggaggtggagctggcagtgagccgagatcgcaccactgcactccagcctgggcaacacagtgagactccatctcaaaaaaaaaaatttttttttcctttagcactttaaatatgtcatgccattctcccctgacctgtaatgtttccactgaaaagtctgctgccagactggagctccactgtatgttactgtttttttttttgtagttgttgtttgtttgtttttcttgcttcttttaggatcctttctttatccttgatctttgggagttagattattaaataccttgaagtagtcttcttttggttaaatctgcttggtgttctgtaaccttcttgtatttgaatgttctttctgtaggtttgggaagttctctgatactatccctttgaataaacattctaccactagctcttcctctacctcctcttcaaggcctataacagatttgcccttttgaggctattttctagatctggtaggcatgcctcattgtttttattcttttttttttttttgagacagagtctcactctgtcacccaggctggagtgcagtggcacgatctcagctcactgcaacctccgcctcccaggttcaagcgatccccctgcctcagcctccggagtagctggaactacaggcatgtgccaccatgcccccggctaatttttgtatttttagtagagatggagtttcaccatgttggccaggctagtctcaaactcttgacctcatgatccgcccacctcggcctcccaaagtgctgggattacaggcaggagccactgcaactggccttttattctgttttcttttgtctctgtgttatctgactgtgtattttcaaatagcctgtcttcaagctcactaattcttctgcttgatcaattctgctattaagagacggacgcattcttcagcatgtcaattgcatttttcaactctagaatttctcgattcttttaaattatttcattctctttgttaaatttatctgatagaattctgaattccttctctgtgttattttgaatttctttgtttcctcaaaacagctattttgaattctgtctttaaggtcatatttctctgtttattcaggattggtccctgctgacttacatagttcatgtggggaggttgtgttttcctggatggtgcagatgcttgcagatgttcgttggtgtctgcattggagaattaggtatttattgtagtcttcacaatctgggcttgtttgtgcccatcctccttgggaaggcttcccagttatttgaagggacttaggccccaagcccaataatgtagttgtttttgcagactcagaaagatcccaccttggtggtcctggataaaatccagaaaaattctctggattaccaggcagagactcttcttcttttcccttattttttgccaaacacatgggtttctcactctgtgatgagccacttggaattgggagtgtggtgatgcaagcacccccgtggccatcaccactgggactgcactgggtcagacctgaagtcagcacagcaccgggccttcccaagacccttcccttcagggcagcgagttcccccaggccctgggcatgtccagagatgctgtctgggagccagggatagcaataaaaaaccttagcaatttacttgatgttctagtctactgtggctaagctggcactcaaaccacaatacaaagtccttctcacgtttccctgccctttccacagggagaggagcctctccatgtggccaccaccaccactggtccacagtgggttctgccaggcaaccgctgatgttcacctaaagcccaaggactcatctgtcagcttgtggtgaatgttaccaggcctgggactcacccttcagggcagtgggtacccctctggcccagggcaggtccagaaatgtccaagcgcctaggcttggacttggagactccaggagcctgcttgttgctctacctcactgtggcctaggtggtacctaggagcacagagcacttcagcccacggtggtggagcctgccgagaaactcaggttccagccgttgggatgggcagttcccccctggctagggctggtgcaaatgttccctccatgcacaggcactggctgagtccagcgcagctttattctcttctgtgacatggcagcactgagttcagtgtgaagtcccctagttgctgtgctctccctttcccaaagtgcacagatcatctctctgttccatatggctgctgccgggggtgggagaggggtggcgtcagtgattcaagactgtctctctgagcctcttcaatggcccttttagcgatatgaggttaaaaccaggtactgtgatcgcttacctgacttttggttcttgtgacggtgcttttttgcaagcagacagttgttaaaatttgatgttccagcaagggcatgaattgtgctctaccttctctactatagattttttaaagtctgcataattttgcattttatgcatgtgccatactgtatttgaccagccttcagctgttcaatgtgaggggctatggtttgaatgtttgtgtccctccaaagttgatacactaaaagctaatacccaatgggataggtttaagaggtggggcttttggggaagtgattaagtcatgagtgctctgctctcatgagtgggattagtgcccttatcaaagaagctcaagggcccctttgccctttttccctttacaccatatgaagatacagcctttgtcccttcaaccatgtgaggacgcagcagcaaggtgccatcttggcatctgctggtgccttgatcttagacttcccagacaccagaactatgagaagtcaacttatattattattttttcttttttctttttttgagacagagttttgctctttttgcccaggctggagtgcaatggcgcaatcttggctcactgcagtctctgcctcatgggttcaagtgattctcctgcctcagcctcctgagtagctgggattacaggcacgtgccactacacctggctaattttgtatttttagtagagatggagtttcatcatgttggtcaggctggtctcaaactcctgacctcaagtgatccgcctgccttggcctctcaaagtgctgggattacaggtgtgagccatcatgccctgccaatttatattatttataatgtaccctgcctgtgatattttgttataccagcaggcacaagtaagacatgagttaacttcattaaaaaaattatagacagtaattcactgaacattcttaccattaagtcttactacacacccttgattattcctttagaataaacttttgggaatagaatcactaggtcaaaggtcgtatgcctatttaaaactttgttattgagaaagcttgtgctaattttattgacagcagtggatgagagtgtctctgcttcctcaagtttttaccatcactggttattttatgtgtgtgtgtgtgtgtgtgtgtgtgtgtgtgtatacatatatatatatatatttttttgagatggattttcgctcctgttgcccaggctggagtgcgatgccatgatcttggctcactgaaacctccgcctccggggttcaagcaattctcctgcctcagcttcccaagtagctaggattacaggcacccaccaccacccctggctaatttttgtatttttagtagcgatgaggtttcaccatgttggtcaggctggtctcgaactcctgacctcaggtgatccgtccacctaggcctcccaaagtgctgggattacaggtgtgaaccagtgctcccggcctggttattatattttgaattttgcaaatgttataagtggaaatatctcttctaaaaataacagatggaaaaactttaaaaaaatcttgttgtaatttgtatttattccatgacaaatttggttaaaacctgtcatatttattaatcatttcttttgtctttagacttttgatgtctgtgtaaggcagggtttagttggaggtaacagaaaccactcttcttattttaaggagaaggagctttgtcaaaggaaattagctttttacaaaatcactgaaagggccggaggaacaggatctatgctgggcttccaagaatgactctgagaacaacaccctagaactagtggctcaggaaagctgctacttctgctccaggcagcttcattctagatattagactgttccttgctaggtctgctagagcttcacagcaaaaaccagtgctctgtgcctgctcccaagacacactaagctactaactgttatggaatctctgctaccatcacaacagacaaacaacaacaaaagtgaaaataaaccaaatgtaaaatacctcaaaatcctagcttaaatgtaacaaatacgtttttacatacttaaagcagatcagaagaataccaaggaaattcccagtggtcacaatggaacgaaactggagttgtaaactaatactgaagccactgctgtgcctaggatatttgtcagtcttgatgacctggatgcttaactggccatctgtgcctggtagataatgccttggcggcagtgaaggggttgcaaattagggatttgaaactgagaactccacatagtaccaagacactcaaaaagctacatcctcaggaaaagaatggattgaataaaagaaacaaaatctgacttttagcaaagagaaataacaaaaaaacttatctttgcctgtgccctgggtggagaaaaaaagcagcttccatggatgtgtaactccacatctttactcttaggggttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataagccctagctgaacataaactttcactccaaattaaaaaagaatacatgaagaaacaagctaccataagagtcagcaagaactcctaagaacttaagataatggatttatcaaatgtgttatataaaacaaatatacctaaaatgtttgattacatttaaaaatacaagaaaagagcaagagatattatataatgtaatcatatacatgcaaaaaatatacaaattataagcatatagcttgatggattttcacaattggaacacatctaactagcacccataaaaaaacccaaaacattactagcatccccaagtcccctgcccccatgtttccttccagtcatgacccatacccttcacaagagtaagtactatcctaacctctaataatagcacagaccagttttaggcagattttaaaaagcactaaatagaacttctacgaaaaaaaaaattttaaaaccccaacaaaccaatgaatgaatagtagatttgacatagctaaagaaagaattgatatggaattaactggattaaagctgaaaaaattttctagaacacagcatggagagacaaaatgatgggaaaatagcaggagttaagagacatggaagatagaatgagggaatctaacctgcttctaataaaaatttcataaggagagaacagaaagaacaggtaaaaggtgattttcagcaagataatgtcagagagtttttcagaattgctgaaagttacatatccttagattcagaagtaatagcgaatcccaagctgaataagtaaaacaaatgaacaccttaacacattatagggataccgaggtcactgaagtaaaagagaactatgggcaatcacaaggaagagacaaatgacttatgaaggcacaacagtaagattaacagcagatttctcaacattaacaatggaagcaagaagtcagtggaagagtaacatctgcaaaatgctgagatgaagagattttcaggttgatttttgacaagtctacctgtatgctatttataagagataacaaaatgatgaaagaggatgaaaaaatatataccaggcaagtagataggaagacacaatttcataaagatatcagttctctaaatcaatctgaattcaattgcaattgaattgcaattctaattaaaattcaaacaggatttttcttggaccttgacaagctggttttacatttcagtagaaaaacataggcaagaatacctagtttcgaagaagcacaacgtttgggtttactctaccaggtgtaactacttattataaaggtctaataattcagagtggtactgatgaaggcacagaaaaatagataaaaggtttagagcagaaagcacagaaaagtgcccatgcctgtatagaaattgacaaacatcagagggtcatggaagatcagtggggaaagaatggtgtccagattattggtttttcatctgggaaaaaaaataaggctgaatgttcacattataaacaaaaatcaattccagggtcggctgaagatctaaacaggaaagagaaaagtttccaacttttagaagaaaatgcttatgaccttaggttagggaaagatttcttataagtcacaaaaagtataaataacaattagattgataacctcactgatattaaattttaaaactgtgctcaaaagacacaaagagtaaaaaaataagctatcgactccgagaaggtatcatatagtttgaatgtctttttcccaccaaatctcaggttgaaatgcgattcctatgttggaggtggggcctggtgggaggtgactggatcatgggggcggttctctcgtgaatggtttagcatcatcctcttggtgataagtgagttctcactctgagttcatgtgagatctggttgtttaagagtgttgaacccacccccaccatttttcttgctcctgctcttgccatgtgatattgcctgctcctccttcaccttccgccatgactgtaagcttcctgaggcctcaccagaagctgagcagatgttggtgccatgcatgtatagcctgcaaaaccattggcccagacacacttcttttctttataaatcacccagtctcaggtgttcttaaaagaacaaatggactaacacaagatatatgcaacatattttgcccattaaatattagtagtagattttataaagtatccaaaatatatggagacctactattaaaaagacaaacaacccgataggaaagacaggcaattcgctaaaggaaaaaccaaaatagtaaatcaacatagaaaaagttactagtaatcaggaaaatggacattaaaaccatagtgaaataccgtttcacacccttcagcttggctaaaattttaaatctgatgataataaatataatttacaagctgttggaatcccagaacactttaagcattgagagagatgtgactgtgatctgagtcatatatgattacaacgtctgtttctcagattatagattaacttactttcttatttttcttgttctgtacaataactagagagaattaaataacaccagggacaacaacctcctgtcttcctaattaatggcctttgttattgattaacatcccctttgttgtcctgccttgctgatcgcagatgacaaaacccatcgctattataccctttattttaaaaaatgctaaatgtagccttcccacaaacactgcctatcatcagtcaaattgctataactatgtaccaaccttgtatgaaaaatgttctaatcttgctaaaagctaccctgtctctccctgtataaatgaaaccttaacttccctactttgaactgccaactccattccttggagttggtttcctggtggactattctcaaactttgcatttgaatacactcctttaaaattagattctgacccttttgattatttcaggttgacagtaccaacaattgatgtggctatgaagcaatttacagtaatgataatataaattggtaatcacttggtagaataagttgaaaatatctaataaagttgacaatacacatacgataagatgcagtaattcccttttaggtacgcactgcagacaagcccttgcacatggcaggagatatgtcaaagaatatttaatgtatcattctgatacaggagctaaaaagaaattatttaggcagatagtgaggctaaaggagtccttggcaaggctgccttttaaacaaaaagcagcccccaaatcatttcttttctaacaaagagcagcctataaaatcaagctgcaaacatagataagcaagctggaagcttgcatgggtgaatgctggcagctgtgccaacaggaaaaggctacctggggaccaggtatattcaatatggagactccatcttcccttttctttgtcaccacgtgtgcagtaaagaagcaggcaacatggcaccggccaggtggagaccccacctgcatagtaaaagattagggtggggcggccagcttctttgcacgctatgcaaatggcacacccagtcctaaccagttcttcgtgctgtatgcaaatggcacaactggtttgaccaatctttcgtgccctagctaaatcagacactgcctcctcaagcttatctataaaacctcctgcgcttcactgtggacctgaagacccgctcaggaccccctctatctgcccgagagagcatttctctttctttcgcctattaaaccaccactgttaacttcactccttgtgtgtctgcatccttgatttccttggcgtgggacaacgaagcctcgggtattaccccagatgaatgacaccacgtgaattcttttatagtaggaaattggaaacaaaatgtccattatcaggagaatgaataaataaattgttgtctatataatggaatgctaaatagcaatgaaagtgaatgagctagagctgtggttgtcaacatggataattcacacaatgttgaatggtaaatgtgaacttcagaagtacacatgtggtatacttgtactggtcctagactggtgcaaatggggcccctgtcatgggtcccacatctcaggagctagggcagagcttggacagagacccagatgactagctttcctctccaccctttgcacagctcctgaggttgaccagatgcccctagcagctctgggctgcacctttgtgtccaagtcttggttccaggaagaactctgagcagattgctcctgttggctggtgcagttggctggtgttcctgttggcaggtggcatagcacaagattgggctgccagaatggtactaatatgctggtttgggcaactcaaattgtttatatagacagacgcccccacaaaaaatacttgcttatgattccacacacctttgggcatataaagcttaaaaatgtgcagtataggccaggcatggtggctcacacctgtactcccagcactttgggaggccgaggtgggcagattgtgaggtcaagagatcgagaccaggccaggtgtggtggctcacccctgtaatcccagccctttgggaggccaaaacgggcggatcacaaggtcaggagatcgagaccatcctggctaacacagtgaaacctgtctccactaaaaaaatacaaaaattagccaggtgtggtggtgggtgcctgtagtcccagctactcaggaggctgaggcaggagaagggcatgaacccaggaggcggagcttgcagtgagccgagatggagccactgtactccagcctgggcaacaaagcgagactccatctcaaaaaaaaaaaaaaaaaaaaaaaaagtccaggcgcggtggctcatgcctgtaatcccagcactttgggaggccgagacaggtggatcacaaggtcaggagttcaagaccagcctggctaagatggtgaaaccccatctctactaaaaatacaaaaattagccaggcatggcggcaggcgcctataatccagctactcaggaggcagagacaggagaattgcttgaacccgggcagcagaggtttcagtgagccgagattgcgccactgcactccagcctgggtgacagagtgagcctcccgagtagctgggactacaggcacccgccaccacaccgggctaatgtgtttttgtatttttagtagagacggggtttcaccgtgttagccaggatggtctcgatctcctgacctcctgatccgcccgccttggcatcccaaagtgctgggattccaggcgtgagccaccgcgcccggcctatcatgttttatttcttaagctgggtagtgggggagtaaaaggtgctgattgtgttattttttatgcctttgtgtattatttgatttttttttcttttttttttaagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaactttta

SEQ ID NO: 1573 - DNA, 120731 bp, Homo sapiens
tactagaaaatttaaaatttttaataaatgtgctttgttcacaaaatgtgaaaaaatacaacaaacacacacgtacattttcaggtatgctacctcccaccacttggcaactatggtaaaaccacatgatctagtcatgatactgaagaatccaaccaaatgattaccatttgtttttgaaacaaccaaattattttggagaaccagctgtgaatgtgacaggaggcctcataacttctttatatccaaaatgaaataattcttaggagtacccatacagtattagaaggccctattaacttccacttgttattacatacatgatctggcatcaagctgcaatgactgcttatacttcaatacttatacactgaattggtttttgtggaatgtgtatcagtttaaatctgtgccaacctaattggaataagctgaatttacagtaacaaatgatataaattcaaacaaatttatactaagtggtagtaggttttataaagagacttcctcagagtactacgtaaaatacatcatgcacactttggagcataagcagaatcaacatctgtaaacaatcagaatttatagcaccaacattttcgctgtaacacaaaggctgactccagggtcatactataccagcctttcaaaagcgctgttttcatttactttcaaagcattttcatttggtgtattgttttctttgctcttaagatatttacccaaatcaaaaagcaaacagtatggtaaaaggtactaccaaaatagttcaaaagagttctgtattatccttaacatagtgcttttttttccttccccttctcttggggaagctacaagacataatccttcagtgcttaactggaaagaacagtcaatcctaaatattaaagaatcttatgctgttgaaagtaaatgaaaaatttcgagttatttgtggcatatttgagcaaccaatatttattgcatttaatcaactgactttaaaaaattacaatcttgttactttcattaatttagcatgtgaaatttaattagaaatactgggtacatacactcaaccatttatatcataaaggataagttttatatttctaaataaagtttgacattcaaaggtactacggcaattcacaataagcacaaaaacatcagctttaccagagtaaagaagtgcagtttatgaaatttaggatcaactattgaaaatgcaagtttcctttaaaaacatacaaacatacgcacaacattaaccatgaaatctgaaactgtgatatttcagtgcaaaaacctcagtatgaggtaattttaatgtaataaccacttgaaaaaaaaatccacacagtggcactcttaaaaatgatagcttccatgacaattgctggctgacaagacaatgtggactaaatgttcttaactgtttaaactaatcttgtcttgtttggacatatatttttccctaatcatttgcttctgattcagaaacacagaaaggcatttattaatgtggaaagggaaaattcccacagccaactaattgatatattcaaagaaaattttctgataaagtttagatagaaattaagataccaaaaggtcaaaaccattttatgagatcaccaacagagggttaattttaggtttttccatataatttgaaacttgtagtgcggcacctccttaacggaaaggtgaggaccctatcaaagttggtttcaacagaacataaactctcttccaagtgcaaaccctttcaaaaaggtgttttaggtcattattgagtattacattgttccttgcttaaataaaacattttgtaaatgaagcctaagtttaagaaaagtaaaagtgaactctcaggtaaatatacttcacaccaaggcccaaatcaacaagaaagttatgaaaatactactttggcaatggtgtttattggatagggctaataaaattagaatacacactttgggggacatctctcccccaatgtctgatgctgtcaaatgagcttttaatataaggaagaaataaaaagaattatcaccaattacaaaaagttcagtaaatattggatcatcagacaaaaaaggaacataaaatgactttctgtaacatcacaattttagttagaaaaaagaaaaagataagtgcatcacaaaacaactaaccgatctatttttctgtatcacatttaacttgtgagtcatcaaagtgcaatctacagctttctacatcttaaagttttccattcaatggtttatagtcaacactgaaaagttgaaaaggaaaacatatagcaaattatgcttgttttcacaatagcactaaagagaaaaaggtacctttctatgatagtgctaaatgctaaagtaacagtagtttctgctatgacatgagtcactctgcatgaaactttaagctttctatataagaataaattttaaaattgagaagtagaaaaaaatagcaaactctgtaaacctctgcatttcttttatgcaaaccaggttttcagtactgagttcatgttagtatttccaattggtgtaagcaattagtttaggagcctggactgaaaggggctttttgcttctatattaacttaaaagtaatatggggtcttctagctcatagaaaggaatagagctggcttgactttctccagaatctgagtcatatggcgcatcagggagttctgtgaaaccatatgctagttgttcatcttctatatctgatcgaacatagcaggaagggttagaatattcctcatcttctatactgttgaaatcttgaggaatatataacattcctgggtagttcctactaaccaagtcacttgtggtttttagagagattttcctaaatgccatcagatgcatatgtgaaaattttgagtacttgaagcgtttaaagcccagggactctatagcaatcttccagcttttcatcatcatagcatgacggttctgatgggaggaatcaggtgtgatgattagtaataaaccatttaacactaacagttcatgggctttcttgcagcaaatccatcgctggtaaggagatggaaaataagaaagaaggagagagaaaacaaccacatggaaaagctctccaggaagagaatcaatagggtttttcagctgcttcaaaaaagcatctatagcatcctgtgcaagctggagtggttgctgaagctgtaagttcaggaaatcacatttatagacactctgcagaaacagaaaacaaggcatattaagaacttcaagattatttccactttagtacatagacttttcagcaaaccatttcacatatcatagtaattccagcattgattatacatttttccttttaaattattaaacttgaacagatgtattcaaccacaacttttacaaaaatctcaaagtaattaagtccaaagacctgctaatcatcatttaaatatatgttttttgcctaacaatttaaaatgggaaataatttgtgtattttgggttgggacttacatgaattttaatttgggtaggagtttacaggaatgacatttctatttacattcactttaacatttacagttaccaaaaacaaactaatataaaaatgctaaacaagaaataccatgaaataaagatgaatcaaataaagaggataatgaaagaggcattataaaatttgtacaagcagaatgattccaaaactttagttctttgaaactgttaactttaaccatttaaaaagtaaccctcaacattacttttattctattaaaaagttaatccctagtttggaacaaactagatttagttagacaaatgaccatgggaaacaatacaacagaggaatgaataacattatataatttgctaaatcttaaaactatggaaatgaatcagaataagcaattttaaaattagacaaaaataactctatcatataccaatagttattaacaaagatatgacctaataccttaatccctcactcatgttagtgtatatacaagccggccacatagtcatctggactgtttattaggaaaagtgatatgcaatgttctagtacctgaaaaaaagatgcttttcttcttccctttttcttaaaggcagctttattgatgtataagtgacaaaaagcataagtctgataagttgtgaggtatttttacactcatgaaaccactggcatggtcgaattaatgaacagatccaacaccccataattttccttattcccctttatagtcccttccttctcttcccctgccagcaggcaaccattgaagtttgtatttcctagaattttatataaataatcattttgagatttttcttgcaggtattaatagtttattcctttttaaattgcagaatggtatcccattgtatcaaggatgtaccacagttggtttatccatatacacctgtttatggatatctgggttgtttctagttttggttattacatttcaagctgctgtgagtattcccatacatgtgtttgaatcaacattctttaatttgtcttggggaaatatcttgggtggctagatcatacagtaggtggtgtagtaggtttaatttttaaataactcccaactgatttcaaaagtggttatgtagtttcatgttcccaccaggagtatgtgagagttccagttcctccaaatccttatcaactcttggtatagctagtctatttcattttagtaattgtaatagatgtgtagtggtatttcagttttaatctgcattttcctaatgagttagtgacatttatcatcttttcccggacttatttgccatccagatatcttctatgttaaagtgtctgttcaaatattttgcccatttaaaaataattgggttgctttaaataaagttttaagtattttctttctgggttttgagagttctttattcttgatgcaagtcctttatgatatatgacttgaaaatattttctcagtatcatgtggcttatcttttcattcttttaacagtgtcctttgaagagctgaagttttaaattttgatgaagactaatttatcaatttgttctttcttagatgttgctttcaaagtcaggtctaaaaagtcttttcctatcccaaggtcataaagactttttttcaaaatgttttcctttagtagttttatagtttatggctttttcatttaggtctatgatacattttgagttttttttgtttgtttgtttttttgtttttttgagatggagtctcactctgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcactgatattcctgaacatcaataccatgctgtcttgaatactgtagctttataattttgaaatcaggtagtgttactctccaacactgtccttcaaagttgttttgagctattattctaggtcctttgaatttccacacagattttagagtaagtttttcaatttctacaaaaaagcccacaagagttttgatgaggactgcactgactctatacagacagggtctcactctgtcacctaggctggagtacagtggtgtgatcttagctcactgcaacctccaccctctgggctcaagcaatcttcccacctcaggctcctgagtagctgggaccacaggcgagtgccaccacatctggctaatttttctatttttttttttgtagagacaggtttttgccacattgcccaggatggtctcgaacttttggactccaacaatccacttgcctaggcctcccaaaatgctgcggttacaggtgtgagccactgcacccaccttaggtcatctttactttctcctaatttgtggtttgcagcatgtggatttttctacttttgtcagatttatgagctacatatttcatatatactcacatataaaataaacatttcatatttttgatgccagagtatggtactgtttttagttaaaatttctgattggttgctgctagtatatacacacaaatttctgtatattgatcttgtctcttgcaaccttgctaaactcatttgttagttttaggagcttctttgaagattacacagaaaaatcaaatagatgatcgatgacacctgtgaatacagttttacttctttccaatgtgcatgctgcttattgctttttcttgctttactgaattgttagaacctctagtacaaatgctaaatagaagctgtaagagtaaacatccttatcttgtttttgtgagaaaagcatttttctttcaccattaaggatgatgttagctggagatttttcagataccctttatcaggttcaagaaattcccttaaattctgagttttttttttttttttaaatcaggaaagtccagatgttgaattttgtcaaagctttgtcaaatgccttttctgtgcctactgaaatgatcaaatgactttttctttttgagttcatacgatagattgtttttgaattttaaaccaagcttgcattcctgagataaaccaaacttggccattatatattatccttttaaaataccttgttggattcaatttgctgaaattttgtatagaacatctgtatctatattcataagggatatggatctgtagttttgttttataacatttgtctgattttgataccagagtaatggcctcatagaatgagttgggaagtattccatccatttcaattttatggaagagaatatatataattggtattatttcttctgtaaatatttggtaaattttaacatgcaggcgttagtgcctggaattttctttgtgggaaggttttaaactgccaattcataatttcttcaatagatttagggccattcatcttatctgtttcttcatgaataagctttggtggttatgtctttcaaggaattggtccatttgaattgtcgaatttattggcataaagttgttcaaaatattttcttatacttttaatgttggtaaaatctgtcatgatgttacctttttctctttacttctgatcagtaggctagagtttataaattttattcatctactcaaagaactagcttttgctttcattaattttccctatttttctgaaagttttctatttcatttgatttctgctctgatcattatttccttttggatttactgctcttcttttttcttctagttgaaaagttgatgtcattgctttgagactgttacctaataaaggtgtttagtgctataattttcccctaagtactacttttgtgactttagtgacatctatgcattttgatatcttgtatttttatttcaaaaaagttctaatttccattgtgaattcttcgccaagtgttcagtatacctgttctaggaattatttagaggggtgctgaaatctctataattttatcaatgtttatgtttccttgacagtttatcagtttttggtttacatatttggaagctttgttattaggtgcatagaccaagtttggtttaggattgttatgtactcttgatgaactgaccctttaatcattatggaatgtcatttttatccctgatcatattctttgctctgaaatatactttgtctaattttaatgtagccatgccagctttcttttctccatcttattgctttcactctatttgtgtcttaataattgaagtacatttcttatgggcaacatatatttgggtcttggcttttttcccccaatctgccagtctttgcctttcaattggggcatttaggccatttctatttaatgtgttgattgatgtgattaggttttaaatctataatcttgctatttattttctacttgtctcacttgattgttgttcccttcccctcttccttcatcttttgaattaactaaattttttatgattttattagccttgttggctgattaggtataactcttttatttcagcagttgctttaacttatcagtctaccttcaagtgatattacaccacttaatgtataagaacctcaaagtactaatattatcacagtggactggttccaggaaccactgtacatacccaaatccacgttcaagtcctttatataaaatggtatatttgcatacaccctatgcatatcctcccatatattttaagtcatctctagattacttataatatgtaatgcaatgtaatgttatgtaaatagttgttatgctatattatttttattgttgtattgttatttttatttattgagacagggtctccctctgttgcccaggctggagtgcagtggcacaatcttggatcactgcagcctcaacctccagggctcaagcgatcctcccatctgtctcctgagcagctgggactacaagtgcaccatgcgtggctaacttttttattttttgtagagatggggtcttgctgtgttgcataggctggtctcaagctcctgggctcaagcagtccttctgcattggcctcccaaagtgctgggatattacaggtgtaagccaccatgccctgccgcaaatatttttgatctgtggttgactgcatccacagatgtggaatccaagtatatggagggccaagtatatttctgattctctcatgtcaccctttatgctactgtcataaatgttcattttatctatattaaaaaccccactctatatcattatttttgcttaagttgttgtattagtttgctagtgctgttgtaacaaagtaccatgaactgggtggcttaaacaatataaattttctcatagttctggaggcttagaagtctgaggtcaagattgtgggaagatttcttccttttgagggctgtgagggagaatctaatcaatgcctcttgccttgcctctagtggtttgctggcaatctttggtggtctttggtttatagatgcatctctccaatctctgtgttcatcttcatgtgacgttctccctgtgtgcttgtttctgagttaaaatttctcctttttataagtataccagagtcttattggactaggggccactgtaatcacccctgtttaatttgattacctctgtaaagctcctatcttcaaataaagtcacatctttagagttagaactccaacatatctgttttaggttgacataattcaacccgaaacaatggtaaattatctttaaagagtttaaacaacaagagaaaatctttttagctgtatagttatcacttctagtattcttcattcctttgtgtagagccatatttctaactggctaaagcacttccaccttaacatttcttataatacaagcttgctaatattgaatttcagcttttacacatctgaagaaaatcgatttcatcttcatttttgaaagacattttggctgggtataaaattctaggtgactttttccttcagtactttaaggtgtctttacaatttctgggagcttttaagattttatcactagttttagaagtttgatttgatgttccttggtgtaattttcttgatgtttcttttgtttggggtttgttgggcttctttgaatttgtgagtttaaagctttaattaaattggaaagtttttggccattttttcaaatcccccaccttttgggggattccaattatgcttatatttagttgcttagatttgtatcactgatgctcttctatttaaaaaattttctgtttcattttggatagctgctattgttgtatcttcaatttccctttccttctgcaacatctaatatgcattaatcctatccagtatgcatcttcacatcacacattatagtatctgtctttagaagatagatttgggtattttaaaatatcttcctatttctacttagctttttatacagttttgatttttttaaataataaaactgtattgaagcataacacatataaggaaagaatataaactgtgtaaaagtttagcttaagtaattttcccaaactggtattatctctattttaatgtccctgtttctgtgtcagttcagggttggtcattgttggctgatttatctcctcactgtgggtcctattttcttgctgctttgcatggctgtaattttttttggatgctagacatggtgaattttaccttggtgggttctacataactatggattgctataaatattcctgaactgtgttctgggatgtagttaagaaacctggagacaatctgaagtttttgggtcttacttttaagatttgttacatgggactagagcactagtatttagtctaaggcaaattattctccattattgaggtaagacccttctctgtgtactctattaaatgtctgtgaatcttgaatgctccagtatggctgatgggaacaggtacaatattaatacttctctgtgtgactgctggccactgtaatctctaagccttttggacagtaccttatctagtctcatgtagttttctcatatacatgtgtgctgatttgtactcagctgagtattcaaaggggaccttttgcaggcctctggagttttccctctatggctttcttattttcagtagaccattctagaaactctagctgcctcggtctcctaggactctcaactccctaggactcttcacaactcacagaatcacctgaactctgcttgggtttctccctgtgctatatcctggaaactctctcaaggcaatatcctagagtaattgtagggcttgtctcatttgttttccatctctcagagattactgtccttcattacctgatgtgcagtgtcaaaattatttcgaatattttgttgcttcaagtggaagaggataaagctggtctatcttatcccatcttggctggaagagtaagtccctttactctgttttaaaattagttataggattctgaactgtgaaactctgattctactacttaagttatgtatagccgtcttttgtcttccctggtgactatacaattcagtgtttataaacctatccataaatagatttaatattaagcttaaggatcagatcaaatggtcatggtgtctcagcagtccctgaagaacatctctcatgtatatcttgaggaaggaagggaagataatccatgcatgaagccacttgggctttaaaactagttcctgatggcacagaacttctctgcagtggtaagctaagaacagtgattttataatagagaaaacgaaagtagaaataacagtaatggttttaggacttgcttgttccttgatgttatacagatttaatcatgctcatcaaaatgattcataatcaaagtttcatatgaaagttaaatcttcatgcaggaatttaccagtagtaacaacaaacatttatttagcaggcactgtataagagctactatgcttgatgctttaaatacttttttttttttttcaagaaaacattacaacaacctatgaaatgtggtctactactaaccccattatacagatgagaaaactgaggatcagagactagaaaatggtgatggagaggttcaaacctaggctggaaacatgattctattcttttatttaaaaaagtattaaatatactaggcactcttctaggtactgggaatacagcaatagagggaaaaaaatccctaataactaatatattaatactctaatccatactttaaaaataacattaaaatgcattttgtaactatttaaatgcattttgtaaaaatttttatgtctagagttctatcaagagtaaaatggtaaacataatgaattaatgttattctggaaaaaagtctttttctgatataaataatgtgcctactttagagttatctatctttaaaaaatgcctttaacacaaactcttggcatcacatgattaaggtaaaagaaagttcaaggtggctgggtgcagtagctcatgcctgcaatcccagcactttgggaggttgaggcaggtggatcacctgaggtcaggagttcgagaccagcctgaccaacatggtgaaaccctgtctctaccaaaaatacaaagttagctgggcgtggtggtacatgcctgtaatccagctatttaggaggctgaggccggagaatcactggaacccgggaggcataagttgcagtgagtgatcatgccactgcactcaagcctgggcaacaagagcaaaactccatcttaaaaaaaagttcaagctgataaggtgatcctgcttcactgaattgaaatgatagtgtcataataactgacccataggaaatgttctcaaaagaaaggatagtatctatcatttattgagttcccataatgtaccaggccaagtgttaagtagtttcatcgactcaagtacaaacaagctggatttaataaagttctggctgatgccaaagcccttgcctctttctactattccataatggctctacaacactgtatatttcagaaagagatgcattaaaagaaaataataaaccaaatataacaaaatgcaaaacccaaacactacagctatgtggaattctgtaatctactgaagtttcttttttttttttttttttagacggagtctcactgtgtcacccaggctggagtgcagtggcgcgatctcgactcactgccacctccgcctcccgggttcaagcgattctcctgcctcagcctcctgagtagctgggattatgggcgcttgccaccacgcccagctacattttttttattttttagtagagacggggtttcaccatgttggccaggctggtctcaaactcctgacctcaggtgatccacccatcttggcctcctaaagtgttgggattacaggagtgatccaccatgcccagttgaagtttcttaattgcaatgattttgctctaacatagttttagattatggctatttagatgataaagaaaataaagacaatatttggttaaatgctcaattattcacaaaatgtatttagttttgaaatctctcctcaatgggtacacaggaaatacatttgctattttagggatgcaaagacagtgcttttcttttgtaaatatacatgtaaaatattaaagtccaaaaacaaaactatgcatacctctacagcaggtacaatatctatgccaacagttagaaattcttcaaacttcagaaatgggttaaagcagctgccaacatcaagtaatctgatttttcctgaggcttgtagcaacctaaaaacagatattttataagaacaaaatcaaatatgagaatgtaagaaatcacatagattatcagttctttaactttttggtctcaggacccttttacacatataaaaattactgacggccccaatgagctttcatttctgtgagttatatctattaataatgatcatatttgaagttaagatgaacaagtcttaaaaatattcatttattagacttaaaaaggatagtaaaaaagtacagccttgttttatatatatttacttatttaattttttaaaaattgagacaaggtcttgctgtattgcccaggctggtcttgaactcctgagctcaagtgatcctccagcctcagctcccaaagtattgggattagaggcgtgagccactgagcctggctcccccacccccaacccccatttttaaaaaatatattttttcaagtctctaatgtctggcttaattgaagatgaatgaattctaatatctgcttttgcattcaggctgttgcaacatcacatgctatgtagtctctggaaaactccactctacactcagagtgagagtaaaaaacaaatgagaatctgtaacaatacgtaatactatacacactactagtcattcttacccttattgggctatggttaaggagttctcgaatcagaaaggctaagaccataaactgactctgacccttaacatgtaatacggggataatagtggtatttacccttagactttttcccagaattaataagataatacattaatacttgaccctatgcctagtacatggtaagtgctcaaaaagtggtacatatcattgctcactattaccatgttttataaaaaatttgtatttcttccactaatgatcttccctagtaaaagcagaatttgctatatgctaaattctgtagtatagattctagtaaactgagtagcaaaacatttctgagagtcttaaaaaaatatacttcttataaattgaattttctttctcaatgaagtatcctaaaccattcaagttacttcaacattatggaacaatcaccaataacttaatcatatcatggattagcttaataactgatcaattgtcagcaatatactaagcctatttcaaattatttggcttcgctccttaattttttatttgcataaaatatacactcagtgagtgaccatgtaattaccactcaggtcaagacataatgactgcatcctggaaacatgaccctccctgatgacatcccccacacctttattttaggtagtcactatccctattttagtcacttatccttatttattcccttgatttccttttatagtcttaagtacctacgactgaatgtctacagtttagttttacactacattttgtaacttgctgctttcatttgctgttgtttttgagttgtttgtgcttctataattcacttttactgctgtacagtagtacacttaagacttttattagcatggcattaagtctaaagatcacttaaggagaattaacatctttacaatattcaatcttcaaattcatgaacatgaatagttatccatttacttaaaaaactgtcaatagttttgatcattttctctaaaaagttccctcacatcttttgttggagttatattccttggtatttcctagtttttgatgcttttattatcttttttcccatggatacactttacttttttttttttcaatttcattttttattgttggttacacagatgcaattgacttggatacaatagtccccccttatctggtgtttcaccttttgtggtttcagttacccgcagttaaccatggtctgaaaatgctcaacagaaaattccagaaataaaccaattcatgagatttaaattgcgtgacattctgagtagcatggtaaattctcacaccgtcagacccaggacacgaatcacatccatttgtccaaagtatccacgctttttgcattagtcattaacaggatatcttatgatcctgatatctaacaattcacataggcatggcttcatgatctaggattactgaaagcaggtgatcctcctcctcctgatgtacggtcagaaggtcaacagtagcctaacgctaagtcacaatacctatgtgattcacctcactccatcccattgtatgggcattttatcatctcacatcataagggtaagtgaagtaccataagacactttgagataccatactcaaatactttaaaaattatgtgagtaaatgaagtacaataagatactttgagataccatactcacgtaatttttatagcattttgttataattgttctattttattgttattcttcttgtgcctaacttataaattaaactttatcatgggtatgtatatataaaaacatagtatgtataggattcagtaatgtctgtggttttaggcctccatgggggtgtcagcatgtactctctgtgaagaaggggtggctactatgcattattttttttagatccagcagctttactaaatttatctcgattgtttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacaagtgagaacatgaagtatgtggttttctgttcctgaattagtttgcttaggataatgacctccagctccatccatgttgctaaaaaggacatgatttcattcttttttatggctgcatagtattctatggtgtatatgtaccatgttttctttatccagtctactgctgttgggcatttaggttgattccatgtctttgctattgtgaactgtgccgtgatgaacgtatgtgtgcatgtgtctttattgtagaatgatttatagtcccttgggtgtatacccaataatgggggattgctgagtctagtggtaattttgttttaagttctttgaggaattgctacactgctttccacaatggctgaactcatttacattcccaccagcactgtattagcattcccctttctctgcaaccttgccagcagctgttattttttgactttttaataatagccattctgatgcctgtgagatggtatctcactgtggttttgatttgcatttctctaacgtttagtgatgttgagcattttttcatatgcttgttggacacgtttgtcttcttttgagaagtgtctgttcatgtcctttgcctactttttaatggggttgttttctacctgcaaatttgtttaagttccttatagatgctggatattggacctttgtcagatgcatggttatattttctcccattctgtaggttgtctgtttattctgttgatagtttctgttgctgtgcagaagctctttagtttaagtaggtcccacttgtcaatgtttttgttaaaattacttttggcatctttgtcataatctttcccaggttttatgtccagaatggtatttcctaggttatcttccaaggtttttctagtttaacatttaagtctttttaactgatcttgagtttatttttgtgtatggtgtaagaaagaggtccagtttcaatcttctgcatatggctagttatcccagcaaatagcgagtcctgtccccattgcttttgtcaactttatcgaagatcagatggttgtaggttttatttctgggttctctattctgtccattggtctgtgtgtctgttttggtaccagtaccatgctgttttgtttactgtagccctatagtatcgtttgaagttgggtaacatgtgatgcctccagctttgttatttttgcttagaattgccttggtgatttgggctcttttctggttccatatgaattttaaactagtttttcttaattctgtgaagaatgtcattggtagtttgatgaaaatagcactggatctgtaaattgctttgacagtatggccatttcaacaataatgattcttcctatccatgagcatgaaatgttttccatttgtttgtgtcatctctgattcgagcattgttttgcaattcttgttgcagagatttttcacctccctgattagctgtattctaggtattttattctttttgtggcaattgtggatggggttgtgttcttgatttggctctcagcttgaatgttcttgatgtataggaatgctgctgatttttgtacatttattttgtatcctgaaactctgctgaagttgatcatcagatctgggagcttttagcagagactatggggttttctagatatagaatcatgtcatctgcaaacagagatagttggacttctctgcttctatttgttccttttatttctcttgcctggttgctctggccaggacttcaggaaatcattttatgcttagctagggtggtttttccttttttgacacaaatccatgtggaattttatcaaatgcattctatatatttgtgcagatatgactaatctatgtggtagaaaaaaattcattaattgtatagtgtcaaatcaatcttgcattctttggaaggtcctaatttggtttctatatattattcttttcataatctgaggatttgttttatatgtctgtgtgtatatacagtaaattctggctacttgtggtcatttggttctataaagtgaccatgaatgttgaattagtgaatgctaaacaatggctcttatggaaactacaggattaggtctctggtcataacattttcatcaatacataccttgaatttatatgtttctgtttaaaagcactgtatttaatacgtattgttgatgcattaacattgaactcgtggccaacagcactataactcatgcctgaaggaagcttacataacacatgtatttttcttcgttaaggcacaatacagcattcttgtgctcaggaacactagacttcaacaccatatgtgggggttgttttaaaagcaaagacatcaacaaaaagcacaaacaaaaaatgtaacaccaaataggctgtgaaaagggtgtttgtgtgagagagcggaaacaaggcatagctcaccttgttggacctcagttgggaggtttatgtgtagaatgagtcaaattttttgccacaagtattgattgtagggttacaagtaagtaagttttagtaagttaggtaattcacagacagggaatttacaaatgagaatcgactgtgtgtaggtattttcaggattttacatctatgtttataagtgggcaagtttgttaatcatgttgttcaaatattgatagtcttactttttgaatgtttcctcaatcttccaccattaagaaaacagaataatctctgcaaattgatttaaaggtattttgttattttcatatatgtttatttttgcaaaaaagaaatctagaaaggataacccagaaactaataaaacctcagaagatctggaacaaggtggatgctttaagtatgagatgggatgtctgagtataccgttcattgtagttttgacttttggaagttgttaatgttttacatattcaaaaaataaaaccactataaactaatgaatctagttaaatgtcaaataacacagaaggaaaaccaataattcaataccatttgagcatactattctaaagacaataatcttgatgggtaatattctaaggacaaaaaaaaagaactgcaaaaatatcctgaattttaatgtttgttgttgtggtagtgctgatatagtcatcttgaaattattttgtgtgtcttgaagagctgagcaaatagcaaataaactaaagttgctgagagatacaaactcagaatgagggaacggagggaaaaaaccctgcagtgatggattagaattagaggtttcataagaaaggatgtcaaagcagtgacaccacagtaacaaaaagcatatctaatactcagaatttggtttctaaataccgttctctcactaaaaggaacctgtactacttagaggaacagcttatgccagggttgaagcagagaaagtacatggttaagcctcgatgatcttattgtacaagaaagtaaagcactgctcaaacactatgacaaggtaaaagaaactactttaaaggcatttccattggcctaatttgggatgatttcaccatcataagaatgaactttaacacaatgatttaaaatctgagactacaggtacttaaataagaaagggggagaaaggaaagatgtttttacaaaagaatgccaaccaatatatttgagcaagatagaaattaatcaccattttgcaaccactgtaataaaaacaacttgatttaggcaagaccactaatggatgctaaagccactggtgaaaacagaaacttcacttggtgtttatgtatataattcactccacaaattacagactaaaggtacttgggaggaatctggcagacatcaccttagtcaaaagatcaaacatcactgaaaatctgagtgatgccctgagaacccaatatcacctatgtagcatgcttaccagaaacattaatgtaatcacagggagttttctgtattaatgcagtccaagagatatttaactagatactatatgtaatctttgatgaatcctggatcaaacaaccatcaaaaataaatctccccaaaacaactatagatttgtcaattttcattatatatatgaagtgttaataaatttcattatttattcaatatttgtttcatatatgcatacgatactattaggcacaaattaaaaattgttatattttcctactaaatcacaccttttatcacaaaaaatgtctcctttatctctagcaatgatactctaaagcctcatgttttggatatctctcataagagcataaattggatttttatattcagagtctgacaatctatgttttaattggaatattttgatctgttatattacttttgcactttctatctgctctacctattctatgtttcttttctcacactctgtactttctttggaatcacactggaagttttaacaacacccagagattctgatttaattgaggggtacgatggagtctgggcattatgattttcaaaagctccctaggtgaatgtatggtatagctaaagttgagaactggttttagatttttcctttttaaatcttagtaattccatgtttttgattttgctaatttgaaaattttacattgcctttgtcttcacccagaccatacaaaaccttgagaacacttaaaattctgttaaccacataaattagtcattttgtgtatttcaattctattattattactggtgtatatctgtttagactttccatttgggatcactttttttctgcctgaaagatagctttagaatttcttttaagtgaggtttggctttcccattctcgcctctccttctgcaactccaataaagatgaaagttatacttcatttttaacttctgtctttaaccattttattttttttattttacattttcttgtctgtgtgaggcaagacaagataataatgttatctggatgataatgtttcctagtttgataattcctcttcaattcattccatatactgagtttattttaaataattttggctttccaaatggctagtctttaaagtttctatttcccgtagaaattttcaagcaattcttttctctaaaatagcatcatccctgggatgcaaggctggctcaacatacgcaaatcaataaatgtaatccatcacattaacagaaccacatgattatttcaatagatgcagaaaaggccttcgataaaattcaacaccccttcatgctaaaaactctcaataaactaggtattggtggaacatatctcaaaatcataagagctatttatgacaaacccacagccaatatcatactgaataggcaaaaactggaagcattccctctgaaaactggcacatgacaaggatgccccctctcacgactcctattcaacaaagtactggaagttctggccaaggcaatccggcaagagaaagaaataaagggtattcaaataggaaaagaggaagctaaattgtctctttgcagatgacatgattgtatatttagaaaaccccatcgtctcagaccaaaatctccttaagctgataagcaacttcagcaaactctcaggatacaaaatcaatgggcaaaaatcacaagcattcgtatacaccaataatagacaaacagaaagccaaatcatgagtgaactcccattcacaattgctacaaagaaaataaaatacctagcaatacaacttacaagggatgtgaaggacctcttcaaggagaactacaaaccactgctcaaggaaataagaggacacaaacaaatggaaaaacattctatcctaatggataggaagaatcaatttcatgaaaatggccatactgcccaaatttatagatttaatgctatccccatcaagctactattgactttcttcacagaattagaaaaaaactactttaaatttcatatggaaccaaaaaaggagcccgtatagccaagacaatcctaaacaaaaagaacaaagctggaggcatcacactacctgacttcaaactatactagaaggctacagtaaccaaaacagcatggtagtggtaccaaaacagagatacagaccaatggaacagaacagaggcctcagaaacaacaccacacatctacaaccatctgatctttgacaaacctgacaaaaacaagcaatggggaaaggatttcctacttaataaatggtgttgggaaaactggctagccatatgcgaagaactgaaactggacaccttccttacaccttatacaaaaattaactcaagatggattaaagacttaaacttaagacctaaaaccataaaatagcttgttttataaattgtgattcataattctaatatacaaagcctttataggtctgttcttgctgcctctgctgactttaggtcgtaccttgttttcatacatgcttagtaatgatttttactataagcaatttacatttcctgaaaaattatttatgaaaattctttgagtagaagtctctttgctgtgtcaagctacctggagtaccaccagtttagggccactttcaactaaataaatacaaggtttaaagttttgtggacccactttgcagatatgaatttgtgcttgggatattctatggtttcaacctgttcagggtctgtctgctttggatgaaggaatagatttacttctggttcaccaaattgagaaagcagctgtttggagattcaattctataagaggagtgtaaaagccaacactcaagtttgccagtttggaccaatgctctcagctcaacagaagctttgtgctttgcttacttttctggcttcccgtcatcatttggattttggccttatcagttcttacctaagaagatttatccatcattttaaaaaagttttcagtttgggagattggttagaatacctagataatcatattccagtttaacttttaaagtaaaataagtaaacagataaaattatcttagtctaactagtcagcataaaatcagtttgtgacaacatagtcaacagttatgaaagtgtatgtaaataaacagtagtagtgttttgttactgttcattgatgtgaaagtactgtattacatgaatatgttaagtatgctaaagacaatagactttgagtatctattaaaagactgtactttcttcatcaaaaaaggctagagggccaatcttaagtgatcttaactgatacactttacttccacattaatatatgcaatgcacatagcaggagaacctaacttgagaatcaatacctcattaaattattaaaaaactaaaactacagaaaagtgcttgttataacacaagaggaactacctgaaaatgcatgttcagttgcttaaatgttttcaaacaaataaaacttctttgccaattataacttaaattcagcaaatatttaaatcatctaatgaataaatttgagtcttgaaagattgtatcatacaaccatgtgtaccttcttcctctaagtcaaaggttttaaaataatttttggaccctcaaacccctttaagcagtctaaagacagatcccttttcaaaatgctttcagaaatgcatgaataaatcaaatcacaaaattagttatcctgaaatagttatcatactattacaagaaaaacaaagctatgatatagtaacaagtgtttctttagtaacacattaaataatgaggattcagcaatataatgactaccacaatttctaagtagtgatgagaataagtattctgatatatataactacaatatgatacaaacatctgtaatttctctaagtaataaagtcatagatactagttttgctgcctacattcataaaagaaggaattgctaaattttaattggagtgaaactagaaaactagaagagaccgataaattcctgaacacatatccccttccaagactgaaccaggaagaaattcattccctgaacagaccaataatgagctctacagttgaatcagtaataagtagcctaccaaacaaaaaatgcccaggaccagatggattcacagaattctacagctgtagaattctacaaagagctggtaccactcctactgaaactattccaaaagactgaggaggagggactcctccccacctcattctatgaagccagcatcattctgataccaaacctggcaaagaaaacaaaaaaagaaatatccttgatgaacactcatgcaaaaatcctcaacaaaatacttgcaaaccaaatccagcagcacattgaaaagccaatccaccacagtcaagtaggctttatccctgggaagccaggttggttcaacatatgcaaatcaataaatgtgactcatcacataaacagaactaaagacaaaaaccacatgatcatctcaataggtgcagaaaaggcttctgataaagtccaacatcccttcatgttaaaaactctcaataaactaggcactgaaggaatatacctcaaaataatgagtcatctatgagatactcacagccaacattatactgaataggcaaaagctggaagcactccctttgaaaaccagcacatgacaaggatgccctctcaccactcctattcaacatagtactgggagtcctgtccagagcaatcggataagagaaagaaataaagggcatccaaatataatagaaaggaagtcaaaccatccctatttgctgatgacatgatgatcctgtatttagaaaacatcatggtcttggcccaaaagcaccttctgctgataaacaactcaagcaaagtttcaggacacaaaactcaatgtacaggaatcactagcatttctatacaccagtaaggcaatcccattcacaattggcataaaaagaatgaaatacctaggaatatggctaacccggaaggtggatgatctctagaatgagaactactgctcaaagaaatcagagacaacacaaaaaaatggaaaaacattccatgttcatgcataggaagaatcaatattgttaaaatggccatattgcccaaagcaatttacagagtcaatgctatacctatcaaactaccaattacattcttcacagaactagaaaaactattttaaaattcatatgaaaccctagaaaagtacccaaattgccaaggcaatcctaagcaaaaagaacaaagctggagtcatcacattatccaacttcaaatgatactacaaagctgctacagtaaacaaaacagcatggtactggtagacagacgcatagaccaatgggacagaatagagagcccagaataaagctgcacacctatgaccatctgatttttgacaaagctgacaaaaacaagcaatggggaaaggacactgaataaatggtgctgggatcagtggctggccctatgcagaagattgaaactagaccccttcttgacaccatatacaaaaatcaactcaagatggactgaagacttaaatgtaaaacttaaaacgataaaaactttggaagacaacctgggcaacaccattctggacataggaatatgcaaaggtttcatgactaagatgtgaaaagcaatcacaacaaaagcaaaatttgacaaatgggatctaattaaacttaaaagcttctgcacagcaaaagaaactaccaacagagtaaacagactagctatagaatgggagaaaatatttacaaactatgcattgacaaaggtccaatatccagcatctataaagaacctaaacaaatttacaagaaaaaacaaccccattataaaaagtgggcaaaggacataaacagacacttctcaacagaatacatacacgtggccaacaagtatattaaaaaaagctcaatatcactgatcattagagaagtgcaaataaaaactacaatgagataccatctcacacaagtcataatggttattattaaaaagtcaataacagatgctggtgagtttgtgtagaaaagaaaatgcttatacactgctagtgggagtgtaaattagttcaaccgttatggaaagcagtgtggcgattcctcaaatagctaaagcagaaataccatttgacctagcaatcctatcactggctgtatacccaaaggaatacaaatcattttaccataaagacacatgcacatgtatgttcactgcagcactattgacagtagcaaagacgtggaatcaacctaaatgcccatcaatggtagactggataaagaaaatggaatagtattgcagtcataaaaaagaacaatataatgtccattgcaggaacatggatggagctggaggccatcatacttagcaaactactgcagaacagaaaaccaaatagtgcatgttttcacttataagtgatgagaacacaaggacataaagagaaaaacaacagacactggggcctactttaagggcagaggtcaggaggagggagaaggtcagaaaaaataactgttgggtactaggtttagcacctgggtaacaaaacaatctgtacaacttttttttttttttttgcatgagagaaacaattcttttacattaatgctaggtatagctatcctggtttctctccaatttacaagttcttacaggatttgtaatcatacttagcaaactaatgcagaaacagaaaaccaaatagtgcatgttctcacttataagtgatgaggacgtatggatataaagagggaaacaacagacactggggcctacttgagggtagaggatgggaggaggaagaagatcagaaaaaataactattggatattaggcttagtacccgggtggcaaagtcatctgtgacatgaatttatctatataacaaacctgcacgtgttctcctgagcctaaaatgtaagttaaaaagaggtgaatgaaaaagatttttctcttgctgttcatggaccccataaagggttaagtgtcaaatgaagtaaacctggacaggttcatttcacacagaaaaggctgtcaaataaaaatcattttaaaggaatggagcaactttctagggaacctacggtgatgagctaaatatgtggccaacttctaacgagtacaccagcattttcactggtttatattaatctcacttctggttccatattcatacattttattttcctcatttaaaaaattgtatctgtttttataagccactgtatgctttttggaatatgagcattctagaaattttctgcaaattaaatagttaatacctaatataaatatgaataaaattaaactgaattactcatttttcccattttaattactgcttataattgtttctcaagagagaattcttttacattaatgctatgtatagctaccctggtttctcttagatttactcttggtaagttcttacaggatttgtaatcatgtagtccaaaataaatcattctataagaactactttcacatcaagataacttttatgtatggaatcaacaacattgataaagactaaattccagcactaatccttatgcaaattctcacagcataattttacttaggggaaaaatcttatttgcaagttaaatggcaaagtttgtggttagatatctggatttcaaaaaaattgccttagcaaattaagaataaatgatttaacagcagaaatactcaaatggtacaacaggatctttatttttcttgataatcctaattgaactattctttcttactacaattaaaggacctggaaattccagtattttgttatccaaactctatttcagattaccttttattcacagagtactacccaccaaacatacataagataaacctgtgtcagatcataatttgtaatttttgatgtggaaaatattacaactataggccaggcatggtggctcatgcctgtaatcccagcattttgagaagccgaggcgggcggatcacctgaggttggaagtttgagaccagcctgaccaatgtggagaaaccctgtctctactaaaaatacaaaattagctgggcatggtggcacatgcctgtaatcctagctactcaggaggctgaggcgggagaattgcttgaacgcgggaggcggaggttgcggtgagccaagattgcgccactgcactccagcttggggaacaagagtgaaactctgtctcaaaagaaaagaaaatattacaactacaaggactgtcaacctagaagcccaagttctaaaaacagaaatatgagtataggccaggtgctgtggctcatgcctgtaaccctagtgcttttgggaggctagggcaggaggactgcttgagaccagaagttcaagaccagcacagaccacatagctagtcactgtctcttcaaaaaatttaaaaaattaaaaaattagcattacaggtcatggtagtgcatgcctgtagccctagctactcaagaggctgaggtgggaggatcgcttgagctcaggaattagaggctatactgagctatgatcatgctactgagctccagcctgggcaacagagtgagactctgtatcttaaaaaaattttcttctgaaagacaataaataatagaggcttatattaagtaactataattataaatatatagctattgaaactttctcagtttagaaatcattttcatttgaaatttagtgaaaaagtatttcaaatctataaaaattcaagtacctttagcatcattaaaaatactttacatgtatacatacctataatttgacaaacattattgaatacctattctatctgttagcctgtttcagagcttgagatataaagttgagtaagagagtccagatactcaagaaattagtccagtgaagaagacacaagtgtaaacagtgcaatgtttgcattaggtagacgagtatacaaaatcttacgggagtagaacactcagagaagggaagggaaactcagagcgctggagcctgcagaataagcaaggttttcccaggatcaaatggagggggatggtggagagtaaaggagaagactattgaggtgggtgactatcattctagtcagaaatcatagttaactgaaaaggtgtatgtttccaatcaggtatggactttccacagactctctgaatctcattataaaagtgccttttgaaatgttgtgcagtcacttatttcactatatttctttaaaaattctccaatgcgggaggccgaggtgggcgatcacgaggtcaggagttcgagaccagcctgatcaacaaggtgaaaccctgtctctactaaaaataccaaaaattagctgggcgtggtggtacacgcctgtaatccccgctactcgggatgctgaggcaagagaattgctttaacccgggaggcagaggttgcagtgatccaagattgtgccactgcactccagcctgggtgacagagcaagactccatctaaaaaaaaaaaaaaacaaagaaaaaattatttagtactacttttttcccctacccttaacattgctttaaaactcactttgattttaaaagtattttaaaaaaagaaaatatcttaaatggttctttcattggtttctgcaagattattaaatccaattctgctaccacaaataaacacacatatgtatatggcagtagttttcaaaccaacttatgctttaatataaaaaaatcacaatgtaatttcccttcacagaaatagaaaatagtttggtacagtaaaaaaaggctctggagacagataatcaacagagctctctctatctttacctacactttactagtatgtgaccttagaaattttacttatcttctttaggtctcagtttcttcatccatgaaatgagggggtagaagtagatgacctccaaagaccattctaactatacaattttagaggactctttagggttttctagatataatttcatcagcaaacagagaaaatttgacttcttttccaatttggatgccctttatttctttctgttgctcgactgctctggctaggacttcccgtactatgttgaatagtagtggtgaaagtgggcatctttgtcttgttccagttcttagggggagtgttttcaacttttctccatttagcatgatattggtggtgggtttgttatagatggcttttattattctgaggtatgttcctgcaatgcctagtttgttgaggggttttatgaaagaatgctggattttataaaatgctttttctgtgtctattgaagtgatcatatggtttttgtttttaattctttttatatgaatgacatttattgattgcatatgttaaaccatctttgcagttgggcatggtggctcatgcctgtaatcccagcactttgggaagccaagatgggtggatcacctgaggtcaggagttcgagaccagcctgaccaatgtggagaaactccgtttctactaaaaatacaaaattagccgggtgtggtggtgcatgcctgtaatcccagctacttgggaggctgagggaatcgcttggacccgggaggcggaggttgtggtgagccaatattgcgccattgcactccagcctgggtaacaagagtgaaactccgtctcaaaacaacaacaacaacaaaaaaaaccatctttgcatccctggaataaaactcagttattcatggtatattatatttttgacatgtgttggatttggtgtgctagtattttgttaaggatttctgcgtctatgttcaccatggatactggcctgcagtctttttttgtgtgtgttcttgcctggctttggaattcgggtgatattggcttcacagaaattagttagaaagaattcactacacctcaatttttgggaacagtatcagtaagattggtaccagttcttctttgtgcatctggtagagctggctgtgaacttggtccttggctttttgttattttgttgggagagtttttactactgattcaatttcactattagttattgttctgttgaggatttctgattcttcctggttcaatgttgcagggcgctggatgtttccaagaatttacccatttcctctagggtttctagtctgtgcatgtagtttgtgcaagactcaaggcatctctgatgattttttgtatttctgcagtatcagttgtaatgtcacctttgtcatttctaactgttgcttatgtgaatcaccttttttccctcagttaatccagctagcagtctatcaattttgtttatcttttcaaagaaacttttgtttaataagtgacttcagtaaagtcaaaatcaacatacaaaagtcagtagcaattctatccaccaataatgatctgacggagaaccaaatcaagaactcaatcccatttccaatagttacaaaatataaaatatctgggagtacatttaaccaaggaggtgaaaagtctctacaaggagaactacaaaacaccgatgaaagaaaatgtagatgatgacacaaacaaatggaaaaacatcccatgcttatggattggaagaatcaatattgttaaaatgactatacagcccaaagcaatctcaatcactattaaattatcaacaacatttttcaccaagtctaaaattcatatggaacccaaaaggagctcaactagccaaagcaatcctaagcaaaaagaaccaagctggaatcatcatattattcgacttcaaattacaccacaaggctataataacaaaaacagtgtggtattagtatgaaatagatatatagatcagcggaacaaagcagaacccagaaataaagctacatacctacaaccaactgatgtttgacaaagtcaacaaaaatatacaatggggaaaaaagcctactcagtcaataatgctgggaaaactggatagccatatacaaaagaatgacattgaactcatatctcttgccatatacaaaaattaactgaagattgattaaagatttaaatgtaagacctgaaactataaaaatccagggaaaactcttctggagattggtctaggcatgaattcaaaagcacgagaacaaaaacaaacagacaaatgggacttaaaagcttctgcacagcaaaagaagtaatcaacagagtaaacacacaacctacggaatgggagaaaatatttgcaaactgtgcatcctacatagggctaatatgcagaatttaaagggaattcaaacaacctaacaagaaaaataacaatcccatttaaaaagtgggcaaaggacatgaacagacattcttccaaagaagacatacaagtttccaacaaatatatgaaaaaatgttcaacaactctaatcatgtgaaatcacaatgagatatcatctaacaccagttagaaaggccattattaaaaagtcaaataacaacagatgttggcaaggattcccaccacacaattggtaggaatgtaaattagtgccacctctatggaaaatggtgaactaaaaatgtaactaccattcaatctagcaatcccactactaggtatctacccaaaggaaaagaaattatatataaagacacctgcccttgtatgttgatcacagcactatctacaatagcaaagtcatggaatcaacttgtatccatcaataaatggctaaatacagaaaatgtggtgtatatatgtacatacacatcatggaattctacgcagccataaaaaatgaaattacgtcttttgcagcagtatgaatggaactggaggccatgaccttaagtataatgactcagaaagccaaatacatgttctaacctgtaagtgggagctaagcaatgtgacaaacacattgacattgtttgtcaatgtggcaaacagagtgaaataatagacattggagaatccaaaaggtgggaggggagtgggggatgggaaactacttactgggtaccatttacactaaaagcccagacatcactacgcaatgtatccatgtaacaaaaatgcatttgtactccccaaatctattcaaataataaaaaagtaaaaaataattataaaatttttggtcagcccttgacagaataaaatatcactctcttgcccaattctagtttttctatatcaacttgcagcggtaaattatttaaaaaatcactctctagtaaattaggaaccacatttcatgaaaatctaatttgtcatgttaatatacatctaacagcagcaaagctctaacaagaacctttcttagtgtgtcatatattgaataaaaactggtgtaatcctggcactgtcagatccaatgataatgaaccagagtttctttcactgcctcaacatggaatcaagagtgtaaagagactctgtcaccgagaagcaaaagactctctaaaggacaacgaactaaaatgctgttaggctggtttctcttttcagcatatctgccctacatttcatttgcattttgtaaagtgataaaacacactaattggaaaacaaagcttggctaaaaagtttatttctgttatgctgcctctacattttaatgctactttgaaatgttcatttatattccttaaattttcacttctgattctttagacaaatttatgcagataatcttaaaactgcattatttaaaaatatttttataacttaacttataacttcatttgacattttttcctttattcagcggaaaagaattgaggaaatacccttggtatatataatgatgtatataagctattcaaattataattttctacttaaatttaaatttcatatacagtttttaactcaatattgtcttttcttttccaaaacagagttcaagatcgtatttctttactctcgcccccttgattcccaccctgctggttatgtattttaataaggaaatataggatttttatttcctacataattttgtttggtgtgtggccagtgctgacaacagcattttgaactactcaagacatgttaagaaagagctgtaattctaagtaagctttttttgcttattgagtaagaaaacctggcaatatttacccaagtatgtagtttacagtagcttttttgttgttttttcaaagtgctctctacagagccagaggcattctctagagtcagtgaagggccagcaaaggcagatatgggagataacagtaggctataacttttataaccttcaaccagaacagcaattttgattcatatggtgggcttccataaaaggtttcttctgaataaagattctatggttaaaatactttgaaatcaatgatctaggccttatttatcatctctgctgctttgaagtaggggaatgagaaaaataggtttctatttcgtatcttttagagcagggaaaattcaaaaagaaaatgcgttgagagtcagtttgtacacagcattgtcacttcttgaattgatgacagtcatacacatgagaaatttttctaatgtccacttttggggctgttagatgagaagtgggtaaaatttattactagatacctgagatgacataaaatcattagttcctcttgtctcagtcatttaaggaacagcagaaaaaaatagttagaaaatatctgactctgcatgagactaggcttattctcatttatttggcaacttacccttagcatttttcatataatccatttcatttctgtatgcataaaaaaatccctgaaatactgactggttaaagattattggttttgattgcaatgtgtaagccagaaaacagcttctcctctgtgttttggtgattaggaaataaaaaattcattgcaagaggtaagtgtggtgatcaaaggttacttatgggctaaacaacctgcacaaagtagatgaaaaaaattctgcctatcataccatacttaagctttaacaagaaaagaagggaaccagatattggctcatagaattaatgatttatatctgaaaaaagtttttctcaaagagcatttcatgaaatagtcttgcaagaagctctttagtcaataggtcaatgaatgtaggaaatgtattctctttttgaaaagctacacaaagaatgtaaccgtctaatagctgtatggttaaggaacttaatttctttagtccaatgtttccccaaatttattttgctgacaaactcccttttcaagaacatattactatcttacagaccttttctggaaaattgagaccagagatctgagaatagaggcttcttaacaaaggcaagtatatctggtttctaagtaaaatatctggaaaaaacaaaaggataacccagaaactccatatacagagctcagagaaaggtataaagaattaagtaaaaagatcttagctatggcttttttcccgtagatgtccagattcctgctcttattgagaatattctttgtgttgctatcatcatgaatatcattaccatataacaatgacagcggccactgcagcagcaatgcaaagttcttatcagtaggtactactactctcattttatagatgaggagactaagtcttaatacaccaaaggtcatatggctaataagtgatttcagatgggattaaaatatttagcagcctgagcttttaatacttatgctttctatatctaatatagaaggaaatggcagtttggatacatcttaatcgttttccatgcataagattaatatacaatggaaatatatactatgaatgttatacttcactttgaaaacaaccctaggtattaggtttttattgctgggtaacaaactaccacaaacttaactttaaaacgacacccaattccataggtcaaaagtgcaggcaggcatggctggtactctttttagactctaataaagctgaaaccaaggtgtcagctggtctgggctcttatctagggactatgtggtatagaatctatttcaagcctcattcaggtttttggcagaatctagtttagcgtggatgtaggactgaggtccctgtttccttgctggctggctgctgggagtcattctcagcttctggaggccacccatatttcttagatcactgccccctccgttttcaaagccaatagcacattaaatccttcttatgtttcaaatctccctgacaccctcttttcccctcctcttctgctaaatctgaagaaagttcttggtttttaaggacttaggtgattaggttaagtttacccagataatctattttaagtaaattgattctgtaaaatcatttcggcagtacctagattagcatttgactgaattaacaaggaataacaattttggaagcgggggcatcttcagaatcttgcctacctcaccatgcttgggggagattaaaaaaaaaaaacttttactttctattagccactaatagttttagaagtttattcagaatttttacttttgtggttagagagtgacatggaaatactgagacttaagtgtttcgtgtgtgtatatgtgcgcacatttgctaataaaaacccagaactttatgttgtttctttgaagccatgaatataaacgagtatacaactaactcagaaattcagttaaatgaatgtcattttgattggactgttacaaaatgaagaaaaatcacaatggcagtagaaattaatacccgaattatagactttttaaaaaagaaaagtgtattatttttatttactttttttttcttttttttttttcgagaccgagtgtcactctgttgcccaggctggggtgcagtggcgtgattttggctcattgcaacctctgcctcccaggttcaagcagttgtcatgcctcagccacctgagtagccaggactactggcgtgagccaccacgcccagctaatttttgtatttttagtagagatggggtttcaccttattggccaggctggtctcgaactcctgagctcagatgatctacctgcctcggcctcccaaagtgctgggattacttatttacttctttgaggatgtaaagaagcaaataccagcttagcagcactgacctctgcatatcttttttgctatagttttgaagtatttgaaaaagttgcattcaaaattaacaacttttgcaaataacagaaaacataagggaatattaatattttgattatctcaaataatgttcctgtacaagaaaactacgtgatgtaaaaatatttattgtccaaatgtatttacatatttaattcaatttaaatgagtatctcctaaaacaattctttttgaactaaaagaaatgaggaaaaatcagaaattaaacaatattcaaaactatatagtaaataaaactgaacaaaggaacagaatacagatagcttcagctccatctataaacttatctgataagttaggttcattcattccctaaatcacatatacacataaacctcaggtaaattggtattgagttacatataatctgaacacaaagtatttaatatacagagtttatgctaaagaaaaaaaataatgaagtcagcagtaaaatgttcttttaatcttttttttttttttttttttttttgagacggagtctcgcctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggccatgttcttttaatctttacagcactaaaataaaaccacaaaacaatggtttgaataaaaatataaacaaacccaataagaaagtaaaaaacaaactgaaagccattaatactaatctatattagaaatcacaaaacaaatacaaacatgtatctaaagtcataaattgcaaaaactataaaatttacatatacacaatcatcacacaccagtgacaaaatgaaaaagtttcagagctgtgctgatctatattgtgtctttgcatcacagaagaagaatttagaagaaaaggtacccccagcttcttcaaataaaaatgttaagttagtctattctgtataaactaaagaactgtatgcaatggcccaagttgcctgcccagagaggctttccagagcccatgaagaagcaacctggctgtgcaaatgtgtgtcacacataccctgaacctgtaagtgcacacactgccagcaacctatgacatcccagtaagatgagcttgtcagggtcagagtaggaggtgagcaaacactgggcatcctagagcagcaagtaggtcagggagatgtcccctgggatgcacaatatggctgggaaagaggaagcaatgctatgagtatttgggtaataaatgatgatggtcttttttgttgctccagggctgggttaggaggcaggaccaccatttgttcttatttaagtcagtataaacatctacccatgtgaatggcttactccttggatgtggctaacttgtgtggtgtggagtctgaatactattagtggcaaccttttaaattacttttaaatcaaaatgaaaatatttagtaagaactatgaaacattcatagtctttgaactgcaatgttactataaattttctcttaaggataacatgatagaaacaaagacatgaagcatgaacttgattatacagccattaaaaataaacatgaagaccacactagatacagaatgtttaccctgacagtaaaaacagaatataaatatacagattttgaaagcagcaatgtaaaaacatataagaaaatagaagataatagtaattctgagatagtaaaatcattacagaatattttttaaattctataatttttaaaataaaaatcaagttgttattcttaaatgcttaaatacttcttatttatttgttaaaaatcctttttccagttagcaaagataaatttttgattagatgttaatcataaattcaaactaatgtgattttaatatatgtcagtgatttacttgtgaaagtgtatatacttaatgaaacatttggctttcaagttttaacaaggctatttgtacagggtgtccactcctatgttcctaaaagtagagaatatataatattacttacaagtgtgggaagccagtatcagaacttctatttatctgtgattttaatttctgaaagaaatgaagctgtactgatatttaatacatgaaatgacacttcagaccctgtgatgattaatattatgcatcaacctgactaggccatagtacctagatatttgatcaaatacctgtttagatgtcgttgtgaaggcacttagatgaaattaactttaaattagcagactttgagtaaagcagactactctctacaatgtgggtgggcctcatccaatcagttgaaggccttaatagaaaaagactgagtttgctcccagaaaggaaattcagcctccagattcaagctgcaatatcaacttttccatgggtgtccagcctactagcctgccctgcagattttggacctgccagcccccacgattcatgtgcatcagttccttaaaataagtttctatctctatatatacagttatgagccacataacaacgttttcagtcaataatggatggcatatatgatggtggtctcataaacataatggagctgaaaacttcctattgcctagtgatgatttagtgcaatgcattactaacatttgcggagttgctggtataaacaattctgcattgccagtcttggaaaagtaaagcacacagaattatgtacagtatataatacctgatactgataataattattggttatgtatttactacacttttgttatattagtgtattccttcaggcaggtccctcaggaggtattccataagtattgttgccatgggagatgagagctcctttgccagtaatgacctgccagtgggacaaaatttggaagtggaagacagtgatattaatggtcccgaccctgtgtaggtctagactaacaaatgtgtttgtgtcttagcttttaccaaaaaagtttaaaaagtaaaaaaaacaaaatttaaaagcttatagaataagaatataaaggaagaaattattttttacaatgtgtgttttcagctaagtgttactgcaaaggagtcaaaaagttaaaaatattaaaaaatttataaagcaaaacagagtaagctacgattgattttactgaaaatgaaacttaaaaagtaaatatagtatagcttaagtgcacagtgtttataaagtctatagtagtatacagtaatgttataggccttcacattcactcaccactcattcactctcacccagagcaacttctagtcccgtaagttccattcgtggtaagtgcactatacaggtataccatttttaatcttttataatcatatttctatggtgccttttctatgtttagatacacaaataccattgttacaactgccttcagtattcagtacaaaacatgctttgcaggtttgtagcctaggagcaaatgactataccatatagcctacaggtatgtataggctataccatctaggtttgtgaaagtacactctatgttcacacaacgattgactaatgacacatttctcagaatgcatccctgttgttaagtgacacatggctatatatatatacccattctattctgttctgttcctctggagaaccctaatacacaaccctacacagacaaccctgttatctgatggttgagctttctgtttgttaaggaggaataacaatggcatccctgctattcgttcccttattgcatcctgcgactgtattgagttttcttgctcttagttaagtgcatacagtgaattattgacttaattaaactaagtctcacaaaggagtagctcatcaagattctttgcaaaaaaaactaaaactaatacaaatgcaagaaaaaaagtcaacagatttgccaggcgccgtggctcacgcctgtaatcccagcactttgggaggccgaggcgggtggatcacgaggtcaggggtcaggagatcgagaccatccaggctaacacggtgaaaccccatctctactaaaaaaatacaaaaaaattagccgggcatggtggcgggcgcttgtagtcccagctactcgggaggctgggacaggagaatggcgtgaaccggggaggcggagcttgcagtgagccgagattatgccactgcactccagcctggggtgacagagcaagactctgtctcaaaaaaaaaaaaaaaaaaaaaaagtcaacagatttgatacttctcttcctagtaaaaacactctttgcaatagtgaggcaaaaagtgactaaatcagatcctgacaaaagctggaaaaaactataaaaaaggctaacgtaaatacagatttacatttgctcatatcattgccctaagtgattatgtcttgagatatgggtgtacaacacaggtgagttataataatattttaaaatattatttccttcaattatttcatctcttatttatagcacaaataacttgctggcaacctatactgcagtagtttttgacaactaaattttgtggtaggacatgtttctttaacaaaggggaagtatctagtgcttaagaatacattttatatttcatagaaatttcttatgatttaatacacttatcagtcttcttaaaaatgacttagtgagctgagtgtggtggcatgcacctgtagtcccagttacttgagaggctgaggtgggaagattgtttgagcccagcctggtcaatactgtcagaccccatctcaagacaacagaatttcttgataataggagtatacatcatgaccgttagtgatttttatagacatataggagttggcttctacaataaatatggctgtttttggaattatttattgcttttctctaaaacagttggtcccttgactcactgtcacattttcttattaataaatctgatccttctgtcttcttgaggtttctaatctgctatgcttgaaaaattctctcctcttcattaaatataagtcagctaaaagtggacctactgtctgatgcaaactagggtaaggaactaaatagtacagccattagattacgaacatcttctgaagatataaagtcccctttttaaaaaaaccttttcccgaatagtctactccctaacattttaatcctttgtttttctccttgggatcatccataatgttttcatctgttgtatttatgattccatcctattctaaatactttgggtcacatcgttgtactaaatggtaaacaattgaaaagaggccaggtacagcggctcaggcctttaatccaagaacgttgggaggctgaggcagggtggatcatttgagctcaggagttccagaccaggctgggcaacattggtgaagccctgtctctacaaaaaataaaaaattaggtgggcatggtggcacatgcctgtagttcaagatacttgggaggctgaggcaggagaattgtttgagcccagcaggtggaggttgtggtaagctaggatcacgccactgcactccagcctgggcgacaggaatgagactgttttttgttttgagacaaacaaaacatggaaaacatggaagagatcttctaggggtaaaaagaaaacagaggattattaattttccctgtttcaaacctcaatgttgtcatctccatattataacgttagagttaacttaatcatgagattggcactattgggcattcggaaattaactctatggtcccttctcacagagaatttattcattcactcaattattggattgcattatatacaaggctactggtgccaggccttgagacgtagaaaataatatagttctaacatgttttcatggagctttacaatctaatacaatggtatggaaaattaaaatgctccttgggccagttattaagtgaagaattaatggttttagaattctctaacctgggctggatatggtggctcatgcctgtaatctcagcactttgggaggccaaggtgggtggatcacctgaggtcaggaatttgagaccagcctggccaacatggggaaaccctgtctctactaaagatacaaaaattagcagggtgtggtggaagacacctgtaatcccagctactctggaggctgaggcaggagaatcgcttgaacccaggacgtggaggttgtagtgagctgagatcatgccactgtactccagcctgggcgacagcgtgagactccaaaaaaaaaaagggggtgggggctagaattctctaaccctttcttaagttctcagccactatgacagctgatgaaactctggcatcacactacttgacttcaaactatactacagggctacagtatccaaaacagcatggcactggtttaaaaaaatacatatatataggccaatggaacagaatagagaatcccgaaataagatcacacacctacaagcatctgatcttcgacaaaactcaaagaaacaagcaatggagaaagaattctctattcaataaatggtgccaggataactggttagttatagtcagaagtttgaaactggatcccttccttaagccatacacaaaaataaaatcaagatggattaaagacttacagatacaactcaaaagtataaatccctgaaagacaacctcggcaataccattcaggacataagcaaaggcaaatacttcgtgatgaagatgctaaaagcagttgcacaaaagcaaaaattgacaaatgaaatctaattaaaataaagagcttctgcatagcaaaagaaactgtcaacagagtgaacagacaacgtacagaatgggagaaaatttttgtaagttatgtatctgacaaaggtctagtatccagcatctacaacgaacttaaacaaatttacaagaaaaaaaacaactccattaaaaagtgggcaaaggacatgaacacttttctaaagatgacatacacacagccaagaatcatatgaagaaaagcttgatatcacttatcattagagaaatgcaaatgaaaaccgcaatgagataccatctcacgtcggtcagatgtcaaaaaataacagatgctagcaaggttgtggggaaaaaggaatgcttacacactcctggtgggagcgtaaactagttcaaccattgtggaagacagtgtggtgattcctcaatgaacaaaagaaataactttccatcccattactgggcatatacccaaagaaatataaatcattctattataaagacacatgcacatgtatgttcactgcagcactattcacaatagcaaagacatggaatcaacctaaatgcccgtcaacagtagactggataaagaaaatgtggtacatatacaccacggaatactatgcagctataaaaaaatgagatcatatcctttgcagggacaatggccatggtggccattatcctcagcaaactaacgcaggaacagaaaaccagataccacatgttctcacttataggtgggagctaaatgagaaaacatggacacagagggggacaacccacattgaaacctattggagggtgggaaaatggagaggatcaagaaaaataactaatgggtactaggcttaatacctgggtgatgaaataatctgtacaacaaacccccatgacacaagtttacctatgtaacaaacctacacttgtacccctgaatttaaaagttaaaaaaaaaatctggcatttggacatgggttctcctgtgtttttatgataaagtttaatgataggatactgtgaattctatttgtattcaacctggagttaatccataacagtacaaagatctttggggggtaggcttttcctcaagaatgattcttaaacaaatactgcttaaaggcttagagagtgactgagtacttcactctgaagtacttgaccactctacactcatatttacagctgaaagttctgtgttttaaccactatcaaattaacacaggtaacaatatttctttggagtccaaaaccactgctttggagaactgaggtgggaaaataatccagatggctaaagttcttcaaaaatttatatatttttcttttttgagacagggtctctctctgtcacctaggctcgagtgcagtggcacaatcacagctgactgcaaccttgacctctcgggcttaagtgatcctcccgcctcagtctcccaagtagctaggacagaggtgcgtagcaccgtgccccactaatttttatatttattgtagagatggggttttgccatgttgtccaggctggtctcaaactcctggactcaagtgatccgcttgccttgacctctaaaactgctgggattacaggtgtgagccaccagccctggcctaaaaatttctgtatttcaaagatggcttccacctgtagttcacatttcatctttggttagatttaaaattaacgctatactcttaattttaaaattttaaaattggcattctcagtcgggcacagtggcttatgccttaaacccagcactttgggtggctaatatgggaggatcacttgaggccaggagttcgagaccaacctaggcaacacagcaagaccccccatctctctcttttttttgagatagagtctctctctgtcaccaggctggagtgcagtggtgcaatctcagctcactgcaacctctgcctcctgggttcaagggattctcgtgcctcagcctcccaagtagctgggattacaggcacacgccaccatacccagctaatttttgtatttttagtgaagacagggtttcgccatgttggccaggatggtctcaatctcctgaacttgtgatccgcccgcctaggcctcccaaagtgctgggattgcaggcgtgagcctccatgcctggtgtcccgtctcattcatatatatatatatttcatatatatacatatattcatatatatatcatatatacatatattcatatatatatttcatacatacatatattcatatatatttcatatatacatatattcatatatatttcatatatacatatattcatatatatttcatatatacatatattcatatatatatttcatatatattcattcatatatatacttatttatatatttattcatatatatatatttatctatatacatatatttgctacttgggaggttgaggggaaggactgcatgagcccaggagtccactatgatgagctatgattgcaccacttcactccagcctgggcaacacagcaagaccctgtctcttaaaacaaaatacctaaaaaactcatgatattctccagaaataaagcaattaccctctaacattctatattagattattcaactatatactaactatttacatgccaggcattccacaggtttcaataatacagtgataaagaagacaaagctattatccttaaatacacacagctaaaatataatttaggtaattgctatataaataaaatgctttatgaattatttttacatgcttttctgtatagagagctgaactgaggaagaatgtgaaccatacacaatataataaatgtataatactactgaggactgtaatttaaaaaacaaagaataagatttgagattaaatgtctatatatttttccatatacagttgctcaataccaggaatttggctattatccacatagtaagaataagcttacaatggaatatattataaaacttggaatagggaaacatctcagaattctgtgcaacattacaactaaagaagccacctctgcctttggccgacccacagctaggtaatctccccaggccaagtgaaacagggagagtgaaaaagagccagggaaggaagggcgtgagttctagtggccacctgcctgcggctacacagcagttgcctggtaaaatgaaagaagtcaggaagggagttgggtgcaacccaagaagagggctcttctacagagtttcagtttctgttgtacctctttaaatagcagctgccccataaacttcatggtagaaggtttagaaagccaaagactcaacctccattctccactataggtcccaaacatagactctgcccaggcctgaatactacatctcgaaagtgtttaaaaatttcctttgttttccaattagcagcagacttcatactaatccctgcttttcttacctgctttttttcctcctctcaagatgctttcaaacaatgttactgctatactttctcaaaagaatgcgattgtaaacaaactggggaagacattaaataccagatgaaggaatttaaaaattgggctctgttttcccctgcatatgccattgtcaattatacgtttttgtaatgtccatcatttgatacaaattactggaaaactgaaacacaatacagccaaaatgtttcaacatctccaaaggactgcactagctccctagcaatggatcctaacctgaatgaaatgaaaattaaaatagtgtcagggataagaagcttagttgtcaatcttaatacaattgagacaaagataaaattcattcagcttgcttaaaacagtgaattttcaacctctcaattttgtaatcactggacacgtaattgaaaagctaaaaattcaatcgtgtactcaattttatgaatattaaagaacatgtataactactgaaaatatattgttactaattctgttcaaagcatgaggcataattaataattttctatttctcaaggaaatggaattaaaagtcttcttataactgtccaacttctgaatttcatattactcttataaaaattttcaggaattctttatgatacaaaactacccatacgtgaagaagttatggtgtctataggtacaatgccacttagtatgctgacagtctaagtaaaattattttcttactatagtaataggataggattttgcatgtgtcaaaacttttggataatgttcctgaatggataaatcataaaacatggaataatattctaaaaagcacaagacttttctaaactctgcagaaaagaactatatttaaataaaatgcctatcagttagcttgtttaccaaatacagttaatatttaaaagcaaaacatgaaaaattatggctttgctttagaacaggggtccccaacctctgggctgcaaactggtattggtccgtggcctgttaggaaccgggctgcatagcaggaggtgagcggccagtaagcattaccacctgagctctgccttctgttagatcagcagcagcattagattctcataggagcatgaaccctactgtgaaatgcacatgcaaaggatctaggtggagtgctccttatgagaatctaatgcctgatgatctgaggtggaaaagtttcattccgaaaccacccttcacccctgtccatggaaaaattgtcttccacgaaactggtctctggtgccaaaagggttggggactgctgctcaagaacaccttacacttgcaaactactatgtctactattaagcaaccaagagttttgtcttttttccccaaaaatggtggattagaggctttcagcattacccatccacttggaaatagcaaaaatagtgcgtaaagatcaatatgtaactttaattcaagaaggaaaatgggaattcaccagactagtaaaggataccctagaccctggggaggagaaggcaagccagcaatcctcgtgaaggtgtttggctggttacatgaatgaaagccccagtatgtgaaaggggcagtctgtcttcctgtgtgtctcacttttctgctagttatctgtataacccaggcaaagggagagcgccctgtttctcccaaaactgggaggtagtgtggggaaaggctaagagatagtgagggaaagacaccaggaagctgcaggcattttcccagacctaggactgagaggaggacaccatttcaaattcaggctcacacaaagtcagtcactgtttggccacctggcaacagcagccactgcagacattttagtatcagtcagagactggagtgcttgctctggagcagggaaaaggcccccacagccagaatcaggcagtgagtgtggagagtgccccagcagtagttgctggaattaggctgtctcctgttgcaagaccggagtggaaggagagttgctgaagctggtatttctcctacgtggtttgacttgcagccagggacagctttgtgacctggaacaagtctgcatgggtcactgctgggtgtcccgggctgcttccttggttggttgcgggacagtagcccaccagtccaaagacagggagggaagcagtctccagtcccctggagatttaaccttcagtgtggactgccccaacagaaggaggaacgtggcctgccaaagccttccttgggtcaaaggaaacaaaagtgaagcacaagccactgaagggggcaacagcaaagccaaggaatgaattcggagagtgggggtaatctctcgcccccagccccgctcattagtgcactgggacgaatgcggcagcagctctacatgctggggaccagagcgtgtgggctgagagaggtgctgtgcaggcctctccagcagctccactcccgctgaagaccagtggcactggcgggataaggatgcttcttttgcctctgtcgcctcctgctggctcttactcataagcgccatctactggacggcagcctgaattacaccaccaaacaagaatacatctctacaccaagcaacatccgagaaagccactgtagaaactatctgcaaccaaggaacccataacacatgaatacacccagaaatgaaatcaaatgatcatattcaacatacaccagtcatatcaacgaaataaagcataaaaattaaaaaaaaaaaccatcccaatgatagcaaattcaaaaaaagcagcaccagtttcctcggatgagaaggaacaagcacaagaacttcggcaattatagaaatccagtgttccatcacctccaaaggatcacatgagctccctagcaatggatcctaatcagaataaaatgactgaaatgatacagaattcagaatatggatggcaagaaaactcaacaagattcaagagaaagttgaaattcaacagaaaacagaaaaatgatccaggagttgaaagataatataaccatattaagaaagaaccaaccagaacatctggaattaaaaaattcactagaggaatttcaaaatacagttggaagccttaacagactagacaaagcagaagaaagaatttcagagctcaaagactggttcttcaaatcaaccctgtcaaataaaaataagaagaagaaaagaacacaaagccttggggaaataagggattatgtaaagcgatcaaatctacaacttactggcattcctgagagagaagagaaaacaagccacttggaaaacatacatgaggacataattcatgaaaatttcccccatcttggtagagaggttgacatacagatgcagaaatccagagaagtcctgtgagatactagacaaaatgaccatccccaaggcacatagtcactagactatccaaggtcaaagcaaaagaaaaaatctcaaagattacctataaagggaaacccatctggctaacaatagatttctgaggagaaatcttacaagccataagagattgggctcccgctccctgcctttttaaaacaacattcttaaaagaaaagaaatgccagcgaagaatttcatatcccaccaaactaagcttcatatatgaaggagaaataaagtatttttcagacaagcagtcgctaagagaattcactgccatcacaggccctacaagagatacttaagggagttctaaacaaggaaaaagaacaatattccctactacaaaagcatacataaacacacagctcacagatcctataaagcaactacgtaattgagactacaaagcaactaataacactatgaaagaaacacaacctctcatatcaatattaaccttgaatgtaactgacctaaatgctccattagaaagacataagttggaaattggattaaaaaaaaaaaaaaacccacccatcttctgtctttgagagacccatctcacatgtaatacacagtctcaaagtaaagggatagagaaagatctattgcataaatggaatataaaaaaaaacaggggtcactattcttttatcagataaaacacaatttaaaccaatagtaacaaagcacagagaagggcactacataatgataaagagctcaattccatgagaagactgaactaccctaaataatatagcacccaatgttggagcatgcagattcataaaataattacttctatagtcaggaaaagactcagacagccacagggtaatagtgggggacttcacctcattcacagcttagatcattgaggcaaaaaactaaaattctggacttaaatttgacacttgaccaactggacctaacagacatccacagacaacttcacccaacaaccacataaaacacattcttctgtcatctacacacagaacgtagtctaagatggaccacatgctcagttataaagcaagtctcaataaattttaaaaaggtcaaagtcatatcaagcatattctcatatcacagaggaataaaaatagaaatcaatatcaagaggaactctcaataccacacaattacatggaaactaaattaacttgctcctgaatgacttttgggtaaacaatgaaattaaggcataaatcaaaaactatttgaaacaaatgaaaatataaacacaacataccaaaacctctacaatgcagcaaaagcagcattaagagaaaagtttgtagtgctaaatgccacaccaagataggaaggtctcaaattaacaatctactattgtacctaaagaaactggaaaaacacaaactgattgcaatgctagcagaagaaaaaagtaactaaaattagagcagaagtaaatgaaatcaagaacaaaaaaccatacaaatgatcaatgttaatagcataaacaagattgacagaccactagttaaacaaagaccactagttaaacaaacaaccagaatattcaaataagcaaaatcagaaatgacaaggtgacatgataccaatcccaaagaaatacaagagatccctagagactactacgaacacctctatgctcacaaaatagaaattctagaggaaattcctaaaaacacacaatgtccaaagattaaattgggaagaaattgaaaccctgaagagaccaatgtgttccgaaattgaatcagtaattaataaaatccagaccagaggaattcatagccgaattctaccagaagcacaaaaaataactggtatcaatcctattggaactatccccccaaaaaaatcgaggaggaggaattcgttcctaactcattctatgaaaccagtatcaccctgatgccaaatctagcaaagacacaatgaaaaaacaacaataaactacagccaatatacttgatgaacatggatgaaaaaatccacagtaaaatactagcaaaccaaatccagcagcacatcagaaagttaattcatgattaagtaggccttattcctaggttgcaagattgattcaacacatacaaatcaataaagtcattcaccacataaacagaattaaaaaccatatgatcatctcactagatacagaaaaagcaatagaaaaatccagcattccttcatgataaaaatcctcaacaaactaggcatctaaagaatatacttcaaaataataagagccaccgatgacaaacccacatccaacatcatgctgaactggcaaaagctggtagcattctacctaagaattgcaacaagacaaaatgtccactctcatcactcctattcaacatagttgaacataaaatgataatgaagtcctagccagagcaatcaagaaagagaaataaaaggcatccaaataggaagagaggaagtcaattatctctcttcactgatggtatgattctgttcttcagaaaattctagagactccaccaaaagtctcctaaacagtcagtgaagtttcaggatacaaaatcaatgtataaaaatcagtagtaaaaaaaaaaaaaagaaatttaaaaaatcagtagcatttctatactatttataatggccattctacaccagtaacactcaagctaagaaccaaatcaagaatgcagtcccctttacagtagctgtgtgcgtgtgtgcacgtgcgtgcacacacccacacacccacacacacacacaaatacctaggaatatatccaaccaaggaggtgaaagatctctgacaaagagaactataaaactctgctaaaaaaaaaattacaggtgacataaacaaatggaaaaacatcccatgctcatgaactggatgaatcagtattgttaaaatgtccatactgcccaaggcaatgtacagattcaatgctcttcctatcaaatcaccaatgttatttttcacagaattaaaaaaaaaactattctaaaattcacatggaaccaaaaaagagcccaaatagccaaagcaatcctcagccaaagttaaaaagctggagacatcacattacccaattgcaaactacaatacaaggctacagtatgcaaaatagcatggcactggtacaaacacagatacatacactaatggaacagaataaagaacccagaaataaagccacacacaaggagctgattttcaaacaagtcaataaaaataagcaatggggaaagaagtccctatttaataaatggtgctggggaatctggctacccacatgcagaagaatgaaactggacccttacctctcagcatatagaaaaattaatgcaagatgggttaaaggcttacgtgaagaccacaaactataaaaatgctagaataaaatctaggaaacactgtagtggacattggcctaggcaaagaatatatgactaaatcctacaaagcaattgctacaaaaacaaaaactgacaagtggaacctaattaaactaaagagcttctgcaccgcaaaagaaactatcaataaacagacaacctagagaataggagaaaatatttgcaaactatggatctgacaaagctgtagtatctagaatctataagaaacttatatcaacaagcaaaaaacaaattaccctattaaaaagtgggctaaggacatgaacagatatttaatagaagacatacctgtggctaacaaacgttgaaaaaaatgttccacgtcactaatcatcagaaatgcaaatcaaaaccacaatgagacaccgtctcatatcagtcagaatggctattatcaaaaagccaaaaaacagatgttggcagggatacagagaaaagggaacacatacattgttggtgggaatgtaaattagtttagcccacatgaaaagtggtttggagtttctcagaaaactaaaactagaactaccatttgacccatcaatcccattactgagtatatacccaaaggaaaataaaaaataccaaaaagacagctgtacccttatgtttatcacagcactatctacaatagcaaagacacaaaatcaacctaggtgtccatcaatagtggactaaagaaaatgtgatacatgtgtaccacagaatactatgcagccataaaaaagaagaaaatcatgtcctctgcagcaacatgatgcagctggaggcatgttctcacttccaagtgggaactaaacactgggtacatagggacataaagatgagaacaaggcactggggactccaaacgtagaggagggaggtaggagggtaagggataaaaaacttcccattaggtactctattcactatctgagtgatggtatcaagagaagcccaaacctcagtatcacgcaacatatccttgtaacaagtaccccttgaatctaaaaataaagcaaccaagagtaataatacagaaatatgttgaattaaatataaacttagccatctgtaactttacatatatttatctgtcttaatcttgatgtttaaaaaaaccttacccttcttttattactttccatgttacctagctagaaatacagtaacactcagcaaatatttttttgaatgactgaaaatatatcattctatgtgctgtcataaccacataaaaccagtctggttcaacttttatgtaaaaaagctgtgagctatttttcagttcccatggacccttaggtcacataacctgataagcccagatcaactaagcatgcaatcacagggggaatctaagtgctaagcgcttagactaaggaaagaagtggatgctgcatggcagtatccgtgatccaatccgattgaggtctggtatcacccatcacaggattcagtcagatgatgcctctggtgtcacctgactgcaagatccaatcacatctcacctcattaccctgtgcttataaaacctgacccagcccccagctcagaggggcactgctttgggaactcttcctgctgttctccttacttgtaataagtaacaaaattcccttgatctttagttgtggtcactgggttgataaccagcaagtgatcaaacccacgggttgtgtgagtaacattctggttgcttgaggctacttggtactgtcatggataaagcagaaaatttttctgcttttcaattatagcttttcagactgaataacttttcaattccaatagtctctaccttttctcttcttctaagctctctccatcccctaattttgttaatactgtgtattagcattaaaaatgaatttaccttagatattcaaaagattaatatttttcactatagatttacaggtacagaataatatgtgctatagtcaagttaggtagaactgatctgaatttccctcaaggcattaccccttaacctttccctatcacactcctcttaagagtatcattactctataaacatcccacttgaacttcaaatcattgaaatttagatgtcacccttaacattgcacaaatccctctcaaggtcaatgatgacttaatcattaaatccaagaacatcctcttaatctgtatcccactgatgactgactttctgaactgttacgttcactgtggcttcatcattgttatacgtaagccttctctaaagttccacagttgaagtttctctctttctattttatcatctttctccagactgattcaggttatgttccagatgacatgtggttccaccaatcaaaataatgccaaatgtagtagagacttttttttgaaacagggtctcgctctgtcactcaggctggagtgcagtggtgcaatcttagctcaccacagcctccgcctcctgagctcaagtgatcctcccacctcagcgtcccaagtaactgggactacaggcacatgccaccatgcttggctattttttgtatcttttttaaaggtgaggttttgcatgctgtcctagctggtctcaaactcccggcctcaagcgatctgcctgtctcaaccttccaaagtgctagaattacaggcatgcaccactgcacctggactgcagttgagacttctgtaactattttctgatttttgaacgtgtttcttaggtccaggctcatattttcaacaacatgcaagataaatattttggcaaaggagtcctggaaatacgtacaaattcaatttatcccaaaccatactaaacttcccattccttaactctttttctcattttttaccccataatatgttctctaccccacaatatatcttctactctgtgaaataacgctaagttcagcacaacctttgtatttccctacctcaaccaggtattacaactccgtaaaatctcttgtacttatcttctttctggatctacccagagttcacagtctcatctattattactgtaattggtttctccattaaagagtatctttcaacccatataacagtgtatggatgcagagacctcctcttaaaaatatattgtttcttaagatgttaagatggcttcacctgtactgcagaaacacaggatgaattgcttggcataatattcaaagctctttattatctaaaactcagtcagctgtactagtcactgttttctgaaaatacaatgtatttatgtacttatacgtctttgttaatcttttctttctcactgttaagccctcattcctttgcgagtcatccttcaaggttcacaccaaatattagctctgagataaattcatcaaatcttcccataaaaattatcattaattcctctgccttcacagcacattcccttttactccatttataacactctcttgctagttgcattcatggtccactggactatgagatcactgtaaatgtaagagggtgcaaaagaggaagaaacatgctctatttatctttgtaaccctttatgactaacctatgttaacagcacatgcttgctgaacttaacaagtatttactgagggcctagtatgtgctgccagttttctaggagctaagttatccacaaggcagatgtggactttacttccagagtttacaatgtgttctaacaggaaagacagaccataaataattatagtaaaatctaagaaaagttagaataaaaataaaatgtgttacagcaggggttttcaaatgttttggtctcagaactcttttgtactcttaaaaattaccaaatacccaaaaagagcatttgtttatgcgggctaaatgtattgctatttaccatattagaacgtataggtgaaatacttttaaaaaatgtattaactcattgaaaatagcaatgataaaaccatcatatacgaacataaataatttctgtaaaagaactatggttttcaaaacaaaaaatttatcaataagaatggcattcatatttttgtaaatttctagtgtatggctggtatagtttggatatttgtccccattcaaatctcacgttgaattgtaatccccaatgctggaggtggggcctggtaggaggtgtctagatcatgggggcagacccctcatgaattaatgctatcactgcaacagtgagttcttgtgagaccttgtgagaccttgtgagttcttgtgtgtggcaactccccgaagtcccccaaacttgctcctgcttttaccatgtgacacgcaagttcctgcttcgccttccgctgtgaataatagcttcctgaggccttcccagaagctgagcaatgttgatgttatgcttcttatatagcctgcagaaccataagccaattaaacctcttttcttgtaaattatccggtctcaggttatagatagcaatgtgagaacagcttaacacaatggctaaaccgaaaatggctggataactgtcataccatcatgttttagcatgtagcagaagtactttttctgcgcttcccatttcatcatgtaacacaaacacaattactcaagagtttagtttaataaaattaatttttactgcttcatccatgacatttttaagtaaaactggctttaaaagaaattgctaatgtatgaagaatgcaatgactattactatagtttggtgcaactgccttgatttgtgccaaggtgccagcagttttatccactgttgcttttgaactatcagtacaaattgcaacacaataaaaaaggcaaataatgttttagtatgaatataaaaattctttgcattcacagaccattctcttcctcccccaactctatgaaagggcttctgagactcctagggatccacagagcacactgagatttgctgtgctagagaagtatgcaccctgttgataacaactctaggagtaaaggaagttatctatcagaaagtttaatatttgacactatatctaaggacaaacaggaaattatcctggtgaagggaataagtaatgggttgtaaaaggatgttctaggcagaagggaaacactaggcatgagctggaattttgcaggagcaaaatgaagttcaatattactgagttatacagttaaaaatgtactgagaaatgagggaggcatatttatgttatattaaggaacttgaattttatctcaaaggcaaagtgacatcactaaaaagttttagtaaaagagctggcattattgggtttgtatttcaaagaaactctcaagttgaattgtgaaaaacagattggagtaaaactggaaaaagagactacttagtaagagatgagatagaggtagacagactaacacaaaattgagaatttagaattgatagtaggacttggtgattaaccagatgtgcgaagtaaaacagcggaaggggtcaaaaataaatcttaaaagtttctggcttggatatgtgtatggatttaattagaaatagggaactctggaagaggaatcaatctgagtggttcaggaggtaggaaaggagagaaaattagctcgcttatgacacaaggatatttcactggcacaaaaacaaacagagaggtctagtgggcaactagatatatggaggtcaagtcagaggtctgaactgaagacagagatttggaataatcagcatatatgtggaaacaaagctataagagttaatcaagccgccatgtgcagctgccatacgctgagtgtgaagagtagagaatccaggaccaacaattaagagagacacagagaaagggaaaatactgttattatgaaacaagtagatggacttatttttaaaaaacaggtttttatagcacaagaattaagatgaggatttttaaaagaagataacatcgcagtgacagaagaaagataggaaggagaatacagaagttgattgtcattaactactaaattgccactattgccacaaaataagctaatacaggctcagtactaatctgaaatgcttaggaccagaagtgttttgggttttggaatacttgcattatatttatctgaagtgctccaatgaacacttccttcaagtaacatattggagcttcaacagtttgagattttggggcaattttgattctgaattttcagatttggagtgctcaacctgtagaacatacatctgccatgcccataaaatgagtaatattcacagatatttgctctggtaagggttttagcttaaaactcatttgaaaatagtcatttgttagttaaaactaaacagtgaagactcaattctctaaattatctttctataattttacatataagtctagttaaccttttaaattaaattagattcaattctagttactaaaataataagtaaatctttactagttagggacataatatacagaactacattaagaatcttataaacaggttaacagaataaattttttgaatgctgtacctctgactaaggaaacacatttactttatgaattcctccagacaatttctttcagtagaaaatattccgcaatcatcattttcatttatacagtcacattatagaaacctggatcatgacattcttctaaaaaatttgccaattgagctgttactcaaatgatttgaaccttataatcatcactattttcattctcaatgcctagagctttgggtcatgatcagaaaatgtagagctttagggtttttaaacatagtaattccccccaaaaaaccagctagacgatcatacagtatttcttttatagaagaaaaagagactcagaatgttagatatttccccaaagttattccctgagccagtgctaaaaattaggtaagtaactgtaaagaagcaactgataagcacagatcatttgcactccatttattaataaacttcaatataattttttaagtctagaaaatctaaggagggaaacttaattttgaaattgataataagcattctttctgcataaatagctttaaaaactagattatgcattttttacagaggacttaatatcttaatattaaatactaagcctccagagacatctggtatttgtaattataaacttatccaattaagatttcagcaaaatacatgtaggatttaactttcaggtttcaatatatttgtatatatatttgattaatatacaacggatttcaaactagaagcaaaactattaaaaaccatcactgaaatacttacaattttgtatgtgtatattattgatggcagcggtagcctgtctggagtggctgctgcaaagacactggctgcagcaggggaggtgtggccagagctacacactccatgaagctggcaggatccgggaacaggtggaagacccttcctctcccaagttggaagggaaagagccccaccctcctgggcgcagctgttcagctgcggctgcagacccgggcatccctgcgctcttgggggcctgggaagctccactgccccgcaggctcagaagtgcctgctcctgccgcccactccaatttcagagcaaagttgtgggccgagtccaggcattgttgtaacctggctgggtatgcatgtatagtgctgacactccagccccctgccaccttggccccctccagactttgggcactgacgagcataggagggaggccaagggcagcataagggtagcctggtgcaggcaccccttggcatgaatagcctgggtgccatggatgacatgaagccccaccttcaagccagggacagcttgaagactcaactcagccagggggctgacttgtcagttccagatggagtctaccacccagaatgagaggttatggtgctttttctgggcctgccaatggcccagtcagcacacacttcctcccttctgagtccataaaaacccttgactcagccagactcaaacagacattgggactaccagctgcggtaaggagctacccaattcaggtctcctcgactcattgggatgacatgcctgcaaataagagctactcactccgggtctcccctccatggagggttacactcaggactgcctgcctacagaaacaagttaccaactctgggtctcctctccgctgagagctggacacttgtcaggacaacctgcctgcagagaagctaccacttgggtctcctgagagctgttctgtcactcaataaagctcttctccaccttgcccaccctccagctgtctgtgtacatttttcctggatacgggaaaagaactagggacccacccaatgacaggactgaaagagctgaacaaaacaggaggctgaaatggccccctaccccgcttgacacattgcgggcaacaaggagagaagagctgcggcccttggggagcccagaccaattggctccctgagccaaggctgtgaaaccctctttggggctctgtggtttctggtgtctccatgcttccaggcaccactgcattccccttgttcagacatggatgcccacagcggaagctgcttgtggtacactggatccagcagcaggcttgtctggagctgcatgccccgccacagcagctggcacgcctggctgtgtgcagtggccggaccccatgttcactcacacaccccttgccactctgcacctggcttgcccttggcaggcatgggatctgggctggtagcacaagctgataacaacctgccaggctgagtcagcagaatgagcccagtgggctcaagcaaaacttggacaaaggcaccaccagccataggaatttctggctggaaaagtgacagcctaaggatccaaagacattatgttaaaaagacatttccaggtgtagtagctcacgcctgtaatcccagcactttgggaggccgaggcaggaggatcatgaggtcaggagatcgagatcatcctggccaacatggtgaaaccccatctctactaaatataaaaaaattagctgggtgtggtggcacgtgcctgtaatcccagctactcaggaggctgaggcaggagaatagcctgaatcagggagtcggaggttgcagtgagctgagatcaagccactgcactccagcctgccaacagagcaagactctgtcttgaaaaacaaccaacgaaccaaccaaccaacaacaacaaaaaatttaacttcctcctttactactgtaacatctttttttaaaaaaaaaaaaaaaaaaaagaaaaggacatttaacttcctcctttactagtgtaacatcttttgctcactaggatcacctccaatattaaaaagtccaagaaaataaaaagaatgtgaaaactgaacagaaatgaactgctaacttaaaacaaaaactcctaaaccagagagcattaaagaggatattaaaaaatcacgtttaaactgttataaactgaactagcaaaaaaagcattaatatctaattcagtcctttttattagataatttcctattgtcatgcagtatattactctttgtcacaaatcttttaagaatatgtccaatattttatatcttaaggcagaatggagataaggcctatagtaagactcttggattggcagtgaccatctaatatgttttgtactctttcctttggctgactgccactactccttcccctcttccttttttccagttaacaatctcaagtagattgttataaaaacatgaccctgctattctaaatatgtccttccatcctttccatccttctttccttttgtctgtctcttccattctttcacctgagaagcatgtgttaaagcccctccttcaataactacatatatcaagtatatcttgagtactaaagaactcaaattggtaaatacttaatatccccaaacagataattctaaaaaacaatagcaaaaaaggaaataaagaaatgattctattcacagctatgtcttagttgccaagaagcttaaagtcaaaactgtattcctatttatagcaagggtaatggacataaatggcagatgaggatgagtttcttttctcaaactgactactggtaatgcttcttagagcactgtgcataaagcattcttaggccaagcccaggctctgtaggaatgatcctatgataaattacctatatttatcatagattttggaaagtatgatgatgacatgcatgccatacttctgccatggcaagtactagaatttcgcagaatgcattttacttttctgacttcccactattttccttctattttacaaattcgcttttccttgttgtattttatgtatccattagaaatgcacactaatacaatggtgtattagtctgttctcatgctgctgataaagacataccccagatgggtcaatttataaaggaaataggtttaattgactcacaattcagcatggctggggaggcctcaggaaacacaatcatagcagaaggagaagcaaacacgtccttcctcacatggtggcagcaaggagaagtgcagagcaaggagttttataagcccattaataaaaccatcagatcttgtgagaactcactcactatcctgagaacagcagcatgggggtaattgccccattattcaattaccttccaccgggtccttcccacaacatgtggggattataggaactagaattcaagatgagatttgggtggggacaatgccagatcacatcattttaccccagcccctcccaaatgtcatgtcctcacatttcaagacaccatcatgccttccctacagttcctcgaagtcttaactcattctgttattaacccaaaagtccaagtccaaggtctcatctgagacaaggcaagtcccttctgcctacgagcttgtaaaataaatgcaagttagttacttcctagatacaatgggggtacaggcactgggtaaatacacccattccaaatgggagaaattggccaaaacaaaggggctacaggttccatataagtccgaaatccaatagggcagtcattaaacctccaagttccaaaatgatctccttggactccatgtctcacatccaggtcatgctgctgcaagaggtagcctcccacagccttgggcagctccacccctgtggctttgcagggtacagcccctctcctggctgctttcacaggctggtgttgagtgtctgtggcttttccaggtgcacaatgcaagctgctggtggatctaaccattctaggatctggaggatggtggctctcttcctaaaactctgctaggcagtgccccagtagggactctgtgtggaggttccaagaccacatttcccttccacactgccctagcagaggttctccatgagggttccacccctgcagaaaacttctgcctggacattcagatgtttcatacatcctctgaaatctaggcagaggttcccaaacctcaattcttctattcacacactttgtatgcacccacaggctcaacaccatgtggaagccttcaagtcttgggacttgcaccctctgaagcaatggcctgagctgtaccttggccccttttagccacagctggagctgaagcagctgggatgcagggcaccatgtctcaaggctgcacagggcagggggggccctgggatcagcccatgaaaccatttttcctccctaggcttctaggcctgtgatgagaggggctgctgtgaagatctctgatgtgccctggaggcattttccccactgtcttggtgattcacatttggctcctcgttacctatgcaaatttctgtagccagcttgaatttctccccagaaaacgggtttttcttttctatcatatcatcaggctgcaaattttccaaacttttatgctctgcttcctcttgagcactttgccacttagaaatttcttccaccagataccttaaatcatctctctcaagttcaaagttccacagatctctggggcaggagcaaaatgctgccagtctctttgcataggatgagtgacccttactccagttcccaactagttccccatctccatctgaggccacctcagcctcagcctggacttcattgtccatatcaccaccagcattttggtcaaaaccatttgacaagtctttaggaagttccaaactttcccacatcttcctatcttctgagcccttcaagtctcttggaagttccaagcattcccacattttactgtcttcttctgagccctccaaactgttctgacgtctgcctgttacccagttccaaagttgctcccacatttttgggtatctttatagcaacaccccactttctgtggtaccaatttactgtattagtccattatcatactactaataaagacatacccgagactgggtaacttataaaggaaagaggtttaattgactcacagttcagcatggctgggaaagcctcaggaaacttacaatcatggtggaagggaaagcaaacatgtccttcctcacctggtggcagcaaggagaagtgctgagcaaaagggggaaaagccccttataaaactatgagatcttgtgaaaactcacttggtatcatgagaacaacggcatgggggtaaccacccccatgatttaattacctcccaccaggtcccttctatgacatgtggggattatgggaactacaatataagatgacatttgggtgaggacacggccaaaccatatcagatgggatgccattttattccatcatgttaataaagagtgaaaaaatgaaaatacttaatgctagtgagttttggcaaaatgggcatttatattgctagagataatggaattagtattatctttctggaaaggaattcagtaatatgtacaagagcccatttatactcttcaacctaaaactccacttctgggaatccatcccaaagacatgaaaactcaagcacaaagatttattgctgaaataaaacagctgtgagaaaggaaacaacctaaatgtccaatgaaagaacaattcatataaagcaagattctttctaccatactgtccttcaaaaaagagagcatcagcttatgtttgagccgtacaaagtctctatgctattcagccctctcaatttttttactttgaacaataaagactattttggggaaaactaacactggcctgaaaggacttcatacagtgtagcttggttacttacctggtaagaaatcacttgataaacttggttccaccatatctccctgcccccacacagaggcaaagaaatttagtaccaatttggtaattatacattgaagtacagctttccaatggcaattattggatgttttctttaaaagatcatactgggccaggcacagcggctcactcctgtaatcccagcactttggaggccgaggaaggcagatcacgaggtcagaagttcaagaccagcctgggccaacatggtgaaaccccatctctactaaaaatacaaaaaattagctgagcatggtggcatgcacctgtaatcccagctacttgggaggctgaggcagaagaattgcttgaaccaggacctgggaggcagaggctgcagtaagcctagaatgtgccactctactccagcctgggctacagagcgagactccatctcaaaataaataaataaataaaaaatataagatcatattattcgtttttaaaaagatcgtattaaacagccgtatcatcaggcaactagataaattctccaatgtcctactggccttaggtttgtttccatcaccagcaaccaaagtgtaacttaacccccaaatacagattcagtcattatctaataatcatgtttatacaatcagtcaggaacaagaaaatgttaattcacatttggaaatgggaaaactggttcagtgtcttaaacttcattctcctggcctcacagaatgagttagaaagtgttccctctgattctgttttcaggaacagattgtagagaactggtattcttccttccttaaatgtctggtatatttcaccagtgaaaacatctgagcctggtgcttcctgttttaaaaggcagttaattatttcttcaatttctgtaatagatataggctttccatattatctatatctccttgtctgagttttagtagattgtatctttcaaggaaccagtctatttcatccaagttatcaaatatgtagtcgtagaattgttcataatattcctttttattcttttactattgatggaatcagtaatggtgggctctctttcatttttggtatttattagtaatttgtatcctatctcttttcgttggttagcttggctacaggtctattaattttgttgatcttttcaaatgaaaccttttggtttcactgattttctctattgtttttctgttttcaatttcattaatttctgttctaatttttcttttcttctgcttagatttaatttgctcttacttttctagtttccaaagatagatgcttatattattgattttgcaccttcttttctaacgtgcattcaatgctacatatttccctctaagtactgctgtcagaacatactacaaatttgatgaggtatgttttcattttcagttagttcaaaaacattttctaattcttctgagacttacttatctgacccttgtgctatttagaggtgtgatgttagatctacaaatattttgggactcttcagttctctgttactgatttctagtttaattctgttgtagtgtgagagaaggcatactctgtataatgatctatctttttaaattggttaagatgtgttttatggccaaatatggtagcatacttggtgaatattttgaaaaattataaatgtttttaaaaagtcagcaaagtaagtattttgtgataattacaaatatatgtgtacacaatgaaggagaggtagacacacagctttcctagtgttagggaaatgggtaattggggtttgggataaaatttccagtaatcatgttatacacatattcaaaaagtgccatatctaaattctgagatatagatgacttaaaggtgactccagtagtaacaaaaattgggtatgcatgaaatctaagtgcaaaaaagtatatctttactatgtgaacccttgctatctgaacccagatatcaaatggcttgaaagatatttggagataagccttagaaaaagataactcttgatatccgaacttgctatctaaactaaaaagttgaatagtttttgatagtaaaggatacatatcttcctatataatatctgtgactaaaccagtaaatatctgacctttatttcatctacatatttaaaagtggtatgtgaggtatgtatgtttgagagagagaaagatttctctttgggaaactggagtattatttggtatttcggatcattttatatttagacacaaacagtggtagattttcatgatgaaatattatgcaaaacagcattctagtggcatgggaagagaagtttacaaaatactttatgcaacatagcctcttttgtttaaataacaatgcctagtaaaaagactagaaagaagtgtacctaaatgtaaccaggattgagtgatcttttttctatgtctataatatctgttctatggcaaatttttcatacctcaatttcatttgtagttagaaaaatgttcaacagtgaattttaacacaatataaataccacaacagagttataaagaaagttcaatactggtatcaaagagtatcaattcttttgggaagttctgagaaagttctggaagagaacatgcttcaaatatagtctaacataaaatacaccaatagtttatcagaattagaacgtatcccatttgcaattgccagaaagtgagaacaagcatgtaccacactagaggaatttaaaataggtccatgtgaccagaatacaagctgcaagaatagtggcaggagaaggaagaatgagaatacacacacacacaatggggactgatgctatattaaggagttcagagtttttagaatgaacaaaatctaaaccaagccatccagggctaaatcattttaatgctaaatttcaatactaagttaatcccttccacgattcaagaaacaactataaaactatcctggataagatcatcaaaaacaactactttagggctcaaacaaaggcaaataagatgaaaagtgtttattcataaaaaccaggtgaacctagcttaggaacagtgaggatctgtcctatctttgcctggagctgctctcaccacccccaacccctgcttagctagtatgaaacttcctccaggacaggactcgttaaaaaatagcagcttcactgctagaggcggctaacttgatttggagcaaagggtaaaaaacctacacagagcagtgtcagtaaaagcagcaaacttggaagaaacaagcatggaaagtcagcagctacgctagtctcaggctgtagttgtggttgggttgagctgcagaatggaggactagtcagaaatttaacaaagatcctggaaatgagatagatatagaggagttagataagctccccacaaagccatggctgatggggaggctatgtgaatatgcagagaaaacccaagagggcctagaagaaagtaaaaggtgaggcagatttgaaaagcgcctaaatgtttaatgcactccccaatcaagacgcactctactggaagagggtggaagccttactgactgaggtgtttgagcgcaacctctaacctatcattgtttggctactaaattatgcagatactggtgcaacccctaggaaatcagcctaaaaaataacaaccccccccacctctgaaaaaaacactaaacataataagggagacagattccacagattaagtctaagcaaattactgagaaacactactactaacgcttgtaggggaaaaaaatccatgacagtttctatactttttaaccaaaaattatgagacatgcaaagaaacccggaaaagcatagtccatactcaggggaaaaaaagtagtaaatggactcttgagtgagcccaaatgttgggttaaacagacaaaaactttaaggcagtgattacaaaatatatatatattataaaaataaaaaagtatacatatatacatatatatgaatacttttttttttttaagacagggtatcactctgtcactcaggctggagtacagtgagaggtgtgatctctactcactgcaacctccaccttccaggctcaagtgatcctttcgctttagcctcccgagtagctaggaccacaggcacatgccactacacctggcttttttgttatttttttgtagagacaggttttgtcatgttgtccaggctggtcctgaactcctggactcaagcaatccacctgtcttggcctctcaaagtgctgggattacaggcatgagccaatgtgcccagccataaaaatatttaacaaatttaaggaaatcatgcttaaagaatcaaaggaaaatgcagtaacaatgactcaataaataagggaatctcaacaatataacagagctataaaaaatatatagaaatctaaagttgatattttccatacatatctgtgtttgatagaagtataactatataatttctttaactggccaacacttaaaatattaatatttaagaatgtccataacacatgagttaaaggatgtttagtaagtcgttatgcattataagctttgtagtaacctttgaataaaggtaaagatggcttatggttccctactgaagtaatcaaagatattttgatttttaaacgtaattgcttaaaactaggtaatattttcaacatgatttaaaatcaaagcaaccaaaagtaatgcttgttattatctatagttttggaactgcttaagagtatcttactttcataattattttctgtgtctatcaagaatatttctataactattcaagtttagcatttttaagtaattaacaaaatacacttgataccacaaaccaacagggtaaaagggtataggaacaattttaatattacagcgaaatacctcagagatactacagctttggttccagactactgcaataaagcaagttacaaaatttttttggttttccagtgcatataagttatgttccactacaccatagtctatgaagtgtgcaatagcattgtctaaaaaacaatgtacagatcttaattttaaaatactttatggctaaaaaatgctagtcatcatttgagcctccagcaagttgtaatctttttactggtggaagctttgccttgatactcatggctgctgactgattagcatgatggttgctgaaagctggggtgctatcagaatttctaaaaataagacaacactaaagtttgccacatacattggctgtacctatcatgaatgatttctctgaagcatcagcatgtgatgctgcttgacagcattttactcacagaatttcttttaaaattggtcagtcctctcaaacccaaccactgctttatcaattaaattttatataatattctaaatcctttgtcattctaacaatgttcacagcatcttcaccagtagatgccatctcaaaaagacacttcctttgctcatccataagaaacgactcctcatccattcaagttttatcatgaaattgcagcaattcagtcccatcttcaggctccacttctaattctagtttttcccaccacatctgcagttatttcatccatgaggcttggaataaactcctccaaactcatattcatgttaatattctgatctgctcccatgaatcacaaatgttcttaatggcatctagaatggtgagtcctttccagaaggttttaatggactttgcccagatccatcagagaaatcgccatgacaactacagccttacaaaatgtatttcttaaataacatgacttgagccaggctcagtgactcatgcctgtaatcctagcacttccagaggctgagacgggaggattgcttgagtccagaaatttgagacctgcctgggcaatatagggagattctctctctataaaaaattttaaaaaagttagctgggcatggtggtgcatgcttgtggtgccagctactggggaggctgaggtgggagggtcacttgagcccaggaggtcaaggctcctgtgagctgtgatcatgccactccactccagcctgggcaacagaatgagacccatctccaaaaaaaaaaaaataataataatatgacctgaaagtctaaattactccttgatccatgggctgcagaatggacgttgtattagcaggcacgaaaacaacattcatctcctcgtacatatatatcagagctcttgggtgacctggtacattatcaatgggcagtaatattttgaaaggaatatttttttctgaacggcaggtctcaacactaggctttaaatattccgtaaactattctttaaacagatgtgctgtcatctaggctttgttccatttacagagcacagccagagtagattcagcataattcttaagggtcctaggattttcaaatggtaaattaacactggcttcaacgtaaagtcaccagctgcattagcccctaacaagagaggctgcctgtcctctgaagctctgaagccaggtattgacttctgatctctagccaagaaactcctaaaaggcgccttcttcttccaatagaaggcttttaaatctacattaaaaatcagttgtttactgtagccactttcatgaatggtctttggtagatcttctggataacctgctgcagcttctaaatcatcacttgctgcttcaccttgcactttatgtcatggagatggtttcttagacctcatgaaccaacctctgttaagcttcaaactttcttctgaagcttcctcacctctcttagccttcaattgaagagagttagacccttgctctggattaggtattggcttgagggaatgctgtggttggtttcatcttgtatccagaccactcaaactttctccacatccacaatcaagttgttttactttcttctcattcccgtgttcactgaatagcactttcaattttaaaaataatttttccttcactttgggaggccgaggtaggtggatcacgaggtcaagagatccagaccgtcctggccaacatggtgaaaccccgtctctactaaaaacacaaaaattggcttggcacagtggcacgcacctgtagtcccagctactcaggaggctgaggcaggagaatggcgtgaacctgggaggcggagcttgcagtgagctgagatcatgccactgcacgccagcctgggcgacagagcgagactccgtctcaaaaataaaataaaatacaataaaataaatgacttttcctttgaattcacaactcagttaattctttggtagaaaaggcctagctttcagcctatatcagcttttgacatgcctacctaactaagtttaatcacttctagcttttgatttagtcagaggagtgcctctttttacttgtatacttaaaggccattgtaggtttattaactggccaaatttccctagtgtcttatggaatagagaggcctgggggtgaagggaaagagagagagaagagggggagggggagagggaagagtggggagagaggagaggggagagagactggggaacagtggatccgtggagcagttagaacatacatgacatttattgaataagttcactgtcttatatggttgataataagttcactgtcttatatggtgcccctaaacaatcttaatagtaacatcaaagatcactgatcacagatcaccaaaacagacatcataataatgaaaaagtttgaaatattgtgagaattactaaaatgtgacagtgtattagtgcgttttcatgctgctgataaagacatctctgagcctgggtaatttataaagaaaaagaggtttaatggactcacagctccatgttgctggggaggcctcacaatcatgatggaaggcgaaaggcatatcttacttacatggtggcaggcaagagagaatgagagccaagctaaaggggaaactccttataaaaccatcagatctcgtgagacttactcactaccacgagaacagtatgggggaaaccgcccccatgattcaattatttcccacagggtccttcccacaacacatgagaattattggagctacaactcaagatgagatttgggtggggacacaattaaaccatatcacagagccacagtgagtacatgctattgggaaaatggtgccaatcgacttgcttgactcagggttgccacaaaccttcaatttgtaaaaaatgtaatatctgtgaagtacaataaagcaagcgcaataaataagttatgcctgtactaataattaattggattataatagtcatgtacttataaaatttatgcctatatgcatataatcttactagcaggcagattttcttaccaacaataaaacaatggtaattggttctattaataacctttcattatttttccttatttgtaaattcttagtggatagccactttaattgtattttgctgttttgattctttgttttgataattacataagaattacatattgttatataattacatattacattgtacattataactatataatactattatataacaattatatgttatatacacacatatagccataacatatatgtaatatatataattatgtaacaatgtataattatataatcgtatttaatgaaccattctttctcattttcagttagaacaacacatgctacagaaccactagttttccagatagctcttacaattttctgctagtttttaatctaataatattacctatctgcatttctcagtctatcatgtaactactggaggagcaagtaaactgctcactgtttagtatgaaccactgcattatttcacattaatacagttatccaggataatcaaagtagaaaaagtatacttactcagttataaattcagggtttgtaaagctgaggttggttaaatgaccttcaagttgagaagactcatgcatatttaaggctggagtggtcttagtggcaagtacagctcttttttcatctttctcaagtgcttttctcttcccaccattttggaaatattctctgcatacactacaagtaaaaataaagttgtattttaacatactgtgtacgactacaaaataagacggaaaaaattggcttttattaatcaagatgggaaactttcaaatttaagatttctgctttgaaaatgtcaaactgagataaatttgagcaccttgtagcactttcaaatttttaaaaattactatacaataaagaatgatcacaaattatgtttagtaaataaaaaatatgttttttcaggattacagatgtgtttgtatatactttactgaacttctctcgactaaaacttctccagcaaagcttacataactctactatgcagtgacaacatccagaaggaatagtagttgcagttaattttgagctggctttactagtagtagacagataacccaacagctgttcttgaggtccctctgggtttatgataacaaagtcagggtgagtgtgcgtgcacgcgcgcacgcgcgtgtgtgtgtttgtatgtatgtgtatatatatgtgtatatatgtatatatggagagcgagcgagctcatttttcttcttatttgcacttaatttactacatatagctcatactttacacaaagctattttatcattctccacagacattgcttggtgaagttccaaaaatacatggcaagagaagaattgaagagcaaagaattcatgcaaaactggtttcagcaagtacaactatggtccaagggaactatgcccatttctccttcatgcttacaggatcccattagttcaacttcagtttttcttagttcctattactaagacttctttaacttatactatgtagatttagttttaactctatacgcagaagttgaaacttattcagcatgaattaaacatttattaagtacgcatcatgtgtagaggtgcataatgatggccaaattgcagaaggcatagttgttaccctcaagaagctactgttacctcagtaaaggacacaaataattactatatataacaataaaaaacatgattgataaacagataaacaaagatagttatttctataaataaagtacctaacccaatctaaaatcagcaatataaatggattttagaaagataagtaggaataaaccaggaaagtaaagtagagtggaaactttctaggcagaaaggacagcataagcaaagacatgaaagagaaaagcagaatgagtcttcagagatgtacctcagttcaagatacatgaagtttaaagtactgggcagaagatgagtggacctattcacaaatgaaaaaaccctgagcctagtgcacacataaagaggaaggagagccaaggtatgcaagcttcaaatcacacaagatccacaggccaattttaaaatgcagtctttacaaatctaatctaatgacagagagcagtttagaggttgcctgggatagggtgtggggacgagtgcaaaggggtacaagggagctttctggagaaaaatgttctatatcttgatagtggtggtggttacataagtgtaaacaactgtaaatacccactaactgtacactagatgggtgcattttattgtatataaattatacctcagtaaagctgataaaaatgtagactttatcaacttgaaattaatactaaaaagcttgcttatgtttctatcaggtagaaccatataaaactggtgatattcaaaagttcttgagctacaaaaattgcaattttatgtggtctaacctaacagctactaaggcagtaaaatacttaaagggctaaaattctaggttctcatagaataatgacaatcatctaaattccaatatccccatataccctcaaaaaacatacagatcaataaagagagcaaataaaagcacttaccatttatacctatggcataacaaggaaataaaaaataacacttcattttacttgttattgaaaaaataaaaatctgaaaccgagttggctttggaggccactcaaagtacagagtcagatgacgactgcataaaagagagaaatgtatgaaaaggtggccaaacagaatcttccagcaatcaccccctagacctgcaagaatatcaaattgagtaactatccatgcaaaaaagcaccttcataagaactaagtcagttaagagatcacagttcctacaagaaaagatgcattgaagatgataggaactccatagacagtcttgaactgtctataccatcctctcccaagccccggcagtacaccccagagagataatctttgtgctttgcagagggagtgtgaaataactacgggactttgcactggaactccatgttgccctgtcacagtggaacacagcactgggcagaaatctactggtgcccacagggggcatttagaccatccttgaacagacagaaagaagtctgctgccctagtgggaggaatcttagtcctagtctgctttgctactggctgaataaagtggccctgggctcccaataaatgtcagtggcagccagaccatggcaactgtagtctttgggtgagccccagtgctgtgctggtctcagcagaggctgtgagcccagggtactacaaccaagtgtgacaccagctgtggtggccatgggaatgcctccatcacccctcccctcattctaggcagtacagtgtagagacttcttccacttggggcaaggagaggaagagtataggagactttgccttgcaacccaggtaccagcccagccacagtaaaacaaagcaccaggcagaatcctaaagcccctgattccaggctgttgttcccacatggcacttctagacccaccctgggacagaagggaatcctctgccctggggggatggaccccaagtccctgcaggattcattacctgctgactaaagtggccttggaccttcagtaaacatcaatgacagttcaaatatgacccagcatgaggccagctgtggtggccacaagagtgtctgtgtcacttcttccccaactctggtcagaccagcataaacagacactcattccacctgggggaagaagagggattttgcctgggaacccagcaacttctcccttatcttcaagtccattagggctgggaattcagcaatctgcagaagttgcagtgtacctgggcttagagtgccctctagtgctgaaatggttacagtgaccacaggcttaggtaatactttagataaactctgaatgcttagaaggccctctgaaaaaggatggatactaacaagtccagattacaaagactggaataaatatctaactcttctatgcccagacactgaaaaacatccacaagcatcaagaacagtcaggaaaatgtgacctcaccaaacagactaaatgaggcaccagtgaccaatcctggagtagtacagatatatgacttctcagggaattccaaatagctttttgaggaatctcaatgaacttcaaaaaaacagagaaggaattcataaatctttcagggaaatttaacaaagagattaaaataatttaaagaatccaacaaaaatcctggagctgaaatattcaattaatgaacaaaaatatgtattactatctaaacagaattgatcaagcagaagaaagaattagcttaaagacaggctatttcaaaatacagaatcaggggagaaaaagaaaaaaggagtgaaaaagaaagaagaatgcttacaagtctggaaaatagcctcaaaagggcaaatctaagagttattggccttaaagaggaagtacagagactggggtagaacgtttattcaaaggaataataacagttttccaaacctagagaaagatacaaatatgcagttataagatcaaagaacaccaagcagcttcaccccaaataagactaccttcaaggcataaaatcaaactcttataggttaaggacaaagaaagaatcctaaaagcagtaagagaaaagaaacaggtaacaaatgaaggaactccaatacatctggcagcacacttctcagtggaaaccttacaggccaagagggaatgagatgacatattcaatgtgctgaaggaaaaaaaaaaaaaaaggaaacaactttcaactgagaatactgtaccccgcaaagctattcttcaaacacaaaggagaaatatgtagataaacaaagatgaaggacttcacaccagacctaccttaccagaaatgctaaagagaatttttcaacttgaaagaaaaggatgctaacacacaataagaaatcatctgaaagtataatataaaactcactggtaaaggtacatacatagttaaattcagaatactctaaaactgtaattgtagtgcataaactattcatatattcagaggaaaaaacccaatgggataaatttattatatctgtacatatatatatatataaacagatatctaagaagagatttgtaataaggaattggcttatgtgattatgcagactgaaatgtcccacaatctgctatgcctaagctgtaaaaccaggaaagctccaatccaagtccaaaggcttgagaactattttataagttctggtccaagtacaaaaaggcttgagaaccattttataagttgtagtctaagttcaaaggcctaagaaccagaagtgtcaatggtgtaggttccagctagatggaaggcctcaaaagaggcctactcacccacaatagagagggcaatctgctttactcagtctacagattcaaatatcaatctcatttggaaacaccctcgcagacacacccagaaataatgttcggccaaatatctgcgtaccttttgaatcagtaaagttgtgaataatattccataatacctaaaattaacataggcaacacaatattgacagaaaaacaaactgaaggactactaccaacttcaagacttactataaagctacagtaatcaagacagtgtggtaatggtgaaagaaaagacaaatacatcaatggaacacaatagagagtgcaaaaatatacctacaaaaatatggtcaacagatctttgaaaaaggagcaaaggcaatacaatggagaaaaaagaaaattttttcaacaagtcatgctagaactagacatccacatgcaaaaaaagaaaaaaagtaaatctagatatagaccttacacctttgacaaaaattatcttgaaatgcatcataaatgcaaaatgcaaaactataaactgtctaaaaggtaacataggagaaaacctagatggcattgggtatggtgatgactttttagacatgacaccaaaggcatgatctgtaaaagaaaaaattgataagctgaacgtcactaaattaaaattttttgctttgtgaaagacattgtcaagagaatgaaaagaaaagccacagacactgagaaaatatttgcaaatcatacatatcaggggtccccaacccccagtactggtccgtgacctgttaggaactgggctgcacagcaggaggtaagtggcaggtgagtgagtgaagcttcgtctgtatttacagctgttccccattgctcgcattactgcctaagctttgcaccttgtcagatcagtgacagcactagattctcatagaagcacgaacccttattgtgaaatgtgcatgtgagggatctaggctgcacgctccttatgagaatctaaagcctgatgatctgtcactgtatcccatataacccccagatgggactggctaattgcaggaaaacaagctcagggctctcactgattctacattatgatgagttgtacaattatttcattatatattacaatgtactaataatagaaataaagtgcacaataaatgtaatgcacttgaatcaccccgaaaccacctgcttccactccagtcaatggaaaaattgtcttccacaaaaccagtccctagtgccaaaaaagttgaggactgctgacatatacaatgaagaactgttatctaaaatatagaaagaactcttaaaactctgtaagaatgcaaataaatttaaaaaccaggtaaaagacctgaacagacatctcatcaaagaagatacacagagtggaagcaacaagaatgcttatcaagtgctgatgagaatgcaaaatgttacactttttacagcagctttattcataattatcaaaacttggaagcaaccaagatacccttccataggtggatggataaactgtgatacatctagacaacagagtattattcagcagtataaagaaatgagatatcaagccataaaaagacacagaagaaccttaaatgctaattactaagtaaaagaagccaatcagaaaaagctacaaactttataattccaactatatgacattctggaaaaggcaatctatgaagtcagtaaaaaaggtggtggttgcaggccgggcgtggtggctcatgcctgtaatcccagcactttgggaggccgaggtgggtggatcacctgaggtcaggagtttgagaccagcctgacctacatggagaaatccgtgtctactaaatatacaaaattagccaggcatggtggcgcatgcctgtaatcccagctacttgggaggctgaggcaggaaaattgcttgaaccgggaggcggaggctgcagtggacggaggttgcggtgagctgagatcgcggcattgcactccagcctgggcaacaagagcaaaactccgtctcaaaaaaaaaaaacaaaaaaaaacaaaaaaaaacaaaaaaaaaaaccaaaaaagttggtggttgcagatgggtgaaaaggccggcacaaaggatttttagggcagttaaactattctgtataatactataatggaggatacatgtcattatacatttttcaaaaaccatagaatgtacaacatcaagaatgaaccctatggtaaactatggactttgggtgataatgatctatcagtataagtttaacaactctaacaaatgtaccactctagtgctggatgttgacagtgggggaggctatgcatgtttgggatggagtggttgtatatgggaactttctgtactttctggtcaattttattgtgggtttctggtcaattgtgttgtaaacccactgctctaaaaaataaagtctacttaaaagagaaaacaaaccaaccttgggataaatatatcatgtatctcctgatgtattaaactgagagggacacaacatcacctatgcaaaactcttgctaacaatacacttaacttatatctaatcacaaataaactacacatatccaaattgagaggcaatctataaaatgttgacttttaaaaaatggccgcataggccaggcacagtggctcatgcctgtaatcccagcactttgggaggccgaggcaggcagatcacctgaggtcaggagttcaagacccgcctgaccaacatagtaaaaccccgcctcttctaaaatataaaaattagctgggtgtagtggcaggtgcctgtaatcccagctactcgggaggctgaggcaggagaattgcttaaccctggaagtggaggctgcagtgagcccagatcgtatcactgcactccagcctgggtaacaacagcgaaactgtctcaaaacaaaaaaaaaaagtcgtatcataaaaagacaaaaaagaaaagaaaaaaatgatgaatttttctagattaaagaccaaaaaggcttcacaactaagtgcaatgagttatccctgatgggatcctggattgaaaaaaaaaaaaatacaggtataaaggacactattgtgaaaattggggaaatttgattatggattacattattagttagcatcacattaatgctaaatttctggagtgtgatagttgtattatgattacgtagaagaatgttcttacatgatacacactgaagtattcaggaataaaagtctggtaatttctgtaactgactctcaaaaggttcagcagagagcaagagagaaaaaggacccagaggagaaagaggaacaagatacaaaagtaagactaagtagagtaacattttttcagaagctgaaggaaagaaagtgtgagtcaaggattttctatccatccaaactacgtatcttgtaacaaaattatacaaaaccagtttgtaagatgggtgaactcagagaacatcataattccaagttgtttttaaaaaatctactggaagataaacttcatctatgagatgattaagaaatgttggtgaagaagtagggaataaaaagcattaaatcacttaaaaaaaaaagcgggtactttaaaatgctaaaggcattcaattcacttcaattcccagtgaagatataactattataaatagttatgtatcacttatcatagcagccatctttacaaagaagaaattccatgagatgtatggagaaacagacaaacaccaacaacagggactttccactttcaatcaagagaatgaaaaggttacagaagccctaaaaaacataataaagtttaccttattgctagaagatgaactctgcattcagagagaatagcttctttttaattatacatggaatagtcacaaaaattaccatatatgtgtattaagtcatgaagaaaaccatagtaaaaaccataatgaaaaaatacagacaaaattatacaattgcaatgcaataaaatgagaattaaccaaaaacaagaaatccattctatctgctattttttaaaaaagtaaaaaagtaaataacttgggtcagagggcaaatactaataaaatcacagaatatctaaaaataattaatgaaagcattacaagtcagaagctaaggaatgcaactaaaatagcaatctgatgaaaactgagatgctttaatgcttatatcaatacaaacaaaagaagaaaatcaaatgaaataaacatggaactcaagggattagaaaatgaagcaaaagaaaggaagagtgccaacaaatacacaaaaacttgtgcaacttttttctagaaaaatacaccaaatatatagaatagaaaaatttcttaaacttgactcggtagaaataaaaagtttaaacaaaacaaaaatccaaagatgaaatagttatcagagttaatcttaccaaaaagcaccagtacaagccttcaaaaaccagataacccctgtattaatcatgttttttactttatctttcatattttgatattttgggaggggtgttggagggtgtgcttatacatccagagagagactgcccctctcaggaccagctaattccttaaggtggtaaacttacttgggaaaacatttctcatatgcaagccaaccgctatctaacttttacacatagaccattaattccccactactaaatcaactcaagaccatataccagacaacaacggacagcctctagtccccaaagcctactgaaattattcaacctagccaatcctaaaccgtttactctgccctgccttggcttttccataaaaaggtcaataacagctctggtctaggatttcctttagctcctgcttctgactcctgacaaaatctggtgcttcctttatagccctgcatggtgcagtatgtccccttctctcaggaaatataagtaataaataattatttcaatggcattgatcactccatgttttccctcagtcacctctataaattaaaattccactgatacatgtgagacaaccccaaaagtacttaaactgttccaaaccatagaaacaaaaacatttttccaaattcattttcagggagcaaaattacaataatacttatctgatctcataaagactacaaaaataaaggccaatatcacttataaatatgaataaaaatatgaaattaaattttaacaaacagaattaaatatgaccaagtgatatgtatttcaggaatgcaaggatggttcagcataagaaaatccactaatataattcactatattcataaatctaagaagaaaacacatttattcttctccatagatgttgaaaggtcattcaacaaaattcaaacccattcctaatataaacactcaataaaatacaagttggcaaacacttccttaatattagaaatatatatatatacacacatcagccaaaaagccagcaacttaatgaaaatacaccacatacattactgcaaaatgaataaagcacagctacgtaatagacaagagaaaaagatttagtcaaatgaataagagaggaagaaataaaactttgtgtatttatagatgacataacagatacaccttgacaacccaagagaatcaatcataaactcatataaacagaaagaaaattcattaaaatggtaggatgtaaaacattaaaaaatgaaaatcatccatatatatatgtacacacacaacaatatcctgttagaatatagtcatgtgttgcttaacaatggggatatgtcccaagaagtgcatcattaaggtgacttcattattgtgaaatcacccaagtatacttaaatctagatggtatagcctactacacatctacagcatgttaccatactgaatactgtaggccactgtaacacaattgttaagtatttgtgtatctaaacatagaaaaggtatagtaaaagtacaatattataatcttatgggactaccattgtatgtagtccatatatttccactgttgatggagatgtcattatgcagtgcatagctgtataaacagaagggaaggggacatttacaacagcaataaaaatgacaaaatacctaggagtaagcacaacaagaaatgtgcataatcactatacagaaaaccttaaaacactactttgcaaagtagtctgctacttttgactaaagtagactagaacaaatggaaagacatatcttttttttttttttgagacagagtcttgctctgtcaccaggctggagtgcagtggtgcgatcttggctcactgcaacctcctccgcctcctgggttcaagtgattctcctgcctcagcctcccaagtagctgggactacaggtgcacaccaccatgcccagctaatttttgtatttttagtagggacagggattcaccatgttggccaggatggtctcaatcccttgaccttgtgatctgcccacctcggcctcccaaagtgctgggattataggcatgagccaccatgcccggccgacgtatctttttaatggataggatgactcaacattattgagatatctgttgttcccaatttatgaaaaattaatgtaatctcaataaaagtaatttttaaaatgtagttggaccagttgatcctaaagtacatgtggaaaaaagcaaaagcaagaaaaaccaagaaaaccctgaaaaagaatagtgtgagatgggggtatggagagaagacactacagaacagcattgtaagtctttatgattaaaatagtgatagtaggcatggatcaatgatatacacaatggaatatgacagaaaagctaaaacaaaaccaactatatgggaaaacttagtacatcatgtaagtgtcatatcaaattactgaagaaaaggtaaagtttttaataaatgttggggaaatggataactttggtagaaaaaaaattagatcaatacttcacaagaaagaccaaatttgacttttaaacaggtcagagatttaatgtaataaatgagaaatcccctaagtactagaagaaaacacgagtgaataacaaattgttatttgaattcctacagtctggtaattaggaaagcttttctaagacaataaaaatctggaagcaataaaacagaagactgatacatctaactacacaaaagcaaaaactttctgtatggcaaaagatatagtcaaagacaaagggcacaaatatttataaatgatataaagagctccaaaaaaatcaagaaaaattagagaccaaaagtcaacagaaaaaaaaaactatcaaaaacatgatcacataattcacaggaaaaaaaggcaaatgactcctaaatatataaaaaggtactttacctcattcataagagaaatgtaaaataaactcaagctagagataccaattccaatctatcggagaaaaattcaatagctgagccacatactatgttggtgaagttatagagaaatgggtattcttacttacttatttatttatttatttatttatttatttatttgctggtgaaactgcaaaatgatataacctctacacagggcaatttggcagcacatctaataaaatcacatatgcatttaatctccattcctgcaattccacacctaggaatctacaaatatacaatgacaaaaatacaaaatgcacacacacaaggttattcattacagcactatttgtagtagcaaaagcttgtaaacaagtcatgaaaatgaggaatatatctgtatacctgtgatggttaattttaggtatcaattgtcaaacattatcttaggtgtttctttgagggtgtttttggatgatattaacatttacattggtagactaaataaagcagactgcctttccttaatgtgagtgggcctcattcagtcagttgatgcctgaatagaacaaaaaagctgactctctcatgaataattaaagagaattcctcctgcctgactgcctttgaactgggacaccagctttttcctgccttcagactcgaagtgggtctagaggctgctggcctttagactggatctataccttcagcactcatggattgccaccttgcccactcaccttgcagatcttaggagttgtcaaactcgataatcatatgcattaattctttataacaaatcttactatacacacaaacagacacatcctattgcttctgtttctctgaagactcctgaccaataccaaatacagtaattctcatattaagtaaaaaagaaaggtacagagtatataacagtatacaacacactaccacctacagggataagaaagggtggatatatgtacatatgcatatgtacatggatatgaatttgtttatttttgcaaaaacaaacactggtaggataaaaacaaaacaaatgaaaatggttacccataggaggtgttacccggtgtaatgcctatatgacagttgaattctgatcctgccccaactctgcttacctttaagaaacaggatacctgtaataaaaagttccctttgaaataacgagaccgggtgagactggttagaaccaagatagctgacataatgaaaagacctcacgtttcattataatctcatttccatgctaaatgaaatggtactcccaccagttccatgacagttggcaaatgaccgtaacaactgcaagaagccataaaaggacaaaaaggatggtggcactccagttctagaaagttcactgcccatttctagaaaagacatgaatattaatcctcttgcttttaatgtccaatgccttcattagaaaaccctatattttaaccccccagcctatcactagtggagaagttgaattatgagccatgctcctgcttctcaattccatggccatcaaataaagcctgcactgcttgatactcacttctggttttgtgtactggttttgtgacaatgaacagggaaagaccccatcttttgggaaaccagctttgttggtaacagaggcaggtgtaaatgaagaaaataaaagggagtcttttttgagtatatctttttataaggtttgacttttgaaccatgtaaatgttttatattctccaaaattaaaataacaataaaaaacgccccaaactgaaaattaagtgaaatcaactgtatagcaaattggtattacaaccatacagaaaataactgtttcaagcaacttttaagcatatattctgatccttggtgggatatgttctaaagacaaaagaactgcaaagaaatcttacatttcagttattttatttttagaaaatcagtattgcaatttttaaatcattttatgtaaattgtaggaaaaggctaatgtattaatgtaattcagaaccaagtccttcggtgtaacagaagagaaataaaaaacagataagttaagcaaaaataaatataaatataaaacaaagttgttaagcaaaaatcttataatattaaactggagtggaaaatatcaattaggaatttgattgaatatttatatataacactatataatattatattatatatttttctaattctctttaccaaaaagatgcagaataaagcacaccctgtgcacatctagtatccacatgttacttttcaaatgccatttcccactaaatgaaactaggactccctgaagaaacagtctgatgccaggtctcgacgaggggaagcaaagactcatctttgtactacagagcaagaaagtgctcacaggtgacgtaaaacacagaagtaaactttgactgggctcctgctgcctaatatgaaattatttgaacaccccaccccccaaaaaaagactaataatgaaaaatggaataaataaaaatccaagatgttactgtgacagtccaaaaaaataaaccccacaaccccgttgtcctaactgtaattgactattataccaattgctttcgtgaaaattggtaattaaacagaattacatattttttaatctgattttctggataacatgtaatcatcattcaccatttataaaggaaaattcttttatttacaaaagaatgccagctaataaatgtcaagaaataatacaattttaaaaataattgttttgtaaccccaaatattatttaataaatggaagtaaaactgtttgttgaaagactgttaggaaagaggattgatccacaagccaaaatatcactgtacatattacttaattataaagggataacataagtttacaatggaaagattgagtagataccaccttaaccaaatgataacatttagtatctctaatggcggtacacctcacaacaaaaacctactaatatgacacaaaatgatgtatgaagcttcatctaatagatatttttgcaaaaatatctgacctgaatcaatcctttagacccaactttcagtttacaggaaataaatgagattgaggaaataaataattggtaccatgagaaaacaatcagataatcctgcatgtagaacacaaaactagtttggaattaggatacagattatcagaacagctcatatgatacaatttaaaaaacaacgtattaaaaagaaatcatgagagatgagaatgcaaaggggtctaaaggaaataaattacagacaagcacaagtccttccaaaatgagaagggatcacaggcactggggaatttgctgaaatggtacctgggctgcagagaatcaagccttccagggtagaaatactctgctggattaaagggaaatggcagagcttttaacaactgcttggctgtgtgacagattgatatctttaagaaactcaaatgtagagataattctccccattctcctcctgattccctccacaggtctatttatgagtatgtgaaggcagcaacagcactggtggctgcgagtggaactaaaaagcagaaaaacattaggcttatgtcctgcaagagagttgcacctgtaatactcacagaacaggattcattcactatcaaagcacttgagaccagaagtgaattgaaaccacctaaagaggtcatccagctccaatacagctcaactcctgatggtatcaaagtgttcagtctttcattctagctgcctttcagagcaaaaaaagcatgtctctctggagaaaaagggtatttatgccaatctcttctaaacacaatgccagtataaaaacagaattatcacacataaagcaggaaaaaatgacccataaccaaaagaaaaaatagccaaaagaaacagacccacagataagacatgttagaataagcagacaaaaactttaaaataactattttaaatttatttttttaaaatagagaaaaagacaacccaaatggacaaaaacagagaacttcaacagaaaaattaaatctctaaaaagccaagtaactattatagaaaaactgggaaaaatggtatcttaaaaacatctttactggttaatgatagataaaaaagccaagaaagaaaaatcagtaaagatatatagaatacttgaacaacactattaaccagcttgaaccaacaattgcaaaatgcagaatgtgggatattctacaaattaactgacatttgtctaaaaactcaatgttatgaaacaaacaaacaaaaaaaccaagaacctaaagaattgtaaccaccaaatgcaatgtatgagacttgattggatttagaaaaaaatacatatatatataaattttaaaatatattttgaagacagaaaaatctgaacttatgaactaagtattttagaaaattagattactgttaactgtcttaatatgatgacggtgttgtggttatgtagaaaaatttcctaattcttaggagatgtgtgctaatagatttagggataaaatgtaatgttatctgtaatttaccttcaaatagttcaggaaatagtgtgtttatagtatatatttctctgtatttaaagagctaaaaaaggcaaattcctttattgaaggtatagctatacctgtatattgcatttttttctctggcttttaatgattcatattacatataaaattttattattctgtccttggcaggataatgtcagtaaggcttacctcatataacatattcccataagttttaagtataacaagaagcaaacttttgtccaaccctttttaaagcccactttagctttcaaactgacatgcttttagaattatcaaaaagagaaaaaaactgcatatagctcataattatatataactcaagtttcaaaacacaatattgtttcaaagtcttttccccaaacctagttttatgtttaaagatgttacataacttctcttagtattacttctgatagtaaaaaaaaaaataaagaaatttaaccatatcttgccactgttctttttttaacagtatgacctaaattcctaatgatttttcatcagtttacataaaaaatgacctcatgtgataatataacgattgataaaacaaaaatccaaggaaaaaggaagaagactgaagtttgaggcagattcattgttcaagtagaaggtgaaagcaattgctccaataagaatactacctatcaaagttcatttaagagatacagtttgagggcctgcctgctgtactgtaatagtaatttaaaagcactacgctaaaatccaacaatgatggtcttaaacagcaatagtactgatttcctgactttctgttacaggggaactatttggttcagtagtatgcctcattttgtgtttcttaacttgagggagaaaatgtatattctgtaaaacagtcagatttataaccatcttctctctagaaatgcaaataaaaacatttaaccccaaccatcccatctcctattattttggcacctttctttagttccttaactccattattctttgactccacaatccactgatggtaccactttctaactataccttatattttcaattcccttacatatcataatcactaaaatgtgtgccccatcacctccctggctcctctgagtcattacacttatttgagcattaatcctagtacactgtcctgtcaactcactatctcattcaccaactgtttaactataatttcgtgccatgattattgaagtagttttctaactgggttcccttactgacacccttgcccttcctatagtctgttcttaacacagaaattaattcttaagaattcttgacatcttgcaaaaggttaataaaatcctgtcacttcttttgtcaaaacagccatatgacttcccatgtcagagtaaaaatcaatgtcttaaaatggcccacaagaccctacaaaatctagctgttcattgccttattttctacctctctccctctgtcattttgctctggccacactggtctcctggctgtttctgaaacatgccagcatgcctcttcttcaaggtcttcagacttggtagggctggcttactgtctcatttcctttatatcattggcacacatcacaacagtgaaaccctcttcccctaccttacttaaaattgttttagttttccttgctttatttttctcatggtgctcaccactgtctgcactagtgtaaatttaaccaacatattgtttccggccactcaccccaactagcacgtaagctctatgagagcaaggattttgtgagttttattgtactcctagtgcctataatatgactggtacaaagtagacaatcactaaatattatttattaaataaaagaactaagttaaatacatatttttctctgaattatttgttgaatgaatgaaatatgcattattacagttttaaaatgagatgtaaaaatttttgaataaaaatggaaagaaaatgtaaaccagaagttatcataaacttactgtccatgagaaagacaatgctttatttttgggaattcatgtttatttatttagcctctagttttttttttttttttttggtccagggttacttttgcaggtttgttatataggtaaattgcacgtcacaggggtttggtatatagattatttcaccaccggggcaataagcatagtacccaatcgggagtttttcagggaattcatgtttaagtttagtcaatatacttatcctttcttataattttaccacattaagagaactagtataagcattatttcattttctgatatttttagcattagaatcaatatcatgagaaaataaacattatccaaagtcaatataaatgctggaataccctgaaccgtacatcaaaaattcaagatttaaaaaattttaagatgttttaagactttatagaactcacttttacttgaatctaaataattatctaaagaaatttttataccataatttattaatgagtcaagtattaaatcattatatttaaatgtattgtatgtattaaatgcatttaaagccatattttttaaaagttaaaacaaaacaagtgtgtcaaaagcatttttatttaaaaaggtgaatgaaacagacctagggaaagtgaagcaaaagggagaaaagttgttttaaaagacatgatctctttcacagtatttctggtattctattttggcactatgaattatacacagcatcacttagatttaagagttttggccaggtgcggtggctcacgtctgtaatccaagcactttgggaggctgaggcgggcaggtcacgaggtcaggagtttgagaccagcctggccaagatggtgaaaccccatctctactaaaaatacaaaaatagctgggcacagtggtgggtgcctataatcccagctacttgggaggctgaggcagaagaactgattgaacccgggaggtggaggttgcagtgagccgagatcacgccatgcactccagcctgggtgacagagcaagactccgtctcaggaaaaaaaaaaaagaagttacaacaatacatttgaaaccaaaaacgttaattcataaaagtacttacctacaacaccattcaatacgaccttcgccctcacaagtttttgcccaatgattatctgccaaatttttcattgcaacggcatattcacaaagagtttcttcatcctcacagtgttctcgccagatcttatcaaaatctcccactaaaaacaaagtgataaatgaattaagtttacactgaaacatgtcagactcttgaaataagttttagcacaatctgaaattatttaaagataaatacaagcaaaattataaagtaaaaccataaaattttaaacatttaaaatgtttaaataaatgtttacacatttaaataaatacatttaaataaaaataaaaatgtttaaataaaagttcctttatgtaaagggatgcatcattttaattatttttaataaataaatgaatgataacagatttgtgaagctggaaaaattgacaacatatacgcagatactgtatatatgagttatcagttaataatccaaagacatgctggtaagaaacaattacagctgagtactcaagaattaattttcctgttactgttgggcaatataactttgcaggagctgagtacaaacactaaacctgcttcttgactgttattttcttgtgtctctattgactgttatcttcttgtatttctacatttattaaaaaggggttggtaggtaagatgacaatgtaaattaagcaatgaagtaaatatttctatttacacacttggacttgctctaggcataatgtagtttaaaaatttataattctaggtcaaaaaagtcaaaaactgccttgaaggaaattactttggaagcctctccaaagtttgtaagccttaaaaaatgtcctatataaaaactataagctgactacattatccattcagctactaccttttatttaaataaaattaaatcagtcatcacaatatgaaattgaaaacatcactgtgatgactaataaaggtaggagaatgctattgctaaataaaggacattaatgcaactgtaatggtaatagagtaaacaaaatttacagggtagtttcattcactgtccttggacataggagttaggttcttacaccccataaggaaatgtaggccattaattggggacagaataaacttaaaactataaatagagggggttggagccaagatggccgaacaggaacagctccggtctacagctcccagcgtgactgaagcagaagacaggtgatttctgcatttccatctgaggtaccgggttcatctcactggggagtgccagacagtgggtgcaggacggtgggtgcagtgcaccgtgtgggagccgaagtggggcgaggcactgcctcacttgggaagcgcaaggggtcagggagttccctttcctagtcaaagaaaggggtgacggatggcacctggaaaatcgggtcactcccaccctaatactgcgcttttccgacgggcttgggaaacggcgcaacaggagattatatcccacacctgactcggagggtcctacgcccacagagtctcgctgattgctagcacagcagtctgagatcaaactgcaaggcggcagcgagactgggggaggggcgcccgccattgcccaggcttgcttaggtaaacaaagcagcagggaagctcgaactgggtggagcccaccacagctcaaggaggcctgcctgcctgcctctgtaggctccacctctgggggcagggcacagacaaacaaaaagacagcagtaacctctgcagacttaaatgtccctgtctgacggctttgaagaagagagcagtggttctcccagcacgcagctggagatctgagaacaggcagactgcctcctcaagtgggtccctgacccctgacccccgagcagcctacctgggaggcaccccccagtaggggcagactgacacctcacacggccgggtactcctctgagacaaaacttccagaggaacgatcagacagcagcattcgcggttcacgaaaatctgctggtctgcagccaccgctgctccaggcaaacagggtctggagtggacctctggcaaactccaacagacctgcagctgagggtcctgtctgttagaaagaaaactaacaaacagaaaggacatccacaccaaaaacccatctgtacatcaccatcatcacagaccaaaagtagataaaaccacaaagatggggaaaaaacagagcagaaaaactggaaactctaaaaagcagagcgcctctcctcctccaaaggaatgcagttcctcaccagcaacggaataaagcttggcagagaatgactttgacaagctgagagaagaaggcttcagacgatcaaactactccgagctaaaggagaaaattcaaaccaaaggcaaagaagttaaaaactttgaaaaaaatttagacaaatgtataactagaataaccaatacagagaagtgcttaaaggagctgatggagctgaaagccaaggctcgagaactacgtgaagaatgcagaagcctcaggagctgatgcgatcaactggaagaaagggtatcagtgatggaagatgaaatgaatgaaatgaagcgagaagggaagtttagagaaaaaagaataaaaagaaatgaacaaagcctccaagaaatatgagactatgtgaaaagaccaaatctatgtctgattggtgtacctgaaagtgatggggagaatggaaccaagttggaaaacactctgcaggatatatccaggagaacttccccaatctagcaaggcaggccaacgttcagattcaggaaatacagagaacgccacaaagatactcctaaagaagagcaactccaagacacatagttgtcagattcgccaaagttgaaatgaaggaaaaaatgttaaaggcagccagagagaaaggtcgggttacccacaaagggaagcccatcagactaacagcggatctctcggcagaaactctacaagccagaagagagtgggggcctatattcaacattcttaaagaaaagaattttcaacccagaatttcatatgcagccaaactaagcttcataagtgaaggagaaataaaatactttacagacaagcaaatgctgagagattttgtcaccatcaggcctgccctaaaagagctcctgaaggaagcactaaacatggaaaggaacaaccactaccagccactgcaaaatcatgccaaattgtaaagaccctcaaggctaggaagaaactgcatcaactaacgagcaaaataaccagctaacatcataatgacgggatcaaattcacacataacaatatcaactttaaatgtaaatggactaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaactaaaaaaggcagcaggtgcaatcctagtctctgataaaacagactttaaaccaacaaagatcaaaagagacaaagaaggccattacataatggtaaagggatgaattcaacaagaagagctaactgtcctaaatgtatatgcacccaagacaggagcacccagattcataaagcaagtcctgagtgacctacaaagagacttagactcccacacaataataatgggagactttaacaccccactgtcaacattaaacagatcaacgagacagaaagttaacaaaggtatccaggaactgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattacaacaaactgtctctcagagcacagtgcaatcaaactagaactcaggattaagaaactcactcaaaaccactcaactacatggaaactgaacaacctgctcctgaatgactactgggtacataatgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagatccaaaattgacaccctaacatcacaattaaaagaactagaaaagctagagcaaacacattcaaaagctagcagaaggcaagaaataactaaaatcagagcagaactgaagaaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgataaaggggatatcaccaccgatcccacagaaatacaaactaccatgagagaatactacaaacacctctacgcaaataaactagaaaatctagaagaaatggataaattcctggacacatacaccctcccaagactaaaccaggaagaagttgaaactccaaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcatcctgataccaaagactggcagagacacaaccaaaaaagagaattttagaccaatatccttgatgaacattgatgcaaaaatcctcaataaaatactggcaaactgaatccagcagtgcatcaaaaagcttatccgccatgatcaagtgggcttcatccctgggatgcaaggctggttcaatacacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcttattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataagcaacttccgcaaagtctcaggatacaaaatcaatgtacaaaaatcacaagcattcttatacaccaataacagacaaacagccaaatcatgagtgaactcccattcacaattgcttcaaagagaataaaatacctaggaatccaacttacaagggacatgaaggacctcttcaaggagaactacaaaccactgctcaaggaaataaaagaggatacaaacaaatggaagaacattccatgctcatggataggaagaatcaatatggtgaaaatggccatattgcccaaggtaatttatagattcaatgccatccccatcaagctaccaatgacttccttcacagaattggaaaaaactactttaaagttcatatggaaccaaaaaagagcccgcatcaccaagtcaaccctaagccaaaagaacaaagctggaggcatcacgctacctgacttcaaactatactacaaggctacagtaaccaaaacagcatggtaatggtaccaaaacagagatatagatcaatggaacagaacagacgcctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctaaaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatggaagaaaattttcgcaacctactcatctgacaaagggctaatatccagaatctacaatgaactcaaacaaatttacaagaaaaaaacaaacaaccccatcaacaaggacattaacagacacttctcaaaagaagacatttatgcagccaaaaaacacatgaaaaaatgctcaccatcactggccatcagagaaatgcaaatcaaaaccacaatgagataccatctcacaccacttagaatggttatcattaaaaagtcaggaaagcccctccccctctccctctccctctccctctcccgctcccgctccccacggtctccctctgatgccgagccgaagctggactgtactgctgccatctcggctcactgcaacctccctgcctgattctcctgcatcagcctgccgagtgcctgcgattacaggcgcgcgccgccacgcctgactggttttcgtatttttttggtggagacggggtttcgctgtgttggccgggctggtctccagctcctaaccgcgagtgatccgtcagcctcggcctcccgaggtgccgggattgcagacggagtctcattcactcagtgctcaatggtgcccaggctggagtgcagtggcatgatctcggcttgctacaacctccacctcccagctgcctgccttggcctcccaaagtgccgagattgcagcctctgcccagccgccaccctgtctgggaagtgaggagcgtctctgcctggccgcccatcgtctgggatgtgaggagcccctctgcctggctgctcagtctggaaagtgaggagcgtctctgcccggccgccatcccatctaggaagtgaggagcgcctcttcccggccgccatcccatctaggaagtgaggagtgtctctacccagccgcccatcgtctgagatgtggggagcgcctctgccccgccgccccgtctgggatgtgaggagcacctctgcccggccatgaccccatctgggaggtgaggagcgtctctgcccggccgccccgtctgagaagtgaggagcccctccgcccggcagccgccctgtctgagaagtgaggagcccctccacctggcagccaccctgtctgggagggaggtgggggtcagcccccgccaggccagccgccccgtccgggagggaggtggggggtcagacccccgcccggccagccaccccgtccgggagggaggtgggggggtcagccccccccccccgggccagccgccccatccgtccctactgggaagtgaggagcccctctgcccggccaccaccccatctgggaggtgtacccaacagctcactgagaacaggccatgatgacaatagcggttttgtggaatagaaaagggggaaaggtggggaaaagattgagaaatcggatggttgctatgtctgtgtagaaagaagtagacatgggagacttttcattttgttctgtactaagaaaaattcttctgccttgggatcctgttgatctatgaccttacccctaaccctgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgggagaaacacccaagaatgatcaataaaaaataaataaataaataaataaatactcaaaaacaaaaaataaaaaaaaattaagtcaggaaacaacaggtgctggagaggatgtggagaaataggaacacttttacactattggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgacagactggattaagaaaatgtggcacatatacaccatggaatactatgccgccataaaaaatgatgagttcatgtcctttgtagggatatggatgaaactggaaatcatcattctcagtaaactatcacaagaacaaaaaaccaaacaccgcatattctcactcataggtgggaattgaataatgagaacacttggacacaggaaggggaagatcacactctggggtctgttgtggggtggcgggaggggggagggatagcattaggagatatacctaatgctaaaggacgagttaatgggtgcagcacaccagcatggcacatgtatacatatgtaactaacctgcacattgtgcatatgtaccctaaaacttaaagtataataataataaaaaaaagaaaaaaaactataaatagaacagccaaatgtgggagataattatactaaaattcttcctccacttaaggttattgaattcttacatctaagaggttttttttaaacagaaaaggaattataatagtccaaatgtaacaaccaatatttaactattcaaatttgaaaatctttccattaatcccagttactgggtattttagggtctacagtctaataagtactgagttgaaaaccaaactattagccctctaatttgatcaagaaagaagagtaaggatacaaacaaaccctctcacacattgttaagatgactatatatcagtctgagtcttggcctgaatactgattttaaacctgagagaattatttttgagggggctatgtactcatatacaaatatttccattaatcactaacatttgggtagtgactggcctctcaatttgttacatatcagactggcaataactattaacttaaaaaaagcagggaaaagttttctagattctcaaataaaaattcctcagttttagaaatgttaaggtattcgagttcaatcatgttaaatcataataaattatgatttattttaatataatggccaatgttcttttttttttagcagtttgacttgaattcctattaatgtttttttccagcagtttcatttgaaaatgaccttctgtgataaaataactattcataaaacacaagtccaaggaaaaagaaaaaagggtgaagtttgaggcagattcaatgttcaagttgaaggtatacacaaatgctcctgtgagaataccacataccgaagttcatttaagacatacagtttgagggcctgcctgctgtattggaatattaatttaaacacactactgctttcctcagttttagcaacatctttcagatgtagttatttatcaagtctctaaatagaacttcagaaagtgaggcgtttgaaacaatactttaattaatgacactttcataaacccatgatggtacataacactatttctgactttatccatcaaatttgaaactaaatcattcattaaggtattgtataattttaaaggtgaatcatcaagtctagaaggcctttttttgaacttttaagtttcactgccctatagaatctatacattataagtaaatacataaatgtattatatgtgctgttaataggagtcattcaaacaaaagttctatgataacatatacctgggaaaagctatgcttaaaacaaacatattttcttttcctttctgcaagacttagcgtctaaagaatgtacaacttggttgggtgtggtagctcttgcctgtaatcccagcactttgggaggccaaggccggcagattacctgaggtcaggagtttgagaccatcctgacaaacatggtaaaaccctgcgtctactacaaaatacaaaattagccaggtgtggtggcgcatgcctgtaatcccaactattcgggaggctgaggcaggagaatcgcttgaacctgggaggtggaggttgcagtgagctgagatcatgccattgcactccaacctgggtgacaagagccaagctctgtctcaaaaaaaaaaaaaaaaaagtacaacttaagacaaagacctgggtccatgtagtttaattgggtgagaatcctaggaaacaggagtaaggaagtagagagaaagatgggaaggagaaaaaactaatacaaggttgctttactgaggttgctgctgttggcaaactgaaaagcataccgaatgtgtccagaattgtgcacctaaagaatgggaggccacggcatttatctctaagttcttatccccattaactgagaattattaacaatctgcactgctagtctgcacttagccactgaataaggggacaatctcagtgggctccagcagtgtgggagaaaggcagaacacaaaaaagcagcactcatttaaagtgggtctatgtaagggctagtgaatctgagctcaaagtgtctatctaccatgggtgaggacaaagggtgtgctatgtgaggcaacacaggcatctgttagaaattcttagagtccttgccatgtcactatatactttgaaactcaatttactctataattattctactagctataagatgcaaagaactgaaaatacacagaaacctactaccctacaactttttagaagacctctagtttttcatactcaacaaaattctctgaaataccacctaatgaaattttatggctatctacctcactgaagtcctaaggaagaattcaaactttgtaggctaatgcaactcagattaaccaaacaacttcaatttaacgatttcattaacattgaggagtctgcagactctcacaaagtgtgttgacactgaaaattgatgtgattcataaagtgaagtatacttaaatatataactgacagtagaagatgcacctgtatatatttttccttctttcaacagattttcttttaaaaatactccatattaaatgctacagaaaataaagttaatgagcaggcattggtatcaaaaaaaggggagaagacatgtaaaatgtggaaatgctataaaagagatatgaacctgacgggttccctatatcctatgcaaggcatcctggacccaaaacttttatttcatatatttataaaataaaaatgtttcaaactctgactactgtgtatacattttgttaaaagtctggtggttataaaattgaacaaaaaacatagctggcctttagttatgagaaaattccacttcccaaaatacctctgaaagcttaaggtaattttaaaaataaatgaaattattaaaaaggaatgagaaaaagtattttcataatagcccattttttgtttttatagtatttaaaataatggtatttaaattttgagcaaagtttttcaaagtaatctatgattcaggttctaaaatccaaaaaaagttagggttcaccagtgcccagtataatatttaaaactcctctaccaactcaaactgcatatacaaacaatatattaaaactcaattttaaggatttttttatcacttagttattaggtcaactaataattaaaagatatactatttaaaaggacaacattttttcattattaaaaggtaaatcaggagctagaacttcttgaagtttgcatgaaaggtctagtcaacacagtataagaaacatttaggtcttcaagttctatcagaactctcaatgaattaataattagccttatgatttattttaatataatggcatctgtgaatgactcaaaagtgttgtaattaataacccattttcttaccaatttcttataggcattctagaaaaaatacatgtgtcttaaagtaaaagtgagacagagagaaagagagagagaaagagacaggtacaaggggaaagggaggcgtggagaacaaaatctgcaatgggtacacacgttttactttgaccaactacagagaattcacaaattatttttagaaagcacaattcaaaaatatatgctctacagcttaaattgtcttacaaaattctagaacaaagttcacattaacatgacttctatttagttatcccataacatttaaatttttcaaacacccattttaaaaaacaaattcgtaattttaaacatgagtgatgccaacttaaagttgccaaaccaagttcaatatgataatcaatgaaccaaattattttgaatcttatatcaagataataccataactattgcattgactaaactcaccttcaaaaacactatgtcacaactaaaaaataaattaggagctactaataaaaggacaatgacaactaggaaagaatagcacattcattaatttaaaaagagttccatttttaataactttgtgattaagacattattacaatgcaactgcctttgtaaaaaaacaagtacaaggaaatgggtttaaaagtatttttgctctacataacatccagaagcgcagctctaaaacagttccaaattaaagtgaaccaatggaatccctaaattatttatttagagttgatattattctttctttatgaattaacctctctcctgccatctggtacagcattttttttccttcaaaatgtaactgaattcatattttcttcaagagggtttatctgcctcccactttatcatcttacacttccctcatctgccatccttacggtactttgtcattcatttatacatactgtctattaaaaccaggtgtgattttcccaatagaaagtataaatggaaaagcaaagactacttttgatttacaatttgtataaattagagaagttaattagggtgctcagtcagtggaggacaaaatatttaaattttcatcatgctcaaaaaataaacatgaaaagtataaacaaattaaattagttgctaagataaaattcaaactacagaggatggctttcaataaatagcagtcactcaaaagcagaatttaaatttttcacaatagttactgttttcaaagtaagagttccaaggtcagaaaagcaataatttcaatgtcatttttctagagaccattgttttaagcttattaaaaaggctttttcattttgtgttattgtcaaaagaaaaccttgcagctgacagtccagtcatatccattaagttctttaatagcagtacacagatcttttcgaaaaatttattagctcaaggagaaatgaacagtaacaccaccaaatagataaagaattacttatatgtgaaaaaaatgaataggtggtgctaaggttcatgcatttttacatgccaggaccacttgatttttatatacttgatgtgtataaaaataatattttttctcaataactctatcctaattctcctttttaaaacatacaaagcacagaaaataagttagcaagtatatatgtgatgccattttaagataaaaatatatttacaaaccatatacctgataaggggttaatatccaaaagatatataaaaaaaacctcaaactgaatagcaaaaaaacaaataatctgactaaaaaatgggcaatgacctgaatagatatttttccaaagacaacacaaaaaatggccaatgggtatatagaagggtgctcaacaaaactaatcatcaggaaaatgcaaattaaaaccacaataagatactacctcccatctgttaggatggctattatcaaaaagaccagagataacaagcattggtgaggatgtgaagaaaagtgaatcctgtatacttatgttgggtatgtaaattagtacagccaaaacagtatggaggttcctaaaaaaattaaaaataaaactactacatgattcagcaatcccactatgggtatttatccaaaggaaatgaaatcagtatgtcaaagagatatctgcaatcctataatcattgcagcattactcacaatagctaagaaacgaaaataaatggaggtgaatctatagtgaaaagacatgtgagactgagagtatagagagagaccgactgcaaagaagtatgagaaaattttggcagtgatgaaaatgttctacgccttattgtggtaatggttttacagagatgcatgcattgtcaaaacttacggaattatatactttaaaaagacacaatttactgtacatgaatcatatctcaataaatttaatttttaaaaatgatgtgccacaagcatggtatatgttacaaaattaagattatatttcattaaatttgagggccatcaaattctctaaaaaagcaaaaaaatacatgagtatcaaaagtcttaaacttttagaaattcagaacaatttatttgattctgacttaggcatattgccaaatacgggccctaagatgccttatctgtagatgacaagactaccaaattcaagttcaaagtacctttaatggtcattttctctaacacaaggtaagtaaagaaactcatgactaagtgcaaacaagttcagctaccatttcaaggcattaaaacaaaatgttcagaattcagattgtcttacatagttaagccatacaacgaccagtcttctcagctcttgagcacctgatacagtgacacatctaaaagtgggataaaaaacatccaaggtgtttggtaattaagagccaaaaagtaaccagaaaacaaaaagtttgaaaacctgcatcttatagccaacatgttatgaatagtcatttctctaatgtgggaagaaaacaccaccaatattctgacatgctaaaaaggttggacttttcatataaaaacttagaaacacaaacagcaaaaggggcaaaaaaaaaaaaaagaagaaaaagaaaaagtcattttaatactgagaagactacagaacagtctaggtaaaaattccaggagccatccagtctttaatgtcatagtccttaaatgcattgaagcagtatagctacagataaaagagctgttatttttaaatttctgtattttacaagcttagtgtgtttcctatatgccaaatgttgttttaagtgcttttcaaatattaactcatttaattataataccaatccattgaggcagatattttactttatagatgaggaaactgaagtagagcgattaagtaaacttttccaaggttacacaacaaacctggtagtcaaaagctaaagtcatgctcctaaccacaaactttgcttctcttcataagtttttaattcatgaactttcatggatatgagcaaagctttgcaacagaggaaagtacacagactctactaaccacaaacaaatggtcttttgtcagtcaaatgcagttatttagtctctgcaactgcattatttgttagatttctggcagtggttctcaactctggctgccaattctggctgcacattggaatcacccagaagtttcatttaactggtctggagtggcaactggtcatttagtttaacactccccggatgaatccaacgtgtagctatggcttaaaaccaatggtgtatagcaaggttgtgagcttaaaagcctggcaaaataatatagagagcagggggttgggacaaccttaagagtccaatttaattaacaaaaaaaaaaacacaacaaaacaaatcaatgcatggattaaacttaatatctacaaacactggctcacggtgtatcttctgttcttggaacagccttttattataaacatatcaacgataaaaatacttactccaaaatgcaagtctgtgaacacatcctataaggcagatggaaagaaatcaagaaaaatcataaccaatgtcaccaacatgttattcccttgtgaaagtgaacttcacaggtgggtctatgaccacacagagcacttgcttagtttaattttcaactttcaaacaaaaggatttatgaacagccttttggaacttaattttcatatgttcaattaaaaagtcttaccctaatttctatataaatggaaatggatactcacatgctgctctaaatgcatgaagattaaccacctattctaaaataaacacagcaatgggtattagtgtatctacacttaaagcacaataggtcagtatagtttagtggttgtcagatgttagattttgtaactagtataaatttcacttcaaatttaagagactgatatattggggttgaaaaatttttatctgtaaatataaacaaatacacaaaactattactttttttttttttttcttttttcgggatggagtctcgttctgtcacccaggctggagtgcagtggtgcaatctcggctcactgcaacctccgccatccaggttcaagtgattttcctacctcagcctcacaagtagctgggactacaggcacatgccaccacacccggctaattttttgtatttttagtagagacagggtttcaccaagttaaccaggatggtctctatctcttgacctcgtgatccacccgcctcggcctcccaaagtgctgggattacaggcatgagccaccgtacccagctcactattaccatttttattaccaacatacagagagacatacattatacccactacaacatccttatgagaacaaataaagataccataatgagtgtaaggatatatttaccattatatttatagaaaaatagaatgctattcagaataacttggaccatttaaaaaagggtaaaattaatctaatatactcaatttaagaagacatgagcataaattagaaaacatgggtatccacaagttaaaattttaaagttatgaatataaaaagataaaactcaactatctggaaatatttacattagcttcttctgtgcgtgtgccttaaatctacaaggcctggtgctatgtactaaggctacagagataaaaggcagagttttactcaagaaactaagtttagtagataaaacagacaaatgaactggtaagttataaataccataaaggtaggcacaatcatgctatggaagcacaaggtaagaggggcacttaggtaggggcacttacttatgtaggattctgtgctaggtgctgtacacaactgtgtttgtggggatggggtttgtgatgattaataaaaacccagatctttgtttcaagagtttacattacaataaactggcctaaaagaccaaccacgaagaggtcatttcaaaagaggcctgaagatcggactctaaaccataatccttaataatctagatttaaagttgttaaaaacattatgctgctaaacttccagtacaacagtacttctgatttaaagaggaacattttagaaaattttacttgaattggtgggggaaggaagaggggcagggataatgcccaggagccatccaatccttaatgctaccctgaagacataaagacagaatagctacggttaacatctctattatttttgttacttaaggagggtagggatcctgctgcttttgctaattagcaaggactagtaaaaacaggagctccaaaagtactgtatgataaaacagcaaagtctccacttaatcgtcaaatgtgaacaatgtatgagattgctctaggaaattaacaaaaatactgaagaagatatgattataataggaactatgtgacaaatgtgcctgacttatttagacactatagaaatggctaccaaaagatagaaaactaatataaaaatgtgtcaaaactatcaatgaagaaatttaaagacaacttcttaaagtgtgccttaaaaacaagtagctccttacacagtggtgcagcgagactacctattattgaaaaatcattaactcattcagttatctcaactgatgtttcactctgtatactgtatttttatgacagaaataaatatttcataggcacatatgaggaaggaatgaatgtgaaaaacaatttgaactcccaggacgagcacatcctttagtaaagtaccctgcttttctttgcaacagaaaaatcttagttcaatgttttctcaaaaagtgttccaatgatcacctgaattagaatcacatgagggacattaaatatgcagattcctgggccccaaatctcagatccaccaaattgctttctggggacctaagaatcagcattttaaaaagttcactggaagattctggagccaactaacgttttaagaaccatggccttagacgctttaaagctgcaaacatgatatatacttattaaagaaaacaaatgcaccaaaaccaactgaaaatactgatttgtttgattttgaaagactgggactctttgaaaatcaaagcaaatcaatattttcttaagaaatattatagtaaacataattttacgttttcttgaggactttaggctgtcactatgaacaccttcactctactgtaaatgaagcataaatggcggcagatacagttctactactgtgttggtacccagcacagcagacacccgatccctgggagtactccctgtgttctgtgatggttccacttttcttcttccaaactctaactactggtgtgttccaaggatctgtcctcagttctatattacaaccccactgtgcagtttacttgcctcaaagattcagcctccacagagggcttccaaatcctaaacttccaaaggatagattgcaaactaaatcattaccattatccctataacaagccaatctgcctgactaccctgttcctcttgcctccaactcctaccatttccaaagtgtatgctaatagctatctacattttcccgggaaagaaatattggcatcatctttgacccttctttattttcactgaaactgcctattctgatcttcaaagtctgtcttcttctattttcatcatcactactgttatttaagctattattaactttagatcaggttagtataaaagcctcctttctcctagattcctcctactacaatagctgtgtttctgaacctctttgtccactgtgtactctgggagcttttatatatacagatgtctgtgttccacaaagttccaaagattatactgatgtggaaccaaggctaagaaccgctatgttagtgggtttattttccattaaacaatcaaggaatctgcaacaatgcttttggtttctagtgtatcttttcaactgcaaaaagcccctaaaacgataccttgtcacaaagaacactaataataacaaaatcaaatagctaaacactaatgtacattgtatacctacatgcccttcattgaactgactatataaatggtccctttatcttttactattactgattactgaactcttttcattatttttcttctgttgggaatggcagttcaaactctcctagtgcaaacttaacaggaccttctgtgacaaccttcaccttatttatttcaatgatcaggcaaatattctatcacaaaaagctttctgattctatatcagaataagtataagaagaacacaaaaagaaaacagcaaaacctcacttgagaaaagaatctgttcaaagtttcttaaggtcttggacttggtcaaaattttaaagcagctgtgtttaaagcccactgaggaaaaaaaataagaaaagttcaattaaaaggagtctcattctaatttttaaaacaacttcaaaactttgtttctggaaaaacaccaacatcacattcattctcttatttttagcctttttggtttaaaattattttaatacaaaagtttttccccttcccccacaattctcattttaagtgtttgctgaagaatagtcaatcacaaatatatttttcagcttatcctacactgccatgctaattcacctgttaagatcaccccctaattccatgactttaagaatacctcttttaacagtttagtacatacttttacttttttttgtgattgatttataagctgcaggtgtttatgtgataaactgttttaaatctgtttggtatgcagaacaagtaaattcagggattgaataatttgataaaatgtcccaaagatattcataagataggttaaaaaaataaaaacgaaatggaatgaaaagtgtacttttactcctgacaactgcagccttttacattttcttggaatttttacataaacgctttaagtttagaaagagaaatgccaggcataaaagcaatcattacaggaatgggttcatgtgaatacgattatggaaaaaaaaaatcatacaaagacaaccaaaaacacacatggctctacttcagttcttgatttgatacatatttgtcaggctcatctaattaaataatgaagtccctgtttgaaaagcgaaactagtttttttaattaaaaagctgtctataactcttatacatttaaaatatttttggtttacatggaggtcaaattttaaaaattatgtatgcaaagacagaaaacacctatatgtgcaagcatatttccatttataaatatggatctattcactagatagtgaaaaacctatcttatgaatatcttatgaatataacctcactttaaaagactgtctcttaactatcaatggcagacaccagaaataccccttcgcatcaccactgctaggcatctccctaccatttctttttagtaactgcttcagatacgagtgctgcctggaacacacctttatctccagttctcactttacctttagacaaattggcacagcatctcttaagtggtgaaacaaggcaggccataaactggggaaggaaaaagtggtaaacgaaaagagtgcattaagcctacctgctactctttacaaccctgttcacccttccccaccccaagcctgttcatcaccatcaactagcatcagttgggcaaatggttggagaagagtggaaaaaaatcttttcttatcacagcaaaaaagaacaacacaacttattttcattgtttttcctgttttattttcaattccactaatagagataagggaaaagaaggctctgttctccaacctcccagtcactatctatcctgtccttaatattcaatggctgttttgcctccttattctaccctaacttatttccttccctgccatctctccccaaaaaaccctcaccttgtatagccccaactcagctaatcatacctatcctatggatcatccattcccatcaatttataacttttcacctaatggaaattctagggccacttcctgcttctcattttccctcctattctaacatttggagtcactaatattaggtttggagttgggggtggggaacctatattattcccataaaatatgtatagtattaataatgaactaccaaagcatcaagaaagttattttaatatttttaggactccgctcacttatctgtaaaatgaagaagctattagatcaccactctaatatctggctgacaatttccagttcctaataatagggatcttaaactatagatctgaggtagaatacaggaattgtctaagaggcacccagttgaatctgctgatcagccatgtttgggaatcactgctaaatgctaagaggttccttctagtctaaaactccaagatcctaagctggaattttcactgcatttgctggtagaagaattgtgataaaaggggtacagtttccatagttattggtgctatagttcaggtatgttattgattcaatgggcctttgcagactgatctagcacttaagcaatcttcagattacaataacagctgacttgcaaatgaacttgtaaaatatgtttacagactggggaccatcagcacaatactaagtcctcaaagtaaaacactaaaaattatttccttagtattattatgtgcacagagtttttcacagatgacttttttactactaatatttagcctatatgtcagaaataaaggtagaaggagcatgctcattaggatcacttattctgctaattcactgatggggctttgtatatcattcaagcaaagcctagagaagtctagatcaccggtgaaattcagggtattaaagcgcctaaagaatagtctcattcaaatgtttaaactgccaggactttaactccccagaagcatactagatcattcacttatgaactccatgtatctattctagatctggtaacttccgattctcataaacaagagttcctgtggttaatactcaggcttaaaacatggttaaacatgtgggaactaagcacatataaacagcacttgaagagatgccacattagtgtgttaatttgagtggaacctattcatttatgaataaatgaataatgaaattattaaaaggtaaaaatagaaatggaattctatgctagtcatttttctctttagaaagatgcacttaaatttgtacaaaatagcaggataaattgcaggaaaatgtgtccatttatttcctaatctctccaaataacataaaatctacagtgaattccattatgtaagagcattctttgaatatcaagaatgatgcagttgttgctatggtaactactcattttattgactaaattgtgggtttgggtagcattctttcaaaaaacatattttaccatcctaagtaggtctgataagactctttctattgctatctgttaaacaataactacaagccccatttggggatgattaaacagcctctattaaaagctaagcttgatttgctaaggaaagaaacctttaaagtttgaaaaatgaaacatatcaactacattcaaaagaacaaaggatacttagttttaactttctagagtagttgaaacgtgtgtataaatcaacagtaacatgatcttacctgtctgtattccttcactgccataattttccttctaatcctaaattattaactaagtataggactaacaccagaaggctgctgacttttcagtttgcaattaagctaaaatgagaaccagtggaaagctttcctcatttcgatactcaggagaagtctctctcccaagcctatgaaaacagaattttcactgtcaaaatcttataaaacagctgtgtacaaaagcctatatttaaagatatcaaggataactgtagactccaactataaacactcttcaggcacaggcaaaagccactaaggcttcttcccctatgagcttccacagagggggttctcaccggaaccccatccatggaagccgagggtgggctttatcggcaggtgtctttaggaggcttccaatacaaacggtattttcagaacctgcccagatctcttcctcatcgcctaaataaacagttaagaccaagtatttaagaaatgggagtgggggccacgagtgtagcccgcccccttttaacaatgtgaagtccagtcagctaaaaggcctgctggcttcccagccctggaagccaatgcgaggaaggctcggcatggttgtaggaatgaagtactaggaagggggtctgataaggaagcaaatggtacagccggtaggtcaagcgtaaaggagggacaactcaggtttcttttcgtcttttacaaatggattttacctgtcttgttttacctcggcgtctcttgcaaaaagcgacccccacctcctctgtgagcgtgtatgtgtttgtgtgtgccgagacaacaacctcagcaccccggctggggacaggggcttggagggggtggggactcaattcctttacaggcctagaactctcccgaagggccctcaaagaaaagggggcggggaggagcgcgtctgatgccgactagggggctcagaccaggcccgggagagcagcagcggctggggggacgtgcagatcctttacattttaatggtggcctctttggaggagggaagaggtgacaagcggttgggggtgatgaggcctccccttcctccctcactcagcgcgctgtttaccttctcggtacttcttgcggagccgccggtggacgctcttcaccacaccggagagcttctcctgctccagtttccgctcctgctcccggggcggcggagtgttcggggacccggccctctgcgcacgagcagtatttcggccgccggcccctggctccatatcgcagccgccgccgccgccgccgcccctcaggcccccgcagacgctccccagatggaggaggtggggtaggaggagggagctgcggaggcagcagccagaggaggcagaggaaccggagcgacag

SEQ ID NO: 1574 - DNA, 64665 bp, Homo sapiens
aattggcgtagcgcttgctgagcggcggcggcaaccgacgtacacaaggggcttgagcgttctgtggagagagtgcgaggtcaggccatgaacttggggtaagcaggggtaagctggggtaagctggggtaagcaaggtggtcgtcagcggagagggaggcatgtgtgtctgggttgtcccttggagtctttactggagaacgttcccaacctgcgccgccgagaggggcagagcccagttctcgggtagaagatcgaggcagatgggtcggcccttagcgactccacagaccttacgttttcacttaatgactagcattaaaactgccagtgatcccctttcggtcccttatttacctcaggatgaggagggaagagaggtgaggaggaaaggagagaaatgacgagacagttagaggaagcgtggcggctcctggggaggactcctggcccatgccccgggttcttcgccaccttgtttttggagtcttgcagaatgttgaaacgcccaaattcgttttaggcccacgaggcggggaaccaggcttctcaagaaatcgatgtagtaccagtgcctaacacctagtaggcgctccttaagtaggggtgaataaataaaaagggctggtgcatggtcttcatcactcgcaagtttgatattttgagaagatgagaagccaccaaactcagacctaactacacatcgttcagcaaatgttattatgttttagaatctggggatatggaaataaataagatagtgtgtcccttaaggagattacagtgcagtgcgtcattgaaggtactttaccattgaagctcttttctttcttggtgacgtttcaccaacataaacacgaactgttcataaccctacaataaggaaagccgtaaaacctattctttccagtgttttacctttaatagttaaggtgaggtaatttgatttcccctacctgagcaacaccgcaaatttcgcattcctaatcagacctttcccagcctctctctcccttgactggcttgctggatttaattttctctctctgaattatggactgtatgtatgggctgccatttttgttctcagtggagttttaggaccttaacagacgttcaagttttgttggcagtggctactgttactttatgcctttgcttctgatatgcacgtataaagcaccatactaaatatcactatgtattatttgaaatattgaaagtggtactctttgctcaagcagttactaaccttgatggcattgttagtagtcatatcgatgctccagcactccatagaatgttttagtcatgagttcattatgaaactaatgaatggcggttaaatatatcttgttcctttaacttatgtgaggagttttggtaacagcattattaaaaaatggtggtatgataacttaatttatagtttaccaataacaaaatgagatttcaggttaatgataacaatgcttgtagtattgaagagtttcaagaattttccccctgtagttgtgggttttatcttggattgcaaacgtttttaattaaaacactggttcgatgtgtacaagattcctgcataaattcaaaataatggatttattgtcaggttcaaatgaacatttctggttatttaaaatgttgcggtttgttaaaaatgagagacaactttctttttttattacagagatggtttaaagcttgaaactgaattactggatggaaaaaccaagctaatattgtctccatatggtatgttgtgttacagaaatctgaaatgttaacttttaaattcatacataaaatttatattagttcaacagactttttgcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaataaaatagaagtaaatccttgaactggattagaaaaaaatactcagtcaagatctaaagtttatgctttcgaggataatgttgctagcttaaaatcttataacaatattaattacagttttcttgcattaccaccttagtatgcttttggtggatagtttagtaatttcttttttcttttgtagaacataaatcaaaaatttctgtgaaggtaagccgtataactttgacctgacctgttttcaaatgtaaaatgcagttttatttatagtggttagaaaataattcctgggaaatgtcaagtgttctaaggggtttggaattatagtgaggagttattattttcttgctttcagattggtcctttcacagaaattgaatcattttaggtttagcccaatagaacctctttctctagataagtgctattcagtaaagcatctgtgttaatggaagtgttcattaataaaatcagtattattgaatatggaagccactagtcatgtatagttattgaacccttaaaatgtaactagtatgactgagcaactgaatttctaatttcctttaatttttaatggaatttaatggataatggattgtactggacaatgcactccagagatctttaaaaatagatattcagactttaaacagaaatgttttttcttttcatactcaaattccatttgcccacaccaaaggggaaatttaattcacaaattgtagcatgcatttagcattttcctttaaaaggttgcacttgagcttaagggtaattttccttttaaattattttcccttatcagaaatctattgtgcttttttctacaaaatacattatcactttgtttattttaatttttgaggcagagtctcactcttgtcacccaggttggagtgtagtggcataatcatggctgcagatcttcctcctccagcctcctgagtagctgggaccgtgtgcatgagccaccatgcccagctaattttttttatttttagtagagatgggatctcactatgttgcataggctggaattaccatttaaaaaatttttttgaggttgggcatggtggctcatgcctgtaatcccagcactttgggaggccaaggtgggtggatcacctgaggtcaggagttcaaggccagcctggccaacatggtgaaaccccatctttatgaaaaatacaaaaattagatgtggtggcgctagtcccagctacttaggaggctgaggcagaagaatcacttgaaccctggagatggaggttgtagtgagccgagatcgcaccactgcactccagcctgggggacagagcgaaattccttctcaaaaaacaaaagcaaaaaaagccaactgttttgatacttctactcttcttgctacctatttcttttttaatttttagattaatatcagtaggaatttctcttctcttccataacttactacagcccccttttatctttgcagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgtttgtaatggttgatttttatcttctccaggctgatttgttatagaagccacatttgtgaagacattttattgtcattttaaccaactcagaacatctgaagatcccctttataggcctataataaacagaattactggtcttggatttttggtaggcctataataaagttactagtcttggacttttgattactagacttttaatcataaaattctatcagctatctaaaggtgttttagaattttttttttaagagtaactactgtgttctcaactgatgttgagcctaaattgtttactgccttaaagcaaattgtttgggtttatccccattgcatttgggacttcaaaatactgatgcaacctaagtttcccttctgtattgattgttttcaagaagtttctcttcccatattgatagaggttacagagatcctcctcatttcttttttgctcttcacagactataaacaccaaaatcagtagtattttcttccttttttgttttgttttttagtttcccaaatttcacagttctgccactagatgttgaattctcttttctgcaagttattcatgaattatctctgcatagtgcttttctttattccttctaatggggtaagctcctgagttactacaacacctacaggtctctttttttttcccccatttcccactggttgaattattgtaatctccatagtttgttctttaaacacagctgaactctatctcattatcatcaagtttaacatatatgtggtcaaagtgctttcctaattctatcaaaatctgtgcatttttcttttctttttttttttcttttttgaggcaggctctctctctttgtccaggctggagtgcagtgggacaattatggctcactgcagcctcgacctcctgggctcaagggatcctcctgcctcagcctcccaagtagctaggactacaggcgcgtgcccacaccaccaggctcagttaattgtttaaaattttttgtacagacgggagtcttcctgtgttgcccaggcttgtctcaaactcctgggctcaagcgatccttccgcctcagcctcccagagtgctaggattataggtgtgagccactgtgcccagcctctcctacatttttatttttcttcaatctgtggtaatgaagtaaacttggttactttcctaatttcttaggtttataggaagagaaatgggaaaatacagataatacagtatcataagtaatttattaaaataatggattctaaaactcttacacttaaaatagtctcaaagattagttgaactataaaacaataaaaaaatttttatgagtacctctgcacgtgagaatcagtgacatactaaaaggtatttgtaatattagtgctaggtagcacattttatatatatatattttgtttgttttagagatgaagtttcgttgttgttgcccaggctggagtgcagtggcacgatctcggttcactgcaacctctgccttctgggttcaagcgattctcttgcctcagcccctcgagtagctgggattacaggagcccaccaccacgcccagctaattttttgtattttttttttttagtagagatggtgttttaccttgttggccaggctggccttgaactcctgacctcaggcaatccacccacctcggcctcccaaagtgctgggattacaggcatgagccattgcaccctggcccacattttatatttaaaaatgttacttttctctgatttgttctggccttgggatcctggccccatataaattgtgaagtgagctgatattaaacaaatccattgaacattgtctttataataataaaaaatggctgggcttggtggctcacgcctgtaatcccagctctttgggaggccaaggcaggtggatcacctgaggtcaggagttcgagaccagcccggctaacatggtgaaaccccgtccctactaaaaatacaaaaactagccaggcttggtggtgggcacctgtaatcccagctactcaggtggctgaggcaggagaattgcttcaaccggggaggtggaggttgcagtgagctgagatcgtgctgttgcactccagcctgggcaacagagtgaaatgctgtgtcaaaaaaaagtagttaaaaaaatttttttaattgaaaaaaaaaaaaaagagataatgtaggtggtataatctaatgacataagattcaaagctggagtatagtggagatgtcctataacaactataataaaagttcctgaagtaagataatttctagttgttgatgaagatttgcaagtattaagagttagtttcttatggttatattacctaaatagcaaaatggaaaaaagtttagaggactgatttatcacagatcatataaagataattggtgatttttcttggacagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtaagatttttctaaagttttcatgaattttgattttttcaatatgtgttttagaatatcagattcattgggttttatgtaactgtgactcttaaactctaatttaacctgtcaatctattaaaataattgttcttttagaggactttctctaatatgcaaaattatttttatagttgtgccatattttaaggttagtgttcagaatattaagaaacctagtttctgtggattttagaaaaaatgttagtacaaaaaactattattatacttattttagaatataggaggctttactcatatttaaaatagttatatgaaacattgtttaaaaacaaattacggtatttccagtgaaaattaaggaaaccttactatgactatttgacttgagttactgaaaaacattgctttcctggccacagcatttactcttcctgttcctcattccatgctaagaaatggcagtactttttttaaaaaacaaggttaacacagatttggaaggaacagtagagtgttacatgctttgtctttcacaagtcctggcattgtattgtgtttttaaaagccttctaatttccactttgggataaggaattgcgaatatgaagacaatagaaatatctaaaattttattaggcaatagtgaaataaataaaaaattaacagttcacatggagaggccccacaaatggtttggggacccattaactcctgaatattcccgtgatactcaagatggaattatttactctcttgttatagattattcttggtaaaatgagggagctggattttgtctttaaggctaaaattctagcaacaacctgcttattaggcataacgagaaatcatatcaacaaagttaaaagcagaatttgcctaatcacgtagactttcatgatttctttctcttcactgggagaactagcacattcaaaagaaatcagaacattttttgagccatcctgtgagccctctaaaacatctgattttgatattatagctgggcatagagacaattcatgaaaaggttttccactgatttcacagctaaataagaaaaataacgtcaaggtaatgagtatttatcaagatatttgtattcccctttaggttgtgatttgtgttataatttttattttatttatttatttattttttgagatggggtctcgctttgtcacccaggctggagtgcagtggcacgatcttggctcactgcaagctctgcctcccgggttcacaccattctcctgcctcagcctcccgagtagctgggactacaggcgcatgccaccacacccggctaacttttttttttttttcttttttttgtatttttagtagagacggggtttcaccgtgttagccaggatgatctcagtctcctgacctcatgatccgcctgcctcagcctcctaaagtgctgggattacaggcatgagccaccacacccagccatataatttttatttttattttttatttattattattatttttttagatggagtctcgctccgttgcccaggctggagtctcgctgcgtcgcccaggctggagtctcgctgcatcgcccaggctggagtgcagtggtgcgatctcggctcactgcaagctccgcctcccaggttcacgccattctcctgcctcagcctcccaagtacctgggactacaggcgcccgccaccacgcccggctaatgttttgtatttttagtagagacggggtttcaccgtgttcgccaggatggtctcgatctcctgacctcgtgatccgcccaccttggcctcccaaagtgctgggattacaggcgtgagccaccgtgcctggccagtttttatttttaaaagcatgctggcaagaggaaatggagatttgttttctgttgttgctcgcttgttttccttatttgatataagaaattgtatggctatggtcatgagcaagccatttaacctctgggcttcagtttcctttgttttgttttgttttgttttgttttgtttttttgagacgacatctggcccagactggagtgcagagtgcagtggcacaatctcagctcactgaaacctccacctcttgggctcaacccatcctcccacctcagtgtcccaaatagctaggactacaggcacgtgccaccacacctacctaatttttgtaatttttgtagagacgaggttttgtcatgttgcccaggctgatctcgaactcctgagcttaagcaatctgcccacgtcagccttccaaagttctgggactacaggtgtgagccaccactccctgcttcctttttttctttttgacaggaagggaaacttaatggctacctcaaggattgttttgagagttaatttaagtaacgtgtaagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggagaattgcttgaacctgggaggcagaggttgcagtgagccaagatcgtgccactgcactccagctgggctaccgagcaagactccatctcaaataaataaataaaaaagaatatgtattgaggatgaagtttaggggccaagggaaaacgtcccctttgccctctggaggttttctgaaagatcaactgacaaaaggcaaattaataaaaggcatacaaatttattaacatgcatggaagttttacaaaatataaaaactaaaataaatggccagatggctgacacttgtccaccatgttgaggttacagaaacaataggggttggagcatggcaaaacagattatgggagggggaggagaggcaacctggccagtaaaagtgtttttttgttttgttttgttttgttttttgagatggggtctcgctgtgttgcccaggctggagtacagtggtgtgatctcggctcactgcaagctccacctcccgggttcacgccattctgcctcagcctccccagtagctgggactacaggcacccactaccacgcccggctaatttttttgtatttttagtagagacggggtttcactgtgttagccaggatggtcttgatctcctgacctcatgatccacctgcctcggcctcccaaagtgctaggattacaggcgtgagccaccacgcccggccaaaagtggttttattatgtacatgagacctcaaaggtagtagccttcagagaacagatgacaaatgtttccttcagacctttaaaggtgtcagactcggttaatttatcctagatctggacaggggagaatcctcagagaaagcctggctgcgtcattgcagattttctctacagatgcaaatcttccccacaaaagacagctttgcaaggctacttctgtttgtaggccctctgaacagccatcttgaaatgtgtcaaattaatacattttggggtaaaacactgtagttccctttaaagtatagttatccctcagtatccatgagagactggttcaaggatagtcttcccacttcagggtgccaaaatgcacagatgctcatgtggaatccatggatatggagggcctactgtatatcttttagtatgatattatcaaaagtcgtattttataatatttgacatctagagtagttctctacaaatgcttaagaaacttagtggtttcataatgccttaggtcgtgtctttttgttactctgaagtgtgcaccaaaaacattaatgtcatcagtacattctgcagcccttgtaaggtcaaagatttgtaaacttttcccatttcctggaaatccttttttataatttttgatagcagacatcctatgcgtttaaggatggttttactaaaaactaattgatttcacttttttaaataaccaaaacattctaatgaagaagaatcattgttgtatcagacagtatgtattctagacagaaataagcttattgctttctttcagctttggaccttataacagaaaaatctataatttctgttagagtcttgaaatttcgttagtgactaagaaatatccattacttcttcgactaaacttggagtctgcgtatcacaatctgcaaaacatgtgacgtaacagttgtatttcttaggaatagctatgctaaaggcatgagatgggcttcaccctagttgaaaaacaagaaagtcttgtgaggccatcactaacttggctgggatagatgatttagaaaaagagataagcaagaccagctgagtggctcacatgtaatcccagcactttggaaggccaagatgggaggattgcttgaggccaggggttcaacatcagcctgctggagcaacagagtgagaccctatctctacaaaaaaacagagagaagcagcagaaataaggagtgaattgatgctggaagtcaagtgtgttagtctgttttgtgttgctataaaggaatacctgagactgaataattgataaaagaggtttatttggcccacagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatattaaaaaaaaaaaaagcttaccagcagtttgctaacagtcacgtagctgggaagttgttgaacttgaattttaacccatagttctctacttcagaattctagcttttaattctcttaataataattgaatgaacattacaggaaactagaacctcgtgataattgacaaagtataaaataagttattccaataaaactgctccttattggtaattgtgataataaaattgtaccatacttaactttggttctgattaaattttttcttattctgtgtccctaaaaaattattctccactttgtgagttaatctccttcctaaaaaagagttttgattagatctgtgttggtatctgcattaagaaggtcagatttgtttacatggttctgtttttacagtttttgtacatttttttaaaaaggacattatttacagatgaacaggttgctttaaagaagaaagaaaaagaagtttctgaaaaatggaatgatccttggaaaaaatctgaaagtgataaaataatatgggaaaaacatcaaattcttgaccaatctagggtaagacatcttaattgcaatttttaaaatactaagcagtgttcatattatagaatttatttttaaagcttattaaaaaaaaaaagttttttttttgagacggagtttctctcttgttgcccaggctggaatgcagtggcacagtctcagctcactgcaacctacccctcccaggctcaagcgattctcctgcctcagcctcccgagtagctaggactacaggtactcaccaccatggccagctaattttttgtattcttaatagagatggtatttcaccactcaggatggtctcgaactcctggcctcatgtgatctgccagccttgacctcccaaagtgctgggattacaggcatgagccaccgtgcccagcctatttaaaaaaacttgtcatatttttgggttttttgtatgtgtgttttttttaaaaaaagaaacagggtcttgctctgttgctcaggcaggtatgcagtggtgaaaacataattccctgcagccttgaacttctggactgaagggatcctcctgcctctgcctcccaaatggctggtactacaggtgtactccaccatgcccagctaattaaaaaaaattttttttagagacagggtctcactgtgttgctcaggctggtgtcaaacttctgacctcaagcgatcctcccaccttggcctcctgagtagctgggattgtaggtgtgagccactgggcctggctcatatggtattttaaaacagtgttatttttaatttaattatgaccttaactggtctctatttacattctgtgagttgtctcgttatgtcgttaggtgaatgtagaggctccctttagagtcttataaaggagctgtgcaatttttgaaatgaatacaaaactctgccactatgtgtaagtgtttagttatcaaatatacacatatgccaagtgtgtcttgtgtagtgcttttgtgatttttaaattttatctgtggttaattttgggtaaagaaacagtgtcactgtttttctatttatttttacacttctgctagctcttcaagcattctatcacagtctcgtagccaggttatggtggtccaagctgatggggcattcacaacttagagctagtcagactttagaggtaagtcctaagtgtcagtactttggatatttaaaccttttagtatttgacctctaacctattttccttgaaggagagaatctaagtcctccttatttttagttatcagttaatttttacttgagtgtattatgcttcatttgctatcccttcctccttgtgaacatttacattttagcaaatgtattctgaaaataatgtagtaacctgaagggatgattctcctaaagagatgattctggtggtagaaatttttggcactatggcctaattaggtaaatttcttatagaaacccttcaagttaaattttgtgcatggctgtctgttctgcttcatgtagagctgacttgcctacattgaatacttttgttgtctgttgataattttacattaacaaaaggaatgaaatctgaattgcatttgcccacaatcccaaaagcacattgactgaaaaggcaataaggttgtcttggtagaactcattttggaaaattctgtagctctgggtgataattttaagtgtgtaaagtttagaagttgtatgcagacaccgttaaaagttgtagctaaaactaagttttcatgaagttggtgaggatccgttgttggcttatttacttttcaacatcaggataaaaaatctgtaatactaaaaatgttaaataatttcagttgccaaattttcagttgaaatgtcaatatataatttatttcttaatttgcatggctttttaggtcatttattatctggggataatccataccatgattgttaatgcaagtaaagaaccatttgaggtgacatttaggttttaaaatattttgtatatattttttaatgatagtatttgtcagttgatgaaatgacgaggctcatgaatttggaaaggagaactttatttctcatcagcagttgcaacctgcagcatggccattctgacaggctgggaagcatagccttcggccaaccaggagccagaaacttcaaggtgttggggaagggaacaggaatttatgctgagtgaagtggctgaatatacgtatttaataagcatagaaggagtcatgaatatttatgaaaggagaaacatccatgcacaattgagttttatgccccttcatgggtcccatgtacaaaaaatgtcagcgttagcatgatccaagggtagagttttcagccctctgacatcaaaaagtaaagcagaggacacaaaaaccttttggacagaagcatcaggtggttggttggtatcagtgctgacatcttctgaagggctggtttctgtttagcccttaggctaaatagtggttagccagggagggaggaggtataatgtggtgtgtctgatttccccatccactcatggccaagaactcagttttcaaggcactttggggtccttggccaagagatccattcagttggttgggggacttagaattttacttttattcctcatgtgtatctttttttaaataactaaaaaaaaacaataaagttatttaaaaaatttttggaatcaaaagttgtgggggttgatgatgggagaaggactagaaaacgaaacacatgctatatccaggactggacaaccaagagttaaaagagtatgattattggctcattttttttactatttaaatgcagttttcgctgggtgcagtggctcatgcctgtaattccagcactttgggaggccgaggtgggcggatcacgaggtcatgagattgagaccatcccagccaacgtggtgaaaccccatctctgctaaaaatacaaaaattagctggacatggtggcacgtgcctgtagtcccagctatttgggaggctgaggcaggagaattgcttgaacctgggaggtggaggttgcagtgagctgagatcgtgccactgcactccagcctgggcgacagagcaagactctgtctcaaaaaaaaaaaaaaaatcagtttttatgtatttgtatgcgaatgtggtacaaaattggagagatgttattgagggaaaaggaatttgctgtgtaacaaaaaagccctcttctcaaataccttagagcagttgttttcagaaatcccagctgtagccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaaaaaactttctagatccagaagaaaattaggttgaatgaaaagagggccaatttgaaggtatatcataataagtttgcaaatatcaagaataaggatatacttcttcaagcatttaaatatgagaaaatgacaacaaaaatcaaagtaaccttagttttcttctctgtatatagtatagcaatatttataagggtttaataaatagagctaaaatatttaatgcctagacaagatgttcatttataaagagaacatagacatactcagacctgaataattacataaaatatttctcccaaatatttcttttaatacaaaagttcttaaagatcatttctggatcagaaaaatgggtcaaaattaaaacaatttacaagaattttgtggttagaaagtaatgagtagctgacacaaaagtctctaagacattgtgaaatgaaaagagtaatgcatatactataaccatatctatatttaaagaaagactttaaaagactagtacatacataaacacacaaacacacacaaaaagcagaatggtggtattgtctcactctggtgaaggacagtggaaggaaacaaggagaaccttctaattctttatgcatttgttttgttagaatattgtgcaaagtgtttagctgttgtgtgatctctccataaaggcagagtttattatgattgtgaaaatcagataaaagttaaagaatgtacaaaactaaagtaaccggccaggcgtggtggctcacgcctgtaatcccagcactttgggaggctgaggcgggtggatcacgaggtcaggaaatcgagaccatcctggccaacatggtgaaaccccatctctacttaaaaaatacaaaaaaattagccgggtgtggtggcgcacgcctgtaatcccagctactcaggaggctgaggcaggggaatggcttgaacctgggaggcaaaggttacagtgagctgagatcacaccactgcactctggcctgggggcagagcaagactctttctcaaaaaaaaaaaaagaaaaaaagaaaactaaagtaatcattagtataattataaagagtatctgccaacatagtttgtacagtaaacatcaagataaatagtaatagcaagataacaagaatcaactctgaaaagtcaaaaatcctttgttaaaaagcagagatatgaaaactccaaagacttgatgcttaaaagagacatacttacaataaaattatacattattaaaaattatgggctggatacagtggctcatgcctataagcccagcactttgggaggccagggcagaagagtagctgccttgagccaagagtttgagaccagcgtgggcaacatagtgagaccctgcctccacaacacaaaaaaactaaaaaattagccgagcatggtgggatgttcctgtagtcctagctattctggaggctgaggtgaaggaattactttagcccaggagttagaggctgcagtgagctatgattatgcttgggccacagagcaagaccctgtctctaaaaagagataagatgccaatatattattactatttgtattggtggttctaggcaatataacaaggaaaataaatttcaagtcctaagaattggagaggaaaaaatgaaagtgtagttattcgtcatgtgtatagaaaccccaaagaatctatagatgaaatattcaaagtaaaaagtgagaattaataatttattaggctataaaagtctcaacaaatttcataggttcacattacatagaatgttatagtggattttattagtttgttctctcattactgtaaagaaatctctggggactgggtaatttataaagaggtttaataggcttacagttttgcagactatacagaaagcatagtggcttctgcttctggggaggccccagggagctttcagtcatggtggaaggcaaaatggaagcaggcatctaacatggcagaaacaggaccaagagagaagtagcagggagggctacacacttttaaacgaccagatcttaccatgaaaaacaatgtggagattccttaaagaactaaaagttaggctgggcgtggtggctcatgcctgtaattccagcactttgggaggcctaggcaggcggattacctgaggtcaggagttcgagaccagcctggctaatatggtgaaaccccgttccctaaaaatacaaaaattagccaggcgtggtagcaggcgcctgtaatcccagctactcaggaggctgaggcaggagaattgcttgaatccaggaggcagaggttgcagtgagccgagatcgcaccactgcactccagcctgtgtgacagagactccgtctcaaaaaataaaagtaaaataaaaataaaaaaagaaccaaaagtagaactaccatttgattcagcattctcactactgggtaactacccagaggaaaagaagtcattatacggaaaagatacttggacacacatttatagcagcataattcacaattcaaaaaatatggaaccagcccaaatggccatcagtcaatgagtggataaagaaactgtgagatagatatagatatggatatatgatggaatcctactcagccataaaaaggaatgaatgaatagcatttgcagcaacctggatggagttggagagtattattttaagtgaagtaactcaggaatggaaaaccaaacatcttatgttctcactcataagtgggagctaagctatgaggatgcaaaggcataagaatgatacagtggactttgaggacttatggagaaaggctgggagggggctgagggataaaagactacaaattggattcagtctatactgctcgggtgatgcatacaccagaatctcacagatcaccactaaagaacttactcatgtaaccaaataccacctgttcccccaaaacctatagaaataaaaatttttttaaaaagtaattgcagttttacccattactttcaatggcaaaaaccgcaatttacttttgcatcaacctaaaaaataaaaagatctcatgagaacttatcgcaatgatagcaccaagtggggtgatgttaaactatgagaaaccatccctgtgatccagtcatctcccaccaggccctacctccaacactggggattacaattcaacatgagttttgatggggacacagaatcaaaccatataatggaattaagctagatatcagtaacaaatagtaactagaaaattcccaaatgtttgataattaggcagtatacttctgactgaaagagaaattcacattagaaaatatttttaactgagtgataatgaaaatattacatatcaaaatgtaggtttcctgtgctgagagggaaatttttcaccttaaatgcatctcttgaaagactgaaaatcaaggaatagtgacctaaagtattcatctcaagaggttagagaaagaacagcaaaattgaagcccaaggtaggtcaaagtggatattagtaaaactggaaatacctacaataaaattaacaaagccaaaagttaattgtttgaaaagttatttaaattgataagcccctcataaaatcgagatgaattaaaaaggagatattaccagagaatatgacattagaaagagaaggggattttctgaataacttcaccaataagttagagaatttgggcttaaaaatgagcaaattattagaaaaacatagattactaaaattgacacaagaagcagtaaatcagaatggtactatctttattaatgaaattgagcttattactaaaaacccaacaaaataaactccagaaccaaatgtgtttactggtgaattcttcccaacaaaggtagaagtgaaaaccttttaggttgtttataagggtagtaaacctgatacccaaaactaacattttttaataccaaaacccaacaggaaatataagaaagaaaaataaatacaagaaagaataataaatcatgatgagttgggtctattcaatgaatgaaagcaagctaggtttaacattcacaaatcaatgatagtcatcatatttataaaaataataggtaaatttaataaaagtggctagacacaagaattaatgtaccagtgtcattagcacaacattgaaaggatgatctgttaaaaagtaattgatgaatgacctaatcacaagttctgttcttggaaggttaaagttaatattataaaatagagggagaaaatgtttgcagattaatccttgataaaaggacttacatccagcatatatttttaaaaactaaacattcactaattagacaacccaatttttttaattggcagaattttaatagacatggctccaaagaggatatatggcaaataaatacatgagaaacggatttttagccatttgttaaacctctatgggccctctggttccagagggaatttaattaatttttaagttcaaagtaattttgttttttaaaaagtgatttcagctctgtgttttgctgctgttcctcctgtaaggtaatgaatggtctttgtaatccagtgtcccgacatccctaccacccacatgaataccttttctgcgtggccagtagacaaggtcggcaggtggatgttgtcatcttaactggggaatcatgaactggcaagaagggctgttctggcccatggcaaagtcaacactgagtgttctttcccaaagctgcatttttataagactgctttaaggggagaattacatgaaatggaaacaggcatctgtagtggaccatttgaaaagccctttattttcagttgtgacttaaccagctgccatttgtacagcatttgaatcaggagtgagactaagatttcctaacagaataatttgaagactgaaagaattacattaggactctgtaacatcaggaactattttaggggaaggttgtagtgggtttcctatgagttttcacacaaggctgtcatgtgagaataggccatgtgcagtggctctttgggagatcaaggcgggtggatttcttgagcccaggagttcaaggccatcctgggcaacaacatgataaaatcctgtctctacaaaaaaataaaaatagccgggtgtggtggtgtgcatctgtagtcccagctacttgggaatctgaggcaggaggatcacttgagcatgggaggttgaggcagcagtgagccgtgattgtgcactccagcctgggtgacagtgagaccctgcctaaaaaaaaaaaataaaaacacaaaagagaataggctccaaacacgtttaggaaaccagtttttatgtaggggaagtctcaggtcaataatagggagatagagtgaaaaagtcagttagcctgggaaaagaggcttctttctttaactgtatggaggatttagtgagagggaatgctagaagaaggtcaaaacaattgttacagtgtgtcttgtgttatacacaaatatgccttactcaccttcaactaaatgcatgcagtaaaccaaaaggaatgcagttctacctactacctctccccatctcccacccccatgtttttcattcttctaactgaatgcacattgggagagacttgtgaaaaagaatgtaagaataatgtaaagcctttcccagtcaacgacagaaatgaaatgcagttaagtggtagtagctttgtaagacatccttgagtaagaaattaaagactcaactgagagatctaattgttcagttatcttagggttatgaatatagataaaacattttgagtgtttaaggaatttttaagggtaattttaacttttgtctaatccctgaataatttgcaatgccactacactaaaatatggaatcagatctggttacatcaaacttaaacaaatatacagcatccactcttttagcttccctgggtcacactgcaagaagaaaaacggtcttgggcaacagatgaaataaactaacactgtgatagctgataaacttaaaaaaaattgcaaaacactttcataatgttttaaggaagtttacaaatttgtgttgggccacattcaaagctgtcttgggccacaggttggacaatgctcgtttttcttttcccattttgacctctaaaacatttcttgaggtataaaaattgttaaatcttttacctaaagataatgttccttttgaagtgattgttttagacttaaataagttggatggtttttaatctggttagaatgtaggaggacctgagatagaaggatctttactttttgtataaatatttcttctgatcaaaacagtgagttgtaaactatgagctttgtgatcttttctggtaaaaacaagggaagaaagtaacattgtgaggtatatcgtcattgtaggattctgtcaaacagtttttcttaattatgtcttgtagttatttcatgtaatgaaatgttttgttgtttgcctgttgcatttcagaagaatttgagtagaatatatttttttccttttttaaaagagtatcctaaactcatcaattaaagtggcagcaaacttttatgctactgttttcattttttactttttccttaagattcaaagactcgttctggacacagtatatttttgttattgaaacatcataggctgtgatagagctgtagtagcagaaacctagaagacagaggttctcctagagagagacatgattcaatagggaaagtctcttgctctcacacatctttctatattctccttgttcttggtccaaagacaatattccaaatgttgtattccaaagccaaatgtaaaacaatattcatctgttttaaattaataactctttcagcctctaaaagagacttagaattttgaaaaacaatatttttgagacagggtctcactctgttgcccatgctggagtgcagtggcatgatttcagctcactacaacctccacctcccgggttcaagtgatttgtgtctcagcctctcaagtagctgggattacagacatgcaccaccacagctggctaattttttttttttttttcagtagagatgagattttgccatgttggccaggggctggccttgaactcctgggctcaagtgatctgcccatgtcagcctcccaacatgctgggattatagtcatgagctgctgcatccagctgaattttgaaagtcttttaattgttttggagaaagaattttctgtttttcattagaaaattcccttcccttacacttagatatcttattatatatctctgatctagtatatttaaaatatgattctgagaatcagaatatatctacttaattctttgaattcaaattcgtttgaagttattgctcctcttacagataaatgcctcagtggattaaatctgtatgttactttggcaagatttgcacatattaagtgattagaaaaagagaactgaactttagatggcttttatggctgttgtttaggaaacagtactgctggagcaccctttcagtgctgtgaaacaagaactgcaaagaaaatggattgaagagttgaataagcaaatagaagatgaccgtcaaagaaaaatagaggaaaaaattatatattcaaaggtaacttatgaggttttgtggctataaaagaaaaaataaaatcaaagtctttaatcaattaaaactagaagtattctgaaactcttgacaagaccagaatattccatttattccacatttgcccatgtgaacctgtttcattgaatgcattatgtgatgttgcatagcttcttacaactttttagaaatttcctaattctttgaatttctcaaattttcaaagctagtgatctatatgtataaggactctaaacagtacagtcttgttaatttttatgatgcttattctgctctaaggtgacttttagaaatcatctttggttgtcatttagaattatatatgagaataattggaaaaattcttagcaattcttatttgtcatcattagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaagtaagttcatgcttatgtatttattgacttttcagaaagtctgtgtgctttagtaagactgttgttatgtctaattggtttcaggtttggtatttgtctttgaaatagaaataattagtagatttatcccaaacaaaaatgatttagcttgttgaatctacctttttgaggttttgaatagctaatgtatgtatcttgccagctttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgccttccagtacagaaggtctttaatatattaagttgtatatgtgaatttgtgttgtcttaggttagtactggtttttttttttttcatcaatttatttctcctgagttctgtttaagatgagaattcattctttgaatagggattgaactagaattatgactaagaaatctaatgcataatggccgggcacggtggctcacgcctgtaatcccagcactttgggaggctgagtgggcagatcacgaggtcaggagatcaagaccatcctgtgaatggtgaaaccccgtctctactaaaaatacaaaaaattagctgggcgtggtggcaggcgcctgtagtccccagctactcgggaggctgaggtgggagaatggcatgaacctgggaggcagagcttgcagtgagctgagattgtgctactgcactccagcctgggcgacagagtgagactccatctcaaaaaaaaaaaagaaatctaatgcataatataagaaaggaggctaaaattaaaattaaaacttcctgtcctgattttagcctaatgctaaagggactttaatatctgcataattcttcaaatcctttgatatatgaatttggcatcattaatgttatgcttagtcagtgagcagacatttgcagagcatctgctacttaacaggcactatgctaagcactgagattatttcttcagttttttttaataccatttcctccagtagccctcctagggttgaagaaaaggcatgtagaacttgacagtacaaatgggagatgggagaaatgcattggaaatttgacatttccacttcacttatataaataatactttcagtatgctgataaaaacttatttctacagtcaccaaactaatgcttcatggattttaaaaattgatatataatgttttatatatttataggatacatatgatattttgttatatatgtagaatgcgtaatgattcagccagagtattctggtatctatcaccttgagtatttatcatttctgtgttgggaacatttcaagtttactagccaatttgaaatatataatacattgttgctgaccatagtcaccttactattgctatcaaacattagaacttattcctttcatctaaccatatgtttgtacccattaacctacctctcttgatcactaccaccctcacacacacccttcccagcctttgatacctatcattccattctttagctcgttgagacctacttttttagctcccacatatgagtgggaacatgtgatgtttatctttatatacctggcttatttcacttaacataatgacgtccagtcccatctgtgttgctgtaaatgacaagattctattctttctttatggccaaatagtatcccattgtgtatataccacattttgtttatctatttgttcatcaatggacactcagattgtaaatagtgctacagttagcacaagagtgcaggtttccttttgatatacagatttcatgttctttcgataaatatccagtactgggaatgctggatcatatggtagttccatttttagttttttgagacgtctccatactgttttccatagtgactgtatttatttacattcccactaacaatgtataaggattcccttttctccgcttccttggcagtatctgttagtttttgtcttttggtatgtttgtttgtttgcttgtttttgagacagggtcttgctctgctgcgcagtctggtatgcagtggcataatcatggctcactgtagcctcatacccctgggctcaagcaatcctgctgcccgagcctccccagtagctgatattacaagcatgcgccaccatgtcaggctaatgttaatttttttcttttatagagacacagtctcactatgttgaccagactggtttcgagctccttgcctcaaacagtcctccaacctcagcctcccagagtgctgggattacaggcatgagccaccgggcccagcatttttgtctttttagtaatagccattctaactgaggcgatatgatatctcattatgggtttgatttgcatttctgtgattagtaatgttgagcattttttcatgtacctgtttgccatttatatgtcttctttagaaaaatgtttattaatgttctttgcccactttttaatggaattatttggatttttggtgtgtgtgtgtgtttagtttgagtttcttaggcattctggatagtagccctttgttggatgaatagtttgcagatattcaaactactgaatatgcaagctattgaatattcaaactactgaatattcaaactgggggacagactgtctctttcactctggttattgtttcctttcccgtgcagaagatttttagttcaatgtagccctattcgtatgtttttggtccctgtgtttttgaggtctcgaccacaaactctataccagtgtcttgaagtgttttccgtatgttttcttctagtaggtttacatttttgggtcatacatttaactatttaatccatcttgaattttttttttttttttttttgaagtggagtctcagactgtcaccctggaatgcagtgacgtgatcagctcactgccgcctccacctcccaggttcaagcaattctccctgctcagcctcctgagtagctgggattacgggtgcatgccaccacacctggctaattttttttttttttttttagtacagatggggtttcaccatgttggccaggctggtcttgaactcctgaccttaaatgatccacctgccttgccctcccaaagtgctaggattacaggcatgagctaccacaccagcccttgaattgttttttgaatatggtgagagatggggctccaatttcattcctctgcatatagatatccaattttccaagcattatttattgaagagtgtgtgctttccccaactatgttcttgacacttttgttgaaaatcagttggctgtaaatacatggatttatttctggattccctattctgttccattgatctatatgtctgtttttataccaataccatgctgttgtggttcctatagtcttgtaatgtattttgaagtcaggtagtgtgatgccttcagctttgttcttttgatccaccttgatttggttattacggctcttttttggtttcatagaaagttttgaattttttctacttctgtgaaaaatgaaggtggtattttgatagagatagcattgaatttgtagattgccttaggcataattcttctgatccatgaacatgggatgtcttgccatttgtttgtatcctctttcgtttatttcatctgttttgtagttttttatgtagaaatgtgtaacccccttggttaaatttattcctagatattttattgttttgtagctattgtaggtgggattgccttctttatttctcagctagtgtatagaaatgctactgatttttgtatgttgattttgtattctgcaactttactgaatttattgatcagatgtgaggtttttgtggagtctaggttttgttttggggtttttttttttttttgagacagagcctcgctctgttgcctaggctggagtgcagtggcgcgatctcatcccactgcaacctctgcctcacaggttcaagcgattctcctgcctcagccttccaagtagctgggactacaggcatgtgccaccgcaccttgtaatttttgtatttttttagtagagatggggtttcgcagtgttggccaggctggtctcgaactcctgacctcaggtgatccacccgccttggcctcccaaagtgctgggatttcaggcatgagccactgtgccagtggagtctagggtttttaagatataagatgataacatcagcaaaggggacgttttgattttagtttgttttgttttgttttgtttgtttgtttgtttgtttgtttgttttgagacagctctgtcacctaggctggacttcagtggcacaatgttggatcactacaacctccaccttctgggttcaagcaattcccatgcctcagccacccaagtagctggaattacaggtgtgtgccaccatgcctgggtaatttttgcataggggactttttattttattttatttattttctattttatttattttatttattttctaatttaggtgccttttatttatcttgcctggttgctctggctaggacttctgttgctatgttgaataagaatggtgaaagtgggcatccttgttttgttttagctcttaggggaaaggctttcagcttttccccattaagtatgatgttagctgtgggtttgtcatatatagtctttattattttaaggtatataccttctgtgcctagtttgttgagagtttttattatttagtgatgttgaattttgtgaaatgttttttcttgtctactgagatgatcatatggtttttgtctttcattctgttgatgtgatgtatcacatttattgatttgtgtatgttgaattctgcctgcatccctgggataaatcccacttaattattgggtattagttttctcatgtgctgttggattgagtttgctagtattttgttgagaatttttgcatctatgttcatcaaaaatagtggcctgtaattttctttgttcttttttgttgtgtccttctctggctttggtatcagggtaatgctggcctcacagaatgagttagggaaaattccctcctctttgatttttttggaatagtttgggaagaattggttagttctttgatagtttggtagaattcattagtgaagttgtctggtcctggactttcctttgttgggagacttttttattaccaattcagtcttattactcattactggtctgttcaggttttctatttcttcctgattcaatcttgatagcttgtgtgtctccaggaatttatccatttcttctagattttctagtttgtctgtgtgtagttgttcataatagcctctgatgatctcttgtatttctgtggtatcagttgtaatttctccttttttattcctgattttatttgggtcttctctcttcggttcttggttagtctatcaagtagcttattggttttgtttatcttttaaaaaatctttgtttctttgatcctttgtattgtgtgtctctattttgtttaattctgctctagtgtttgttatttctttccactaatttggggtttgttcttttctagttccttttaggtacatcattagattgctttttgaaatgtttccacttttttgatataggcacttattgctaaaatttccctcttagcactgcttttgctgtatcccataggttttggtatgttgggtttaaattttcatttttttcaagaatttttttaaattttttccttgactggatgcttgttcagaagcatgtggtttaatttctatttattggtacagttgccagtgttcctctcattattgattactggttttgttccattgtggtttgagaagatacttgatatgaagtcagttttttaaagtttgttaagatttgttttgtgtcctaacatatgatctgtcctggagaataatccttatgctaatgaaaagaatgtgtattctcttaactgttggatgagatgttctgtgtccatgtgttctcatggttcaactcccacttatgagtgagaacgtgcagtgtttggttttctgttcttgtgttagtttgctgagaattatggtttccagcttcatccatgtccctgcaaaggacatgcactcatccttttttatggctgcatagtattccatggtgtatatgtgccacattttctttatcgagtctatcattgatgggcatttgggttggttccaagtctttgctgtagtgctgcaataaacatacatgtgcacttatcttttttttttttttttttgagacagagtcttgctctgtcgccaggctggagtgcagtggtgcaatctcagctcactgcgacctctgcctcccgggttcaagtgattctcctgccccaccctcccaagtagctgggattataggtgcccgccaccgtgcctggctaatttttgtatttttagtacagagagcatttcaccatgttggccaggatggtctcaatctcctgaccccatgatcgggctaccttggcctccaaaagtgctgggattacaggcatgagccaccgcgcccggctgcatgtatctttatagtagaatgatttataatcccttcggtatatacctagtaatgggattgctgggtcgaatggtagttctggttctggatccttgaggaattgccacactgtcttccacaatggttgaactaatttacgctcccaccaacagtgtaaaagcgttcctatttcaccacatcctctccagcatctgttgtttcctgactttttaatgatcgccattctaactggcatgagatggtatctcattgtggttttgatttgcatttctctaatgaccagtgatgatgagcttttctccatatgtttgttggctgcataaatgtcttcttttgagaagtgtctgctcatagtcctttgcctactttttgatggggttgtttttttcttgtaaatttgtttaggttctttgtagattttgaatattagccctttgtcagatgggtagattgcagaaattgtctgccattctgtgggttgcctgttcactctgatgatagtttcttttgctgtgcagaagttctttagtttaattagatcccatttgtcaatttcagcttttgttgccattgcttttggtgttttagtcattttgtccatgcctgtgtcctgaatgatactgcctaggtttacttctagggtttttatggttttaggtcttacgtttaagtctttattccatcttgagttaatttttgtataaggtgtaaggaaggagtccagtttcagttttctgcatatggctagccagttttcccaacaccatttatgaagtaaggaatcctttccccattgcttgtttgtgtcaggtttgtcaaagatcagatggttgtgggtgtgtggtgttatttctgaggcctctcttctgttctattcatctatatatctgttttggtaccagtaccatgctgctttggttattgtaaccttgtagtatagtttgaagtgagacagcatgatgcctccagctttgttctttttggttaggattgtgttggctgtttgggctgttttttgattccataggaaatttaaagtagttttttccaattctgtgaagaaagtgagtggtagcttgatggggatagcattgaatctgtacattactttgggcaatatggtcattttcacaatattaattcttcctatccatgagtatggagtgtttttccatttgtttgtgtcctcttttatttccttgagcagtggtttgtagttctccttaaagaggtccttcacgtcccttgtaagttgtattcctaggtattttattctcttagtagcagttgtgaatgggagttcactcatgatttggctgtttgtctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagagacaacttaacttcctcttttcctatttgaataccctttatttctttctcatgcctgattgccttggccagaacttccaatactatgttgaataggagtggagagagagggcatccttgccttttgccgtttttcaagggaatgcttccagtttttgcccattcagtatgatattggctgtgggtttgtcataagtagctcttattatttttagatacgttccatcaatacctagtttattgagagtttttagcatgaagggatgttgaattttgttgaaggctttttgtgcaactattgagataatcatgtggtttttgtcattggttctgtttatgtgaatagattacgtttactgatttccatatgatgaaccagccttgcatcccagatatgaagccaacttgatcgtgctggataagctttttgatgtgctgctggatttgatttgacagtattttgttgaggatttttgcatcaatgttcatcagggatattggcctgaaattctctttttttgttgttgttgtgtctctgccaggttttggtatcaggatgatgttggtctcataaaattaattagggaggattccctctatttctattgattggaatagtttcagaaggaatggtaccagctcctctttgtacctctggtagaattctgctgtgaatccgtctggtcctggacttcttttggttggtaggctattaattattgcctcaatttcagacctggttattggtatcttcagggattcgtcttcttcttggtttagacttgggagggtgtatgtgtccaggaatttatccatttcttctagattttctagtttatttgtgtagaggtgtttatagtattctttgatggtagtttgtatttctgtgggaacagcggtgatatcccctttatcattttttttttttttttttgagacagagtgttgctctgtcacccaggctggagtgcagtggcatgatctcggctcactgcaagctctgcctcccaggttcacgccattctcctgcctcagcctcctgagtagctgggactacaggcgcccaccatcacacccagctaattttttgtattttttagtagagacggggtttcaccgtgttagccaggatggtctcaatctcccaacctcgtgatccacccacctcggcctcccaaagtactgggattacaggtgtgaggcacggcacccggccccctttatcattttttattgcgtctgtttgattcttctctcttttcttcttattagtctggctagtggtctgtctattttgttgatcttttcaaaaagccagctcctggattcattgattttttttgaagggtttcgtgtctgtatctcctacagttctgctctaatcttagttatttcttgtcttctggtagcttttgaatttgtttgctcttgtttctctagttcttttagttgtgatgttagggtgtcaattttagatctttcctgctttctcctgtgggcatttagtgctataaatttccctgtaaacactgctttaaatgtgtcccatagattttggtacgttgtctctttgttctcattggtttcaaataacatctttatttctgtcttaatttcgttatttacccagtagtcattcaggagcaggttggtcattttccacgtagttgagcggttttgagtgagtttcttaatcctgagttctaatttgattgcactgtggtctgagagactgtgtttttatatctagttttttttgcatttgctgaggagtgttttacttccaattgtgtggttaattttagaataagtgtgattaagtcctcagaagaatgtagattctgttgatttggggtggagagttctgtagatgtctattaggtctgcttggtccagagctgagttcaagtcctgaatatccttgttaattttctgtctcattgatctgtctgatattgacagtgggatgttaaagtctcccattatcattgtgtgggagtctaagtctctttgtaggtctctaaggacttgctttatgaatctgggtgcttctgttttgggtacatatatatttaggatagttagctcttcttgttgcattgatccctttaccattatgtaatggccttctttgtctcttttgatctttgttggtttaaagtctgttttatcagagactaggattgcttttctttctctccgtttgattggtaaatactccttcatccctttattttgagcctatgtgtgtctctgcgtgtgagatgggtctcctgaatacagcacactgttgggtcttgattctttatccagtttgccagtctgtgtcttttaattgggacatttagcccatttacatttaaggtttatattgttatgtgtgaatttgatcctgtcattatgatgctagctggttattttgctcattagttgatgcagtttcttcatagtgtcgatggtctttacaatttggtatgtttttgcagtgggtggtaccagttgttcctttccatgtttagtgcttccttcaggacctcttgtaaggcaggcctggtggtgacaaaatctctcagaatttccttgtctataaaggattttatttctcctttgcttatgaaactgagtttggctggatatgaaattccgggttgaaaattcttttttttttttaagaatgttgaatattggccccaactctctcctggctcgtagagtttctgcagagagatccgctgttagtctgatgggcttccctttgtgggtaacccgacctttctctctggctgcccttaacattttttcctccatttcagtcttggtgaatctgatgattatgtgtctttgggttgctcttctccaggagtatctttgcatttcctgaatttgaatgttggcctgtcttgctaggttggggaagttctcctggataatatcctgaagagtgttttccaacttggttccattctccctgtcactttcaggtacactaatcaaacgtagatttggtcttttcacatactcccacatttcttggaggctgtgtttgttctttttcattcttttttttctaatcttgtctttttgctgtatttcattaagttgatcttcaatcactgataccctttcttacgcttaatcagtttggctattgatacttgtgtatgcttcacaaggttcttgtgctgtgtttttcagctccgtcaggtcatttatgttcttctctaaacggttattctagttagcaatttgtctaaccttttttcaaggttcttagcttccttgcattgggttagaacaggctcctttagctcggaggagtttgttattacctaccttctgaagccttcttctgtcaattcgtaaaactcattctctgtccagttttgttcccttgctggcaaggacttgtgatcctttggaggagaagaggcgttctggtttttggaattttcagtctttttgtgctggtttctccccatcttcatggatttatctacctttggtctttgatcttggtgacctttggatggggtctctgagtggacatcctttttgttgttgatgctaatcctttctgtttgttagttttccttctaatagtcaggcccctctgctgcaggtctgctggagtttgctggaggtccattccatatcctgtttgcctgggtatcaccagcagaggctgcagaacagcaaagattgctgcttgttccttcctctggaagcttcgtcccagaggggcacccgtcacatgccagccagagctctcctgtatgaagtgtctgtcagcccctactaggaagtgtctcctagtcaggatacatgggtgtcagggacccacttgaggaggcagtctgacccttagtagagctcgaatgctgtgctgggcgatccactgctctcttcagagccatcaggcagggacgtttaagtctgctgaagctgcacccacagccaccccttccccctggtgctctgcctcagagaggtaggggttttatctataagcccctgactggggctgctgcctttttttcagagattccctgtccaaagaggaggaatctagagaggcaatctggccacagcagccttgctgagctgcggtgggctctgcccagttcgatcttccaggccgctttgtttacactatgagggtagaaccacctactcaagcctcagcagtggtgggtgcccctcaccccaccaagcttgagagtcccaggtcaacctcagactgttgtgctggcagggagaatttcaagtcagtggatcatagcttgctgagctccctggggataggaccctccgagcctgactacttgcaaggctccctggcttccgccccctttccaggagagtgaacagttctgtctcactggcattccaggcaccactggggtatggaaaaaaaactcctacagttagctcggtgtctgcacaaacggccgcccagttttgtgcttgaaatccaggccctggtggcataggcaccagagggaatctcctggtctgcgggtggcgaagactgtgggaaaagcacagtatctgggccagagtgcaccattcctcacagcatggcacatccctcatggattcccttgggtagggaagagatttccctgaccctttgcactttctgggttgaggtggcgcctcaccctgcttcggctcgctctctgtgggctgcacccactgtccaaccagtcccaatgagatgaactaggtacctaagttggaaatgcagaaatcacccgccttctgtgtcgatcttgctgggagctacagaccggagctcttcctattcggccatcttgccaacaaccctccatcttctagaatttttatagtttcaggtcttaggtttaagccctgaatccatcttgagttgatttttgtataaggtgagagatgaggatccagtttcattctcctatatgtggctagccaattattccaacaccatttgttgaaaagggtgtcctttccccacttcatgtttttgtttgctttgtcgaagatcagttggctgtaagtatttgggtttatttctgggttctctgttctgttccattggtctatgtgcctatttttatatgagtaccatgctgttttggtgactgcggccttatagtatagtttgaaatcaggtaatatgatgcctccagatttgttctttttgcttagtcttgctgtggctatgtgggctcttttttggttccatatgaagtttagaattgttttttctaactctgtgaagaatgatggtggtattttgatggggattatgttgaatttgtagattgcttttggcagtatggtcattttcacaatgttgattctacccatccatgagcatgggatgtgtttccatttgtttgtgtaatctgtgatttctttcagcagcgttttgtagttttccttatagaggtctttcgactcctttgttaggtatattcctaagtattttatatatttttttgcagttgtgaaagggcttgagttcttgatttctctgcttggtcgctgttggtatatagaagagctactgatttgtgtccattaatcttgtatctggaaactttgcagaattattttatcagttctaggagctttctggaggagtcttacagactcctaaggtaaacagttatattgtcagcaaacagggacagtttgacttcctctttactgatttggatgccctttatttatttctgttgtctgattgttctggctgggacttccagtactacgttgaagaggagtgatgagagtgggcatccttgtcttgttcctgttctcagagggaatgctttcaacttttccccattcagtattatgttggctgtgggtttgtcatagattgcttttattacattaaggtatgtcccttgtatgctgattttgctgagggttttgatcataaaggatgctggattttgtctaatgctttttctgcatctattgagatgatcatgtgatttttgttcttaattctgtttatgtggtatattacatttattgagtatgttaaaccatccctgcatccctggtatgaaacccacttgatcatggtggattatctttttgatatgttgttagattcagttagctagtattttgttaaggattttagcatctatgttcatcaaagatattggtctgtagttttcttttttgggtgtgtcctttcctggttttggtattagggtgatgctggcttcatagaatgaattagggagggttccttctttctccatcttgtggaatagcgtcaaaagaattggtaccaattacctgaatgtctggtagaatgctgctgttaatccatctggtcctggactttttttgttggtaatttttaaattaccatttcaatctcactgcttgctattggtctgttcagggtatctaattctgatttaagctaggagggttgtatttttccgggtctttatccatttcttctaggttttctagtttatgtgtgtaaaggtgttcatagtagccttgaatgatcttttgtatttcagtggtgtcagttgtaatatctcctgttttgtttcttagtgaggtgtttggattttctctgttcttttcttggttaatcttgctaatctatccattttatttatcttttcaaagaaccagctttttgtttcatttgtcgtttgtttcaatttcatttagttctgctctgatgttggttgtttcctttcttctgctaggtttggtttgttcttgtttctccatttccttgaggtgtgaccttagattgtctgtctgtgctctttcagacttttttgatgtaggtgttttagggctatgaactttcctcttagcactgtcttaactgtatcccaaaggttttgataggttgtgtcattactgtcgttcagttcaaagaatttttaaattttcatcttgatttcatttttggcccagtgctcattcaggagcaatttatttaatttccatgtatttgtgtggttttgaaggttccttttggagttgatttccacttttattccactgtggtctgagagagtgcttgatataatttcagttttcttaaatttattgaggcttgttttatggcctgtcatatagtctattttggagaaagttccacgtgcttttgaatagaatgtgtattctgtggttgttagactaaatgttctgtatatatctgttaggtccatttgttccagggtatagtttaaatccattgtttctttgttgactttctgtcttgatgacctgtctagtcagtggagtattgaagtcctccactattatggtgttgctatctcatttcttaggtctattagtaattacaagtttgggagctacagtgttaggtgcatatatgtttaggattgtgatgttctcctgttggaccaggccttttactattatgtaatgtccctctttgtctcttttaaccactgttgctttaaagtttgttttgtctgatataagaatagctatcctgtttgcttttggtgtgcatttgcatgaaatgtgtttttccgctcacataaacttaaagtttaggtgagtctcctaagagggcagatggttggtaagttcttatccattctgcagttctgtatcttttaagtggagcctttaggccatttacattcaatgttaatattgaaatgtgaggtactgttgcattcatcatgctgtttgttgcttgcgtactttggatttgttttttgtttttgttttttaacttgtatttttgttttataggtcctcctgtgtgatttatgttttaaagagattctgttttgatgtgtttccaggatttgtttcaagatttagagctccttttagcagttcttttagtggtggcttggtaatggcgaattctctcagcatttgtctgaaaatgactatatgatgcttagttttgccaaatacaaaatttggctgataatttttttgtttgaggaggctgaagatagggccccaatctcttctagcttgtagggtttctgctgagaaatctgctgttaatctgataggttttcctttataggttacctggtgcttctgtctcacagctcttaagattctttccttcgtcttcactttggataacctgatgacactgtgcctaggcagagatctttttgtgttgaatttcccaggtgttctttgtgcttcttgtgtatgcatgtctaggtctttagcaaggccagggaagttttcctcaattattcccctaaatatgttttgcaagcttttagaattgtcttctccctcaggaacaccaattattcttaggtttggtcatccgagctctgaatttctttcttctacttgttcaattctattgctgagactttccagagcatttcatatttctaaaagtgtgtccactttctttgagctctaaatttctttcttctccttgttcaattctgttgctgagacttaccagagcatttcacatttctaaaagtgtgtccaaagtttcctgaatttttggttttttctttaagctatctatttcactgaatatttctccctttacttcttgtatcatttttctgatttccttgcattgggcttcgcctttctctggtccctctctgattagcataataactaacctcctgaattctttttcaggtaaatcagggatttctttttggtttagatccattgctggtgaagtagtgtgatttttgggggggtgttgacgagccttgttttattatattaccacagttggttttctggttccttcttatttgggtaggctctgtcagagggattgtctagggctgaagagtgttgttcagatttttttgtcccacagggtgttccctatgtattacgcttcccccttttcctgtggatgttgcttcctgtgagcctaactgcagtgattattgtctgtcttctgggtccagccacccagtgagtctacttggctccgggctggtgctgggagttgtctgcacagagtgcttatgtgaactgtctgtggctctctcagccgtggataccagtgcctgttctggtggaggtggtggaggatgcagtggactccgtgggactccttagctttgatggtttaatgctctatttttgtgctggttggcctcctgccaggaggtggtgctttccagaaagcatcagctgtagtagtgtgtggagagggaccagccatggtgagggccctagaactctcaagattatatgtcttttgtcttccgataccagggtggatagagaaggaccaccaggtgggggcggggctaggtgtgtctgaggtcaggctctccttgggtgggtcttgctgtggctgctgtgggggacggggatgagattcccaggtcactggagtagtgtacctaggaggattatggctgcctgtgctgagtcatgcaggttgtcagggaagtgggggaaagccagcagtcacaggcctcacccaactcccccacaaaccaaagggccagtctcactgtgtcccccgaccccctcaaacgcctgcaacatcccccgagtctgtttccaggtatagggcccagctatgaaagaagacctccccagctgcgaaagaaaacggctttagttcttcccccacctgtggagtctgcaagcccaattcatgcccaccccccaccccccacgcccagttctggcaaggaagcttctcgtcctgttcaagttgttacaaagttcatctagagaagtaattctccctgtggagttttaacccctgctcctctggccaccctcctgatggatccctgtggtgccaggcagggatgggatccttggggatcccacgagctcccagtgtctttctgctacttcctctacccatgtatttcactgggctcggctctctaacttgactcagccccaggtaaagtcgggagcttctcccgcaaagactttcagcttctccagtgggggtgtgtgttcgggagaggagggtctccctttcccacttccacagttgggtcactcacagtatttggggtgtctcccagctcctgcagcagcagtctgctttcttcagagggtcctctaaggattgctggtctgttcttgcagttgatctatagctaaaattcacaatgcaagcctccacatgctgctgtgtctggagctgcaatctagtcctgcctcccatctgccatggtcctcaactcctatttccttgcttttttacatattctgcaccttgatatctgcatatctggtataacgatcacttcttccgattttttgaatttgctttcatatctatgatggtggttgggtaggcactttggctttgattctgggtatgtgcagtagtgtaatctctatagacttttttttggccgaaaacagtatctgtggtatctgtaatttccttggtggcttagggtgcagttgttcgtggaggctgtggtaaagttttgttgtgaacggggacaccaaatggaccagtcgttaggttgcaggatgctagcagtaggctgagcatgcctgtccttgggccccagggctgtatacactggcatcagtggtagcaggtcaagccaggccaattattgggcttctagatggcttgctcaggtgctgagaatggtgacagtgggttgggtgggtgagtaggttttcaagccactgggcagcaaacatgggcaatggcagtagtagtagtgggacaaccctctgggatccaagcagccagtggtggtgttggcggtggctataatgggctgcgtgggccagtccccagacttgcaggtggcatatgagggtgggtgccagctgtgatggtaatggcaggttgattgggcccatactctaggaggagtgctcaggtgccaatggtggtgtcctgggcagggcagtccccaggtccctggaccaatgtgcttggttactggtggagatgcagcaaggctgggcagacctgcccccgggttcccaaggtgttgtgtgcagtgctggctgttgtaggcaggggtgggatgatttcccaggccaccagcagaatgcttaggttggggcagtagcagctgcattgtagctctgctactagggagggtgggtttgctttcagtgggttgctcttgcagatggtgaatgtcagtggggctctagggatgtggagatgcaggggctgttgggccccagagcaagatgcaggaccactagggactgggctctcaaaatagtgccatgctacagttccttaggtcttgggtgtttgtggagcctagtgtgagctccctcttgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagtaggtacttacattctaattgtaactttggtttttgtttgtgtttttgagacagggtctcactcttttgcccaggttggagtgcagtggtgcaatcatagctcactgcagtcttgacctctgggcacaagttgtccttccaccttggtctcctcagtagcagggactacaggcacgtaccaacacatctggctaatttttttgttggtctgtggagacagggtctcactatgttcaagcgatcctcccacctcagcctcctaaagtgttggtattacaggtgtgagctaccatgcttggcctcctaattgtaacattttagaataaaaatggatatgtttttaaaggaaaaataaccagaagttgaacatttctattattttgaattgtgaagctatgtatggaaatgtcagaccttcacataaagttagcaaagagagaagcttgagaaagttttattatttcacatgatatagttctcaaatgttatattggtttggctttttctgttgaggaggtcaagatgaattattacagcacaaagcaaattacctatgtgcttcatttttatctactcctagtttttttgcttcatttctaagcaataattattatatcaataattattctaggtatgttaagagaaatgattggcctatcattatccacttaggaacatacatttgcagaataattggctgggattgatgatacaatttgtgactgttagagatctctgtgttaaatggcctttttaaaaagtagatacctagttggctaggagaaccctaagtggtgcagacaagataggtatgtatggtggtggtaccatatttgagctaacctaacaaaaatactcacttgctaaagttttaaagtgtagagcactttaaacattttcttgccttttgctgcagttttcccacttggcaaccttcactccaaaattggctggtaaagggacacatggtctgggttccagtttcattgagttgataggctgagccagttacccctaggtaacatgaggaaatcagtaaagtatcatttgaaccgcaagaaatggtcataaatcttgtgtttaccttttaaaatctatttttaaatgtaataaaagtttttaaaactttgaaaacttttagtataaatttgaaatgggtaaaaagagttatatttgtgattgaatacagctgtagaaaaagatgttaaaatgtaagctccaaaagggcaggaactttgccttgttgactgttgtacccttagtgtctaaacaagtgcctgatacataggagaagcttagaaaatgtttactgagaggaaatagtcaagtctttgtatgtttaatagatgaatttagtaacacatcaatattgacaggaaatcatgactctcaagacaaatgagctattccagacaatgcagcgagcacaggaactggcacagagactaaaacaagaacaaagaatccgagaattggcgcaaaagggacatgacacttctagactgattaaaaatcttggtggtaagggcctaaccagaactttatttataatatttttagaagatgattttaaataattcctttttatctttgtttggagacaaggactcattctgttgcacaggctagagtgcagtggtgccatcacagctcactgcaacctcatattttttgtagacatggaatctcgctttgttgcccaggctggtcttgctgccttcagatgactctcccaccttggcctcccaaagtgttgggattacaggtgtgagtcactgcacccagcctaaatgattgcctatttttaataccttcaatatacctactattcttgtaggaatatcagactttaaactagtataattttataaataggaatgcttaatttatgtggaaaattgcaataaaagcagaactaaaggttaaaatgtgttaatgttaaaataataggtaaaatgtgtactttttgtgtctatttttaccgagaacaattattaaatgatctccctaaattcagtaactgataggaatgtgggtactttttgtaagaaaatttttattgcagtgttcattctgattaagtgaaaattattgtatttagttgctgctatacataatttttattaatattccttaagtgttgttttatcaggtgatttctctttgccagttgatacaatacaaatggaatataatgcatctaacatttcaaattcaagacatgattctgatgaaatcagtggtaaaatgaatacatatatgaattctacgacttctaagaaggatactggtgtgcaaacaggtatttgtgtggaaattgtggtttggtttaaaatttacttaaagtcataattaaagcagttagaattaagttcaatttaaaagttcaaaaattaacaaaacttgaggttttcagtaagagttacaaaataaagggataacagctttgttgaaacatgtcatgtaccacaaaatttatcctacagtttagtcttttttggtattcagtggtgcaaccattaccacaatcaattctaaaacattttgatcactctagaaacactgtacccattacttgccactttctatttctcttttctcctccagttaacattctgtctctgaatatttttgcctgttgtggacatttcacgtaactggaattagaccacataacggtcttctctggcttctttctctcttagcatgttttaaggttcatccatgttgtagcatgtgtcagtacttcattcctgtttgtcactgaataaatattacatttataataccacatttttattcatgagttgatgaacatttgggttatctccactttttggctatgaatatgctgctgtgaacattcatatatagatttttgtggatgtacatttttagttcgagagaagagtagaattgctgagtcatgagtaacaggtactgtatgtttagcattttgaggaaccaccaaactcttctccaaagcagtggtaccattttacattcccaccatcagtgcatgtgggttctgattctctatatccttgccagcccttgttattctactggttgtgaagtggtatctcaggtggttttggtttgcatttcccccccagtgactgatgatgttgagcatcttttcatgattatcagttcatagaaatggaaattagagtggtggctgccagtggttgggagtatgtggttgttctttaatgagtatagaggttcggttttgttgaaaattaatgaaagaaaaaagtcttagagggcaataattgtttaatgttttggggaaaattatttaatattgaaaattttgtttacaatttttaaaaatcatttgcaacttttttttagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggtaaagctcttccatcttagatgatgtgttgacgtttctggattcaaaacacagtttctcatacgtatgctttggtaaggctgttctgatctgtttcagtttacattagggatcagcaaactatatcccatgggcaaatccaggctgctgcctgtttttggaaagttttatacgaacatagtcaactcattcttttatgaattgtctgtggctgacttcacacaccagactagcaacagaaacaatatggcccacaaagctgaaaaggtttccttatgcttatcgagtcctttacacttacacaacttctgtagatggatgctgtgtattcaaatacccctttaaaacccttgtttatagtccacatagacagaggtttgggagattaggaactcccaaggattagttttgactctggaaaaaactatatctattccattgctcagtcagtacctgttattcaaatattaccctcagactatttcaacaagtagccctaaaaatatttgtggggacatgtgaagatgctatatattcctttctgcatttatctatccatattttaggaagaagagcctctgaatattcattcattcagcaaggaaaggtaagtatgcatcagattaattccgcagctacttaatgctttctatgtgggacaaaaaagggattcaagatctggacagcatcatatggtatatgtagagaacaatcagaaagggtgtggcttccaggtgagggttagaggtttaagggatagtgtggcactttagcaggagcttgaaggcccaagttggactgggcctaggcaggaatgtagataacatttacttttatctctagacttaactaagtgattttgatattccaggtatgtcattagcagaataggcattctgctttgggaggagggatggctgggggctgtgaatgggaagaaatgactgataaggacaatgagaaattcagtcagttaatgagagatttagaaccattagaatttttattctttgtgcatgaaccagctggtttagttgtctcagaatggggctctaaaaacaagtttcattcaaatggtgagtacattattgtatggtgaattatctaaggagaaacagtaggctcagattaaccaagccagcactgttcctcaggatctaggaattaaatttctcccttgtgctacagtacacataccatagctagtgctagtaaaaacataaatgaataccattctcttccccggttttatggaacaatattatagagttcaggcttctatgcatacattcccaaaggtgttacaggtacatttagaataaagtgaaatgggccaggcatgtggctcacgcctgtaatcccagcactttgggaggccgaggcaggtggatccacctgaggtcaggagttcaagaccagcctggccaacttggtgaaccccgtctctactaaaaatacagaaactagctgggcactgtggcgtgcgcctgtaatcccagctacttgggaggctgaagcaggagagttgcagtgagctgagatcgcgccactgcactccagcctgggcaacagagcgagacttcatctcataaataaagtgaaatgtgattaaagagatatacttaatctaaatacacaattttttactattttttttttaaataggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaaggtaagtaaatattaagcattctaactgtaaaaattgaagacccatgtaaaccccgtcaacaactttaaattccaaattagtaattcctgcacttagttctataaagtttcttgaatatgtcttaaatttttcttagtactttcctaggatacatacttattataatgactcctgacaatattatatagcacagggctatgtcattttactaatgtaattgactgacttgttactttcatctggctttagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctgtatgtttgttagacacaaataaaatgggactttcctaagacttgcttttacactgccgtctttgagtagttctttccagtacgaaatcatcagacagttctaaaattaagacaagtttattgagtaaaaaaatgcatacattggaacggcaaaacatcaataaggccctaaaacaaaaaatacagttatgctttaacaaattcttagcaatgtggcccacgctttttaaaaaattgacgtgttggcagtgtttgttagaacattgacgtacatcccaaatagtaataaattcagtatgaaattatacgcataaccttactcaccatactactttttctcccaaactattgtgacttctttttgctctctgattaaaacaaacaggtaacatccttacacctttgctccatcccttgggctttaaaaagaatggctgtagttagttttgattcactatatactctctgtacttgaggaagagtaagctgtgtttaaaagtgcccttttccatgtcgtcatgtaccaataccctctgcatttcaaaatgttgactcagatgtttttccctctacagaactagaaaattgtccccccactttggtctatttactcatttgaagacaaacagggttactaagagttttacataagttatttctttagagtgacgaagtgttagtttacttcttgcttagtggagacaaaaattgtgagataaagaggaaggaataggatgtacacatttacccatcaatatagcacccagtgttatttcagcaggacccttctgttagcatctaaggtaaggttaggacagtcaagataaaatactggatgttggccaggagcagtggctcaagcctgtaatcccagcactttgggaggctgaggcaggcagatcatgaggtcaggagatcaagaccatcctggctaacacagtgaaaccctgtctctactaaaaatacaaaaagttagttagttagttagccaggcgtggtggtgggtgcctgtagtcccagccattcgggaggttgaggcaggagaatggtgtgaacctgggaggcagagcttgcagtgagattgcaccactgtactccagcttgggcgacagagcgagactccatctccaaaaaaaaacaaaacaacaacaacaaaaaaaaaacactgtatgttaagggagactccttcagtatctaagagcacttgggggtggactgggggagaagggatgacttcatttacccccatagttatggagtcttgagttctaagaaaattttcatccctattgatttttatgctaaaaacagaatcttacaaatgtgatagctatatatccaaatgaggtggtctagtacaagcatttctgaaaaaatttttgaatgacaaaattttatcctaagcgatatgttttccaagtgaatataattctagtttaacacaacattgcaagtcaggtgtgcacattttactaacaaacatatatcaatgtgatttcagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagtaa

SEQ ID NO: 1575 - DNA, 64665 bp, Homo sapiens; identical to SEQ ID NO: 1574

SEQ ID NO: 1576 - DNA, 64665 bp, Homo sapiens; identical to SEQ ID NO: 1574

SEQ ID NO: 1577 - DNA, 99896 bp, Homo sapiens
ggttgagcgtttgcattagatgacattgaaaaatagtagaggaatattttagtcatatgccagagctggttttataaggcttttattcatacaaaagttctgtgatccccagaaagccttatttacattttctcgtctattttccatggattcctccaactgttgtttatcatactttctagttttctacgaagattacctagcattctttttttttttttttttttttaaataaaggaaacaatacttcatggaataattcatgaaaatttctctgactatacattttcaattttcatgtcaatatgatagaaatgtaaatgttatctcgatttgtacatttctatttgacttgcaaatttttgctcctttaaattttctcgtttggtatttttactctttcctaagtaaataatgatataatcgcataaggatcgactacatcttgtgtcctctcatctacttttaatatcttcctaaattattttacttcaaatctggttgtattgatgcctgtgagctgattgtttacatttctccccacatctctgttcaatgacagcatgtaggtagcttaaaataaccatggagtatttactccagggaaatcagaaaactccatagactagggctttccccgccatagagccagggcacaaaactctttaagactaccattgggttcgaatacacattagcacttttaaaaattttgatggtaaaaagccctaattatttgactgcactgcagaaccaaacatgcatgctaatcttttaaagcgaggtcccaactcattaaggtaatcatagctttcatcctgatcagagactgctgattctaaggagctcagggatccagctaatgaccctgttccctcaaaagcgtaggtctggagggaatcaaaaggaggggcacacggatcagtattagcttcttcgagcttttccagaatgaatttcctgaatatggcactgtcggggccaacttgcaaagactgcctgtataggctcctgatctcagcgcttgtggttttccgagtcttgcgttcccgcattatggtactactcctcagctctgctatatcaaaggcctctgtatcttcttctccacccccttcatcatcatattggaatatattctctctgaaatcttcacttttctcaggaaatagaatctgttttctccgttgttttaaacccaaagtcaaaaaaataaaccctgatgaagaaagcacatcagaatatcaataaacaataaagagtattataaacattacagtctttgctctcatttcaagctcaagatgagtgcttaaactttatgattataaaacaaaaagatacatttgttattgaaaatttgccaaagggacttgcaaaattacaaaagaatgtatcacgatttttctggctgatgacttagagtcaaagaaaaccataaaaatatagtgaactatatttattaatatatatattaatatatatataatataatatatatagtgaactatatatattagatgatgaacaatttaacattcaaaatctgtttcttctcaaatattaaaatagaataaagtagaataaaactttgcaacctgaatgcgtttgtcaactttagtagccaatgcttcatattaatagtagttcagaacaacagaacagtttgatgttccctattgaagcaaaattctgtggcataattattttctaaattaatatgtattgactatgaagcatacatcaggcattcttctaaaagctttatatttattgattgattttattcttgtgaaagtcattatattattatatcctattatagatgagaaaactgaagcacacagatgttaaatgacattgctagaaagacacagctagttgagagatacaatggaatactgttcagtcaccaacagtgaagtcatttacagcaacatagatgaacctgctggacatcatgttaagtaaaataagctaggcacagaaagaaaagcactgcatgatctcacttatacatggaatctaaaaaagttgatttcatagaagtagagaatacaatgataggtaccaagatttggagagtagtcaggggagtggggctgaagagaggttattcaattggtgcaaagttacagtgggacaggaggaataagttctggtgttctattataccgtagggtgattgtagctaataatttatttcaaaataggtagaagagataaattggaatgttatcaccacaaagaaaggctacatgttttcagtcacaaatatgctaattatgctgacttgagcattatacactatatacaggtattgaaacaacacactgtaccccataaatatgtccaatttgtatcaattataaatacaataaaataaaaaaagacaaaagtagaaagttggttcagagcctgttttctgtgacaccacataaatttcagaaatttcaaactatcatgcatttgaatcataacacatttgtctagaattattatttattacataagataattttaacatcatgtagaaacagaaaaaattcagaacacttttgctttaattttaaataaaaatgtgtgtgtgtgtctgtgtgtgtgtgtgtctttgcgtgtgggtatcaaggataaccaagagccaacctaggatcttatgtagctgttcagaatttcacatgtaggatttgaaacacacatgaagtaatgttatgaatagtatcacaaagagaaatatgttggttatatagtatttatataaaacttgcatttaaaatatctaaattaaataaggtcaccatatttgcattcatgtattgcactttagaactcatatgatatatatggttgaaatagaaaggagtctaataaatacttttctgatctgaattggagataaacatttataaaacattcaaaggaaatcactattgtaatagttgacccgtaactcccacctgctaaattttactcacatttgtaattacaaagctgccccttgtttgtttgtagattttcagggcttggtttaagtctgtatctataggtagctcagtattttagtcccccaaaattatgcttttactatttatctttgcttctggatctagctatgtagctatgaattcagcttcataatcaaagatcattaaaaataattttaaaaactgaagctaggtcctaaacaattgtaatggtaggtgtaaatgaggaatggattggttttgaaaccttgagaaagataagttaagtgaagacaaggcaggtcctgaaacatatctcatgccagtttgagtggtcagtttgacatttcagaaactaatacatttgctctcactcttcaatgtagtttcattggcttttggtttgaagttttgagggaggcaagagcagagtttagactatatattttggcattaaaaaaaggaaaaggttatgctagatgaatattttatagtcctgaaagcctgattaagaccttttggtgttcagctgcctcatttgtgaaatgaatataaattatctgcttataaaaacagtgatagcaatagaaaaaaacaagcaaacaaaaactaatagcgctcttttactgggatttctttctcttctgtacttggatttaaaaaagacgttctcttatacattcctcatttctaacatttactgtcctttttattcacaaaagacttttggattatttttagttttaattgacaaaaacatatacatttatggtatgcaatgtgatgtctgatatatgtatacattgtggaatgattaaatcaatttaattaatatattcatcaccttaaatacttataaataaaagtggtatgttgaagagatagccacacttccatgttcattacagcattattcatgatagccaagatatggaattgatggaagctaagtttccatcagtgaattaatggataaggaaaatgtggtatacagacagaacgaatgctatttagctttaaataagaaagaagttctgtcacttgccacaacatagataaaactagataacattatactaaatgaaagaagccagccacagaaagacaaacactgcatgatctcactttgacaaatctaaaacaagtaaataagtaactcacataagtagagagtagaatggtagtagcaggatagcaggtgagagaatgaagagacattggtcaaaagacacaaagtttcagttagacattaggaataaattcaagagatctattttaccacatggtaactatagttaataataaggtattttatactcgaaaattgctaagagagtagattttactgcgctgtttttttttttaaatgcaccttgggctctagtcagttgcagtacagtgttgtataacaatgtgttgtggtcatggaatcttagcacatcattttctagctgtgtgacccttcataaagcacaaagctttttgagtttctattccttcatctggaaaatgtaggtgatattagttactacttaataaggttattgtgaggtttggattgcatagtgcatataaaacactgaagattgtctcctggagtataataagcactcgagagaagctcgccattattatcactaatttttacatgttttatactgttacattgtatatgtgtcaagaacatgcataaacagatgtgtacatacatactcatacaattcaaagatcatgtttttatccacttatttactccacttgatttaagaattatactacattcagaggagcaataaacgtacacacagacccacattataatgctataatagaattaactatgtatttatcatgttattttaaataaatgagtatatgttcagttcagcaccacctaccaaatatgatcataatgcaaatgagaatagcaatgatgacttctacctaccaaatatgatcataatgcaaatgagaatagcaatgatgacttctgtcttgaatcccatggaaagcacaagctcctggtactggcaggtctgtgtgctcccactgtcaccacagtcacagacatggatggtaagggtgtttgtacttgtaagtgacgggattccattgtcggcaattaagatggagatgtagaagacaggttcttcttgaaggttaaaaccagttctattagtcaaaatgacagctgtgttatctaaaacaaaaatccatgtgcataattttttcaactacgtaagagaaatttgtatgtaatagtcacatgtgctagggacaatagtatagagatatgatcaagtaagttcaaataaaaggaagacgaaatttctgacgagaagacaactaaaacatccacactaaattattagtgttttgacattacctaaaccctaattatgtaatcagatgaattatttaaattatgtagtaaaattactatttaatattattaaatattgagttgatactacttatttagttaaagtatttatattattattgaattaattaaattggttccaaaatgtctttgacacatatataaaacatacgtgtaacacagaaaatggctttttaatcagatatcaataatttatagggactaccaatatgaaatataagctgattgagctggctttatttgtgttaattacatatgacacggtctattttctaatacttgtgacccattatttgtacaaatccagggaatatacaagactttcaaagatatatatcaaagcacatgatctcaaatactatattttctaattagacaaaataatttcacttggtagacaagatcctattagtatatttcatatcacattgctgttattaatctattttgtatttaaaattctgaaaatcattacacttagactgattcatttacctagagagtccattcaaaaaaattcatgaaaacaaacaataagcacttcaacaaatatgcaatgactcttctgtgaatcccaaaatattatgaataacttttgtcattgtaatttcttgtacctcagaactgtattttccctttacttcttttttaccatccctcaaaatattttctatagtcaccaaattttagaagacaatagcagtaaaaggaaaataaaagccttttgaaatgcatgcttaagtaggacatttcccaaatcacctttttaaagacaattcactatgaaacccttaaggtctataaagcccatgtgattttattcgctaggcagatctaagagttgagagacagttgacactttttaaatatgcgttttattaaattacttgtgaccacaagcattaaaccaaatcaattttgtatgcttcaatgtatttatttcacctcagtaatttattttatattaatataaattaatctatatatacaaatatcaatgtatttaaatatatacatttaaaaactccagcttagattcatttatattaatatatgtattttaaaatataatttttaacttagagtataataataaaaaataaataaataaaataacgttgaagtctgcaacaaataataataataataataataataataataataataataataatacatgtaccccctgaatctaagagtttgttacatggctaaattttgtggaaaggagtctggagatttgtcaaagagcttgaaagagatatttgtggtttttgtctgaaacatatttgagtttcctccccgggggaatttgacgagggcaaaacagacagaaaggtgttgcatttactctcgtatgaaaggcctcttctgaacaaagcttaacctcagctgtaaggagaactgcaagtatttggttacagatacttgagtaataaatcaactgtgtttcataactttgaggtatgaaaaaattaaaacagaagttcttattatgacaaaaagtatctcttactgaagctcatgaaaaagaagcagcgtggctttgtataaagttaatccacctctacagaaaggaaaaataaattctgcccctacaaaaagttctttggaacacttaatccttagattgatacaaattatttagttttgaaggaataagaactatattaacccaatttcacatattctaagctcctaattgatgaccctaaatatttttgaatcaatcaagctaatatgactaactaaaataaatatcattttcttcctcagtcatagattgaagtctgagttagatgagaacatgaaaggagctgtggtgtcagaactgcaattatattcgcagggtcattcagactttacaagagcttacagccattgataactttaaaaagtgtttctactttgaagaaatgcggtgagaaatggagtcaatatttttagaacttaacattgagttttgttttccattttaattgttactcttttgcttgatttccaaacattattatgttgcaagaacagtataaaaatccatgccataaattccattaaagtctaacatgagtcacaaaaatgtatcaaaactcattatgagtgaatgacattaccttgattatctatgattgtaaaacttgaattgttagtgtcttctacagatagattaaagtaaaaatggtgctcttctatggattcatctctatccactgcactgatagtctgaattacctaaaaaaaaagggggatagatttttgttgttgtttggattcaggaagaagatcactgctgctattattattagcttttattcacattgctttattacaatcaatagggacattgcagaaaataactgtcaaatcagtggagaatattaaaatgttttttctcaggttaaaaatatgttcacttccttttttcaaagagtgttgtaatattacataataaacaaactcttgttgatggatcaggtggattccaaaagctgtttgttgaaagtctccaaagcattgcttttgtattactcacatcctccctgcctacatttcactctttcttccttcttaactttttctttatctgaatgtcagacattatgatttgctaaagttgtctatttcctgtttttactgagagcaaaactgtggtagagttactggcttactaaactatttgctgaagtaatgagatttgcaattgattgaggaaataatgcatttaaaatgtaggggcaatgtacatgatttcctttgacccataatgattataggaaagtgttttacatcaaataagttcatctctatatctcagatcataaaacaatgaagtactgcagacatgaacaaatccattttcaattaattttcttctttcaagacatgaatctgtcagtcaagtagttcattattgtcgaaaaagatatgctgtcaagatcacatagtgagattgtgattaattgtggaaattaaagtaaattgattatagaagttattgtttcgaattttctacaattaaagtgcctttaacaatatgtcaaacaaaaatagcctcagatgcaagatgacaagcccagatttatattatacttcaaaaaaatagatacatcttcacaggcataaagaacattaggaaaccaatacgatctgtatattacttctccacattgatttatttttaactcattacacattactaataaataatattcatttagtgttaattaagtaatttaacaaaacacattttattcaatccatgcttataattatacatgtggatattgatttatgttaaggtaaagccttcattttagaatattacaggattttgtataggctgggtagagggcaggggcttggaaacccaatattctgaatcctggctttgccatttagaagtttttaaccttgaaaaataaaaatactaatacttaaccttcagggttcattttcaggattataggtcttggcttgtcagagggtttgtcacacgacaaactattatgtgttcctatgtctattatgtgttcctcatgaaaatattctcttgttgagtttttgcatatcatggtgtcctgaatattgttagtcataggcatatggatatctttatatgcacatttgctgaaataagattgataacaaagtatagaattcatgtttatcttgctggcatatgtggctacagtgttcagataaggaatattttattttactacctgatgttctgtattaaacatgagcatctgagtaaatgttgcaaatgtctccctttgggaatgaagacttaagaagactggagatatgctgtatgtatgtcaaaagatttttaataaatcaaaataccttatgcatatgtacaggaaactgaatgagcaagatttcaacagtctgcctccttttaaatgatcatgtctccacttatatttgctttgtaagttgggcttccaataagatatgttttactggctttcataattactttataaaaataggaagacacagacataaaatgagtcatatatcaagtattatgaattttattgaagttaccttgaacaggtacacttaaacacataccactaataaagggaccacattaatatgctaataagttttgatggaggatatttatttttcctttaaatataccaatggaaaggttttcattttcattttaaaataaaattataagaaaaacttctatatgttgtattggttgctatttacttatatctctttatctgggaactatcgttgaccttatacatttatgaaaggagtaaagataaattaaaaggtaaaagtatataccaagaacagccatggcttgagagattgggaaaagagaaaatgaaaataactccaaattatgaccaattctgaaagctcagatttttagtattctttttgctctctacgtagaatgttggccaatttatttctgatgcagtacattcaatcatctatatacagtgcattgaaagctacaatggaaatacattgtgtaagccccaagaattgaaaagtaactacaatttaataagaacttacctatgggccaggatctgttctatacattatcttagataatcttcacaatggtctctggaataaatcctattattgttcccatgttataaatgtttatattaagcttcatataagctaagtgtcttaggtaagtaaattggctgggccagaattagaatgtaagctgatgtcataggcaatgtgaaatatgagtagtaagtgtagccctctaggacatattgttcatatcctagacttgttcttgtcctaccagatttacatacaaaatgataccgtaaaagacatgaaattccaaaagcaagtaaaaatatgtctcataaaagttagtgacagagaaataagtaatataattttgtagaataaggaccaaaaataatggttaaaaatagaagaaaataatgtgttttgatatgggagaaagggaagattttctagggtaagagtacagccaatgagctaatactcaaataaaaatatgaattgaggaaaaaagtgtgatcccaagcaaagaatatcaagaaaattaatgaaggcaaagatatcatacattaggtataaatgtatgaaattaatattttgtagattaaagatgacctactaatggaagtttcataagttccaatttagttattttatgaaactataatcactatttgactttaaagataatcaggagaataaagataatcatttgcctgctattaatcattatgcactatgtctttttttaagaaaaagtcacacatgggccagtttactaagatatcattccagattaattatcctgagccaaaaataagcccaatactcacattcttcaaaccaaagagatggttcttattaaacatgcaattgatggacagctaatttaagatgcaactcttgtacacaaatatttggagcaagcaatacatttgtgtctgtttccttaccttcatggcaagtcacaatgaaacctacttccaggattagtcaatgaataaattgttgaataggattataaactatagattgaatcatgaactctaaatcaagatacaaatactgagtattaatttatataactcatcaattccttgaagtgcacttaataaacaataaaaaaatgcttctcaatagaaaaatgttaaacaaaaagttggagttgtaataaatgaatatctggaaagattttcttaaaaatcttatctgagttgcttatttagttattctaggtaggtataccttgtattaggctaaagatgcagattgtctcccattgccaagaaattattatacaaacatatgtatgagaccatcactttttatattactctaatgagtaaatgattttaaattacacctgttttgacaaaataaatctataaaactcaaaaaaggtgttgaacatctgttcaaacaggcagagtacaaaataatacactaatagaagtagaaccaacaagaaagtctaggttgtagtatgcttgttgtctttctttgtttagcaaaatattagaagaaaaatgttcaaaaggtcattatagcataatattttagacctggatagaactgaggatactctaagttttctaaaaggatttttcacaaagtttcattatatttatttaaatgtcatagatattataattgtttttgccattaacttgtagaaattgatattcagttgaaaaatacacattcctagatttttatctcaatacgtattttctaattttccttttaaagttaatattccaaatatacttttaaaattcacataaaatcagcatgtatatggaaaaatattaaactataaaatatctcattagtatcttaaatgtatccatttaaaatgtatttcattagtacttacagcactccaagcaatcctatgccctggtggtacaatcatggataaagttagtctctgtcaccactgttcacattctagtggtgaagaagatcaagcagaattgcaaacttaaaaagtattgaggaagtacagaatacccaaattacattttaaaagttataaacacctaaagtacttaatacttaaatattggggggtcagagaaccttgtatctgtgctgaaattagaagatcatacagcagaagtgagcaggggatacatcgtggacatattaaagagttttgactttatactgagggacactcccaggctctaagttgggaatgacatgatcattacttttatttgggatcacatggttccaggcaaaggactgcattttagaatgctccttctgaggacatccttagtgtaagtctggaaatagagaatctagtccgcaagctattgtcatgatcctattgaacaactgcttggtaatcaaaatcactttatgtgatatacaaaaaaacccactaacaatcacaattatggaatgtgttattttaaatgagaaacaatacagaaattactgagcagtgttcataaattgagaatggtacagtatgcttcaaatagagatataattcctgagtcccaaaatttgcctaagggtatgctgagctccagaagatgtcaccaaagtaatgttttttcaccattttcaagagggctatatattctcctcgctactctccatccagtaaaatctgattctcctgaaactgcatgactgcagtcttacctaataaatataattgatttataaaactgatacattgctgcatatgtgctgtgagattggatgaaggaaagtttgattttacaggaacatccctctgcagacctgcttaggtcaggttcactctagaagagaagataggtcccttaggttaggttcactctagaagagaatataggttcctattagggtagaaagaatgatgatagagagaaattgatacattaaagacatatgtaggagatgggatcaacagaaccaaattattgattggatatggagaataaagactagaattaattaaaaatgatgtccatatgtctttttttcttgcaaaacttgatatcataataattttcctagggatactgaagaaagggaaggcttaggagcaaatttggtgtaaccatgggacatctgagttgttttctcaggttagtcagacacatagcttaaaacagaaaaatcaggcagagatacagttatttggatatgaactgtagtcgagaggaagaagtggataaaagaagaaataatgagttcaggaaacttttggacacaaaagtgaaaggaagagaatcatagatcacaaaatgcaaccactgaaatttaggaaaaagaaaatttttacatggagacaaggtaaatgtctttagacaaaatattggtatgagtgaatctgaaaattatcgatattatactttacctccaaaaaaaaagacatttaatatcagtcaaaataatggcactcagtgatttgaaaaatgataactatttgcaccacatggcaaaggcaaattaccctgatgtcagctcatttattatattaatatttgcaaattgctgaaaattctctcctactcttccccaccctggccacttacacattaagaacaaaaccaaaaattttgtttacccacataggtatttgagtaaatgtttggattcctccagagtagagtgtgactactctggcatttttattttctatgatcaatttattatccatccaaagtagatagatataagacatccttttacctgccattttctctggctgtttgagcatgtgggaaatgagaaaagaatcatcttcataaattaaaaatatgtataaaatatttaatattctgttaatgattttaattaaaagtatgtgaagatgatattttggatatattatatcaaataaacattactaaaattaacattatctgggtgttttttatatttttaaacgtggctacaggaaaatttacaattctatcatttatttggaagcactgcattacatactcatattttcaaataatttttctttttttcagtgactttattttatatgtactttatatattgtatgaaatttggctttagaactccaacaaataatagtgtaagagaaggcattgttttcttattactgttttaaattatattaccctatcagtttcaatattacataaagttttgattatcgattgaggactataatattttatcattattatacgtattatgtgtgccttttgaagtcttatatttattacctaggatttaggtttattattcttattcattacttatttatttatttatttttgagatggagtttcactcttgtcactcaggcttgagtgcaacggtgcgatctcggctcactacaacctcttcctcccaggttcaagcgattctcctgcctcagcctcctgagtagctgggattacaggtgcccaccaccgtgcccagctaatttttgtagtttcagtagagatggtgtttcaccatgttggccaggctggtctcgaacttctgacctcaggtgatcctctcgcctaggcctcccaaagtgctgggattacacacgtgagccactgtgtcccacctaggtttacttttatctgagggtttcttagcatcaaatgaaaagttcgtgtatataatttttatgtgtattatttagttcctttgacttgatatgtaaaatatttacagatttcaaagtattgtatattgttaactttttattatttttaggaaagtttaaataacatgaaaattaactgtaactttgaaactcaacgatacaaatctcttgaccgaaaatattccttagaaacttctctgtgacatagtctcagtattattaagcataattgttttaatcctcttttctatttttcttacattatttcattttatttcattccagtctaatgactttttttaaaaacctgcattttgaaatgattatagattcacaagaaaatgtaaaccctgtgcatgcagtctctcagacacttcattcagctaaaccaatggttacatcttatgtacctgtagtacattattaatatcacacacgtatgatgacaaaacaaaaaaatcaacctctataacacatttatagtggagttcttaacttttgttttttactttgttaattcgactcccctaaacatctgatgaacgacattattaacctgctccactctcatctccaacagacattgacaatgttgtttgtgtgcaatgtcaagtgtacatagacaccgtgtagctaattcaaatctctttagaagacaatgaactccatgttaagaacttataatgtatgacatgacccttaattgtcactgttaatattaacaaaactacttttaccacagtcctcttttaccttctttcttatttgttttttatctttacaaaatccttagaagatagagattgtagaggagaagctgtattattatttttgaaatgaggagattagtattcagcatggttaggatattatcatctaattggggtagtgtggatgagtgatagagatcttcagctattgcactgtgtaatctttttgttattgtagcttgttgtttttgatgtttcattctcacataaggggaaacatatttgaattacatctcatggtttcctatacatgtgatttttagacaataatcaagaataccaatcagaaattccaggaacttaacactagaaaacaaatgtttattgcaatcctctctaaagaaccactttgcctttcaaaaacatgggacaaaacaaaacctaacaaagaaacaaaaaacaaaagacatttaaataatacataaaaagaacaacacttattttgctatcctgctcatttttctcaaagggtaaaagaggcaaatccatcaaattcaaaaagatgcactcagctatcattggaaagctgtgtgctatgtattgcttaagagtaaatgagggccaggtgtgatggctcacacctgtaatcccagcactttgggaggccgaggcaggcggatcacgaggtcaggagatggagaccatcctggctaacatggtgaaaccccatctctgctaaaactataaaaaattagccgggtgtggtggcatgcacctgtagtcccagctactcgggaggctgaggcaggagaatcgcttgaactcgggaggcagaggttgcagtgagccgagattgcactactgcactccagcctgggtgacacagccagactctgtctcaaacaaaaaacaaacaaacaaacaaaaaagtgagaaacgtgatagacagttccaatcgaaagagaaatagagcagcctcagttattaaacgcctatcttttttaaactctggccatcctggggccaagaatgataactagctggaagaaaatagctgtttttttttttttttttcagttttctgatgctgtagcacatctaagcaatctctaaaatatacaaataaatccatcatgaaaaagttaccaattatttttggagataaggaatttttttcaaaagagtaaagaaaatattgtataattttttctttttttgagttaatttgagttattgtataactgaaaagaacaaagaaaatattgtaaagcataattttaagatctgtatatcttcactgaaacacatttggagaattttatattgttttaaaattttatattttacccattctacctattaatagatttgcattataaaaaaagtgaaccagcaaatttcatggacaaccttataatcacatcacaaactttaaaaaacaagttttacaattcaaagaattttcctttaattatttttcaatacaagtcttcaagtctgatagtctgataaccttgatgttaaaataaaggtaatacaagaaaacgttgctcctgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttataatttcattttatatacatttttacatacttgctgaaatttctatacacacaagtaattcatcaaaccaatctatgaatcagtttactaaaaatgttcacttcctattaatattagtaataaatagaatgtggtttctggatctgataaattttttaaatgttaatttctatgaatgcatattgtggaaaataatttgggaaagcttcaacagtactcttacctggttaaaacattcagaatgataaatatgtcacctgtaatggatacagagtgcttggaaatttcttcattggcaaagtcacccacggtatttacattaagtcatttactacatcaacacgaggtactaacttttataaagaacatttcttatcaaccagcaaatattcttgcatattgaggacagaatgacttcttcaggattttgcaaataattatcttctcacttatctctggcctttatttatttatttatttattttgtttgtttgtttgtttgtttatttgtttttgagacatgtcctcactctgtccaggctagactgcaatgatgcaatcatagatcattgcagctttgaactcctgggctcaagtaatcctccctcctcagcatccttggtagctggttctacaggcattaatcaccatgcccagctaattaaaaaaaaaaaatgtagagacggaatttcacagtgtgaaagtccagtccagaaaggctggtcttgaactcctggacttgagtgctgctcttacttcggcctcccaaagtgctgggataacaggtgtcagccatcaccccctgcctgcctttatttttaattaaaatgtattagtctgccaaaaagttacagggtttatgtagttacttgttctgttgttgttgttgttgttgttgttgttgttgttgttgttgttgtttcgagacggagtttctctctgtcgcccaggctggagtgcagtggcgcgatctcggctcactgcaagctccgcctcccgggttcacgccattctcctgcctcagcctcctgaatagctggtactacaggcgcccgccaccatgcccggcaatttttttttgtatttttagtagagactggggttcaccgtgttagccagaatggtctcaatctcctgacctcctgatccgcccgcctcagcctcccaaagtgctgggtttacaggtgtgagccacccagcccggcgtagttttgttttgagacagagtttcactcttgttacccaggctggagtgcaatggcgtgatgttggctcactgcaacctccacctcccaagttcaagtgattctcctgcctcagcctcccaagctgctgggtttacaagcattcgcccattcgccactacgcccggctaatttcgtatttttagtagagacgggggtgcgccatgttggccaggctggtttcgaacccctgacctcaggtgatccacctgccttggcctcccaaagtgttgggataacaggtgtgagccactgtgcctggccagttatttgtaatagaaacgattattaatgttttacacagctttcaaacattttttatacaatttgactttttatcctttttcttttaaatataatatgttttattatatatattttttcttctttttggtatagttactttttaatatgtttcatattaattcgaacacatttaagcttaaagagttctgtgctattcctaggatttatgtatttattagacatttaaaatattttggccttaaaaaaattatttaacaactttctatagggatatctggaaactaatgttgaactatatgtaagattgtctgtagcaatttgatagaaataatgtttacctataaattatttttaatagttacaatttaaaaaaccctctgaaaaattgataccttttcctaaaacattaatttataaatatttatactaattaaaaatagttgaaaaaaataaaaatcacaaaaaaatgagatgaagttttaatactgcctttatcattatcaaaaatgaaagagaaagcgtaggaattaattggacaggttttccaattttatttactgacaattccatctgtattttctgcaattcctcactaacagatcacagaatcttgggaaatgactgattccatatctaggacaggaaatgtgaaaggcctggctcggtatcagcctggttccaacagagggacaaaaccacatgatcatttgaaacgaggaattctaatagaattctaagctataatatcagagcaatcataaagatgtaaggagaactctaaagggtatcctgacgctctgagaaaatatcagaggacagccaagcgtgggcggaaagccttctccctgggaccagcttcagccctccttggaggaggtgcagctgcagcataccctatggaagatgttcacaggttgcctgggttcacattctaacccacattcttcaggaaagaagaaacaaccctccagggtaccagtgggctggaggataaatatgcaggacttggcgctcacctcactgcgttgccaggtctggagcacagtgtttacactcggtgggggtggggggggagtgggtctcaaggcggttgtcatgagcccaggcggcagttgctggttgccaagtgcctgtacatttggtacattagggtctgtatgtgcgtctggggaaaagcaccacacaaatccccacacgtccagagagctgaccatgcagtatgacaaagggaaaagcaaacatgccacgtactggatctaggaagagaagtcttctcctgcaatgttcatccacagccctctactgacaaggctcaaccttgcactcaccgtaaaggagaaaagctctccgggggtgggggcgggggggttggggggcgtaattcctgtgcacagcgcaggaccttgttaagcaggtattgaggcatgaatgtgcgccacgaagcattaaattgatcagtggcagagcccagaacatattgctgtaccagaaaccatgtaagcaatcaaagactaacatgttgtctaaagtacacagaaactgacatgaatgtgtgaggatctatttttctaaacattctttgtcctttttataattccttttgtgatgtagatagcttatttttttctttatttttatttttttcctaacttgtgcgtgtgtgtgtgcacacatgcatggacacctgtaaatattttttaaaacaattattgcgctgctgctttggaactttgaagaagcctggtcctttttaaagagtagtgtggacaaagaacacaaagtttcagttagacaagaaaaataagtttaagagttcgattgtacatagttaataacaattgactatggttaataacaacatattgtatacttcaaaatttctgagagtagattttaagtgttctctccacaaaaaacaagtatgtaggtaatgcatatgttaattaacttgatttagccatttcacaatatatgcgtgtatgtttgtgtgtatatatatatatatatatatatatataaacatcatcatgcaccataaatatgtactatctgtatttgttaattaaaaatatttttaaaaataaaaataaagagtactctagggaagtggaaacagtgaactttgttttgggtttcttaatagaaacaaatccatgctgagtctatcaccctatgcacatactcttcttttagtttctggtataatgaagctttttatttcttaccaacagtctctaaattgtgtgtccttcatgttttattctgccccaattttatttttagcaattccctttcagggatctcaggctgagattatatcaaagaaggtgccacctttctctttactatcattttctcattctaaggtggagagctgtcaaagtgtttttccatttcgtttgtgccaccaagttccctgcttgaaacctaagaaagtatatactggttctggattttctcttggcttaatccagaatttacattatttaatttatctgacacgcatatttaacaatttgtgtcctaatggtgtagacatttccttattttggtgattaactgttccttatgtttaaacattttctctgtttacttctaaatagaatgctcttcagagtttccttatcagcaccacttaatattattgttaagattatggtgaacctaatcaaataacttttactaccctttgtaataatttttaaaaactacttatacagagatattgcattaaaataattacggttcatatgcacaccatttcagttacatgagctatgccttattacctttgaaagcatttttttttagagattgcttcattggttttagtgttcatacattaatatttcacttctaggaaggaggaagagattaacagcactttaaaaagtttttagtggcactttgggaggcatatattaatgttaggtgtttggttttaattgtattaacaaaaacctacccagtgaatttcaaatcagaaatctcaacccaagtcagtctgactctatgatcaacactggaggaaacacaacagtcttgtgcttgtgatagccataattcctggattattaaaacaaggcatcttaatatatgagaaagtatctactataatgttatatacattgacagccctcaaaccatgtgtccactgatttcaatttgtaaactatcatgtatacagcagggtgggaggaaattgttggcttctccttggatttaaatggaggaacatgataggtagccatatatcattctttcagatgcttataggactgagacagacttccagaatttgacagcgacatctgcacgtcccaaaataattatttcatgatgtgtgacactctccttaagggaaattgtaaaatagggctgaccaatgtcccttattttgagtttgaagagtgcatatcccaggaaggagtttggaatcagtcaaattgaccttccttttatttttgcccttaaaatcataaatagcattctttctgaatagagaaacagaaaaacttgtttttcatatttttagttgtgtgcataatctaaagagagctagtctttatgattagcatggaatatggggtaaaaatcactatcattcttggagacagacataaattttaattctggcttacctattgctacattatatgatgttgagaaagttccctaagttaactaaactttttaagcatagtatacatatatgtacatttataaaaagtattttatttcatagctttttccataaagctttacatttatactttaagcagggcacaagaaaactctatgccattgcacccaatagatatttctctcctcagtagagtttaagactgagaatacttttacagtacattgcaataaacattagcatttgagtttcctttggatcagttctacctgtttgtagataatggtatttcatttttgtggttgttatagaggtacttcaaagaataaacaaatattaacttatttcaaatttaaaaattatatcttcaatgactatgtgggtatgtagacacttttataaatctaggatacattatggaacttagtaacatggtggttttaaatgccttgaatattatcaagatacttgtcttggacattttcatgatacatcatcatccaaagaattatttcatcattgtgcataagtttttttcacatatatatttaaaagacatgtaatttgaaagattgtgtattgaaagtttgtgtgaagaatgacaataatgaaataaatcttcactatttcatcattctttttttttaaaattgtgttgctcaaagtattacatcaactttgaaaaatatataaaagaggactggcacaccatcttttagtttcatttctattttcattgactatacatgtccagtaatatttgaataagtgttataaagataatttcaaaatcagggatagtttccaagaattagttttattactgaatatataaatatgtatatatatatatgtgtgtgtgtgtgtgtgtgtgtatgtatgtatatatatgtgtatggcaagcttaaatattgaatgaattacaaataaatttttttaaatatctattatatattggtgcactcaggtatacatatatattaagttttttagtataactaacaaatactacttagtaattctattttgaactatatccatgtggttagtattgtcatttttgcttattttttcatatttacaaaacatacaaaattgtttttccaggttgcatgtgaaatatatttttctgaaagcatatgaattgaatacttttcatattataatcactatatgtgcatacatatataactatggaataaaatcaagaatctctgctgtcataaatctagtaatatattgaggaaaatacgaaaatattaaacagaaacggccaagtgtggtcgcttacgcctgcaatcttagcactttgagagtccgaggcaggcagatcacgaggtcaggagtttgagagcagcctgcccaacatggcaaaaacccatctctactaaaaatacaaaaaaatttagccgggtgtggtggcgtgcgcctgtcatctccactactcgggaggctaagacaggagaatcaatcgcttgaacccgagacagggaggttgcagtgagccaagatcacgccacttcactccagcctgggcaacgagagcaaagctccatctatatatatatataaaaaacagaactttgtccaattaacatacttaccacatgggacatttacagaaataggtgtatagaagatgcagtaaattaaacctattttttttaggcttaaaacaggctaataaatggataatctaaatacattcatatgtacacttcatatgtacatgaaatgaatgaaataatttactatactggtactagaaatatgaaatataattataataaatataaaccataattttatttataataattctagaaatatgttacatctaatatgtaaatttgatatatatttattagaaaattataaaattcatcatttcaaaaattatttgtattttaagaaaactggtgtgccacatttaaagtatcatttattagatttacatgttattatttaaaagttgcttgttatatttgtcaatgtgtctaagtaatcagatgtgtttgaaattcttgagaacattagctatgtccaatttctaaatatataatctacttatagtaccacgtttgaagaaaaatgtctaagctgaatttctgcaggagccatgggtccaagttcacgttcattctgtttttgtgatctcttctaccctatactgtacgcccatacatttctaaaatagttcaattttggttctagggaaagtgcaacacaatagagagcctctgaaatttttatatccaccttttactttcccaaatccttgggttctaacccattagaaatgagtgctttaaatttttaaagtcatttgtatatttataacaattctattactgttttcaaaaacattttggaaaatatttataggcaagatttgatcattatttccagtgaaatcacattcaaaaatacacatagcttaatgaaattcagtcatttcaagaaatattgacaattttcactatgttgcagtttaataatcagtaacagttaagatgtacctatttcttaagatatgagtattcctcagcatagtagctaattgatcaaatataactttggttactaacatttattgaaagagaaatataatttctgcttttgtaaaatccaaatggtccctgactagctttgttgataaattcaaagctacttagaataattgagttgatagtatctgtataactgtttagtatcatgaactctagactgtaaaatttttgaacattagtggacattttttaaagaaaaacagcttatggtatttaatagtcttctgtgtgctctaagaaacctgataattatattagtttattatgtaccagagcttagaagtacacaaataacattctaacttaagtttcacattttacaaataaaaaagtgagcagcagataagaaagtgtgtgaaataaattgtgaagtaatgataatgtatttcaaaatgagtatgttctcataagtgtttacatatctaataatttgtacaaaactcagttttatttgtgttgctatacctggtatagcaattaaacgctacgaaaaaacattctggtgtattttccctccatatgtttatgtttatgtctcattttacctttacctgcatgatgaataaaaaaaaaaaaacttaaatgtgactaacctatagaattaatttttttaattgtattggcaaagtataaatgaactactgaataataaatatactataaaagtaaactactgaatcactatcgttagcaaatttttaaaaacattttaggaatttgaaagtagaaaacttgaaatttgcatgcttttaaaaattaaaataaaatattattatacaaagctcacaacataaaagcatgtaattaatataaatagaataaattttttgatgttttaaaataagatgaatgcataacaaaaattattacatattataaagcttattttatatatataatttgtatatatattgaatataatataatatagaattacaataattatataaattataatatatgaatattaaagatgttgatatctattatataacaatattgtataatatatgaagaaatttcatattatgaaacaatgatatattgtttagactttgtaatttataatgagtccttacctgaccagagcctgcattttcacaaacataagtctcatagtattgagagaactcaggagcatgatcattgatgttaagaacttgcacatacagtgggatcgaagagatctgttctatattgtctgcaatttgaatatatataataaaaatctaacatattttaatatgtctttagaagagacatcattaaaattacattagaggctacgtggtgtatttttattttacttgaaaaaagcaatctgaggacaggatatctatatgattcacctacttatcaacaatagatcctagaaaaaaattccatgctcaatatattcaaaccaagcaatatttattgagtgcattgtatttgccatgggctgtaataagtgatgagaaaaagcagtaaaaagataaagtaaaataagggtatacggagagcttgcaagagtccaggaaccatttaaagttttgtattaactcatttaattttgatcaatatatggattattatccccccaattttacggataaaaaattgataaaccatttagtttcaaaaattacagttaaattacttgtgtaaggttatagctgcagtgctataacaaaaaaaattctgtgaaccactgaaatttagggcgtagcttttaaaaacaaataattagaatctaaatatattttaaagtaaaatagttataataaaatctaaataaagtttttatataaacattgaattgagaagattttctaagtgagccaagaaatccaaaaaacataatgagagaaaattgtggttaaaacatttaaatctttcaaattgatataaaaaagacatttcagaaaaaagtatgaagtaggaattcacaggagagaaaattcgatttatcttatagcagactttctcactgctgtcactattaatattttatactggataattcttagttttgggagattctcctgtgcattgtaggatgcttagtggcatccctgacttctattccccgaatgtctgcagcatccctcccatcccagtgtgtcaatccaaactgtattcagacattgtcaatgtgccctggttgaaattgggggcagaagtgtggagccaaatggcctgtagtggagacacgccgcgttatcataatgttcacacagcctctcaccacaggtaagaagaatgatggtttagcccatgccatttttgtcatatgcgatagaacagcacccagtgatagctgagtgctgaaaaataacaatgtaaaccgactctagcaatggataatgaaatttaaactacacatatctgtgacccaatctgttaaacttaagctacagtctaaggtatcagtatttgagtaaatgatccgattaaatacattccagagttatttgcattacatccaaattatataaacgactcaaatgtacaacaaaaaagaattggggagaataaattacaactgaactatgatattatgtggatttattaaaaatttgtgagtctggccaagcatggtaactcacacctctaaatcccagcgctttggaaggccaaggcaggaggataacttgaactcaggagtttgagagcagcctgagcaatatagtgagacctcatctctactaaaaatccaaaaaaattagctgagtgtagtagtgtacattgtagtctcagctacttgggaggctgaggtgggagaatcgcttgagcaggaggttgtggcagcagtgagctgtgatcgggctactgcactccagcctgggctacagagtgaaaccctgactcagataaaagagtcaatgtaacacatttttattgtgagctctaaaactggatgacttgagtttgaatcttgtttctcaatttgagaaaaatacttaaccagaatgcctcagttggcattctgaaaaatgggtgtgatagtagtacctgccttatagggttgttgttaagattaaacatatacataaagcaattgcataaattacatgaagcaattacacaaattggttaatatacataaggcaattaagagtacttagtacataactgaacaatgaatgttaaatattattgttttgttgcatctactaaccagacatgtattttgtgaactgaaaaaagtaagttgcagctattatattgtgtaggtttattgtttttaatctttctctctctcaggctgtagtgcagtggcaggatcccagctcactgcaacctccacctcctaggctcaagcgattctcctgcctcagcctccctagtagctgaaactacaggcacatgccaccaggactggctaattttcgtatttttagtagagacaggcttttgccatgttggcaacggtgatcacaaactcctgaccccaggttatccacccaccttggcctcctaaagtgctggaattacaggcttaagtcatcatacagggcctctctttttcataaaaaaaaaagaaagctataggaaaggtgcatacaattaaagggtataggagtgggattctttagtttgttttagtgtttttatttaaaatatatgtactatttgcaatgataatttgaaagaacaaaacaaattaaaaattagaggccttgtacttgttgaaagcaagggaaaatattttttctttccttccttttctcagagcattcatacacacacacacacacacacacacacacacagagaaagagagagagagagggaaaaaaaaagctttgtatgtaagttttttctttgtccctttgaagcgtatggaaatctttcaaaagttcaacaagtttcttggaagctttaggatccaggattgtatttatcaagtaatggtgaccatctctttgaaatgtaatcttcaaggaatacagcatccctatatcctagatgtggggaaggataggagactcattttagcaacgatcttgttctaagttgtagaactacctcttgtcataaagacatgaaaagttaagttgtcctttggataaaaccacttagcaaatacaggcggtcactccaactacccagtgaatatagaatgaattctatgtgacaaatagtgctaagtcctcatacttgaatatctagataatatttaacttgagaacatgtatatattggattgcacctgcttgaccacataaaaaggtgagatttctttccattttggcaatctcttagatttcctatgatgcagatcacattgtgttttaatgctttccagtaataaaatttttctctctgttctacctttgaggggaggttttctgggctgggatgagattttgcttaaaattgaattttcccaacaataacagttacaattaagatagaaattgtaattttcaattaactaaaaattaaaatttctaggatttattacacacacacacacacacacacacacatccatggcctttaagaaatacagcaactattagtatttatcattttgagacttttctccattgtgtgacatttaggatgaaaataaattaatggaacatttaaaaatgaaaaggtatttctaaagatttcaagaagaaattaaccagaaaatttaggttcgtatttgttatggtttcagcgcatacatcatcacagaatatctttttgcttaaataattaaattgtataatgtaattcagttgtgaataaactgacagaaaattaataagaaattcataatgtttttatctttgtgttcctaaactttgcttgaaattaagttaaattaaacctttggtattactgcacaaaatgtatataaaacttcacagcttcaccttaaaatagtagttttattcacttagctagcatactgataaatagcattgtgcttaatttgggaagctttccagaaaagagactaagcacaacgaacttcatttgctggaaaaaaaaaatttttaaatggaacatctctttcctataatcagtataattgctatggtgaaagcttttcaaggtagttagcaaatgcagctagatgatttttaaaacagttttatgtaatgccctgttttccaccagtaggtggtttgtttatattgctattgaagcttaaatggtcaagcctaattatttttggttcaatattgatttcacagtagtaaaaaaatggcagttacacatattttccccaaatagatctaaaatgggcttaatgatgtagaattttttaaaatgttagagaaagaaaaaaaatgaaaatttgttatccagtgttataaaagcttgttccaacaagtttttccttaaaatgaaaaaaaaaaattgttctcagaaatacacaatgaataaaagctgcatttaaaataaacatctttgcattttctgacacgagaagccttgacatttcctctgttacagcgggcatttattccattgtaacatttgcctccttttatggtttagttaaatggaaccttgaaaacccagattcaagctctcctacagtgtttccatagaactgttcattgtatcgcaaataatatgcggagatgccttccactccaccatatcacctgccatctgcctgataaagtaaggaaaagagagatatctgctccctgcctcaacaaagagtgaagaaaggaaacaggattattaaaattctatgtaaaatcagctataagaaaagatgcatctgagaatattttatatttgtaattttaatactttacaattctaaatctattgactaagtaatggaaatgacttcgatattttatattgtgttatatttatttctttaagctttaataaatataattgtatgaataatggattcatgattttaaggacaatatccaagtggtaaatcagaaaaatttacaacccgaaaacgaaatcatccacctaaataaacaagcagaatttcaggtgaatttcatttgtattttgttgtttcctcaatttattcttgtatggaaaattatttactgttataattagaaaatagtttagaaggtatttagtggtaagcatataaataaaaactaataaaatacgcaagtacacacatttacattgaatgtcatttaaataattccaacaacattttaaagtagccttgtccccatgtatagaaatttgtaattatttacaaaatatggcaaacaactgtattggatttcaaatgagtacttacatttttctgtggctgtaatacttaggttgtaccaagcactgatttcacgatccagtgagttacttgtagtgattgtaccattatcattgatattgaacactttgctcctagtaatagaatacctgaaccaaaaggaaagtataccttaatatttttattctatctgcataacagtgttagataatactctttaagcaataagacatcttattcaatgcatgctctacatagccaatatataataccgaacaacttttaaaacagtatattcctgtatttaagattcaactcagtggagatagaaaaaaagacgtaacatgactttagatttaaattgatggatgctaaatctaaaattaatgattgtgaatctttttttcctatcaaataaattaaaatatatcttcagcctagacgagtattgatctctttcctatgtcacaggtgttgcttgcgaatctgttcattttactacaactacttggcttgatatttaacaaatgtttttgtttgtttaaaaagtaaatttgataaaaagtaaagtctatatagtagatagaattttaattcttttgggaaacctgaaagacttctgaaatctggaatctggaatcaggaatccaaaatatttatatatatatatatataaacatatatataatacattatatatgatatatattttacattttataacacatgacatattttattacatatataacatatttgtaatatttaatacatatatgctttattctatattacatatagaaaatatgtaatacataatacatatatgttttatgcatatatatgtaatatatgatacatatgttttattatatattacatacaatatatgtatgtatatatgtatgtgatatattacatcacatgtatttattttatattatatatttttacatataatatatatgttttatatatatacacacatataaaacaaaagtaaaatacagtagttctaatgtgcttttagattgtgcatggaagaaagccaagttacaaatttctcccaagggaaaaaaaaaactgaaaaatgatctccacctccacaatgaaagaagacttcgaaatactcagcatgtctcatctatgtggaaacaattaataataaaaattaaagagcaataataactagggttcaataatggcttctcattgcatgtatattcctgaagactttgatgagatatcaaggaagtttaccataattatatggcaaagatgagaatattttaattttgagttcaagtatttccaaaaacattatgctactttgtagctaggtattcagataaggactcaatagaaatcacgaggaattaagctttaggggagttcagttttaactgtactccatttaaaatatttataagtattttccctaaatatccccaagtggttgcctttcacacctaatagaattgttggaaaaattatacagtgttttaacagttgttattttgaattaaacatctaatcctatttctgtaaaatgtcattgcacataaagcccatttaaagtttgacaggatgttatagtctttagtagtttaattcacatctgttagaatttaggaagaagagccacataaacaataaattggttcagttcccattaattaattaaaacagaagtaaaaatatatgtagcccctctaggatgtgatataagcagtgatgtgtaatatgtatcatttttcttaaccccttttagaaccacaaattctcgttatgtaagttttcttttcccccactccaccttcactggacaaaatttgtttggctttgaggtaagttttagttaaattttacatatatgtaaaatacatatatatatttttcccatttttaaactagggagacaaacatcagaaaattcataaatatgtaaacagctgacttatttagatatgtaccatcatgacctcagcaaaatttaaaatttggaattttcccactaatccaattaaaaacattttacaataattttggacttacagaaatgttgcaaaaacagcacacagcatttctacatgctcttcactcagctttttctaatgttaaaatcttatataaactttaatctgtttaataaattaatcgctataatttaattaatcaaactacaaactatagttggatttcactgttttttttccactcatattcttcttttacaatccaatgtagaatccaatacggcctttcattttcctgcgtccttagtctcctccacgattcctcaatgttcttgtctctcaagaccttgatgctattgaagagtattggtcaattattttaaagagcgtctctcaatttgggtttgtctgatgctttctcatgattagactaaggttacatatttttggcaggaataacacagacatgatatactttcttaggctatcatatcaggggaacatgatgttcatcatatctcatgaatggtgatattaacattgagaactcgaataggtgatgacgaccccatttctctggggtaaaattgctatttttttcttctgtaattcataaggatctcaggaaactattttaaaatgttctggtttctcaaacatttatccactaattttcagtatccatagaggaataatgttaacattttttaatactttctttctggaaccacaagatgctccaggatgatcttgtcgtttccttacaacagctctggattccagttatcagatgagttgcagcatctttgattggagagtagtattagaaagcaagatctaggtattaagagttcccattgcttcttgagtttcattgtttttaggtcctttgagcagacatcagcaggaaatatatgtatgtatacccatgcgtacaaacacatctatatttatttccatgtaattccttctgtctgtatatatattaagaaggcattcgtgcatcatacctcagatttcaatccagtgtgacaccttcatgtaacttttctcattttttatttgtaatcatttcttttgacaataatgcatcttagtcttactatctacagcatatttacttatgtgttcaatcccaatatacatgtagagtaacactgcaatccctaaatagtatccatgtaaaaaatatattcactatgtagagtacatttcttctgaacagctatttttttctctagatttagaattgaaatactctcttccaaaattacttaggttgtattttcctaattcctctccttttgattatgttatttgtctataatataataaagtacatttgcaatagtttgccttcaattttggggatatctccaaagtcctatttgatttttttccagagtttacactaattagtattttcatctatatcttggagaattctctgaacttggacaaaagaatagtcatgtgtccgccttcacataatgacacagaacaattttatcaccctcctttcctttgtcatatctttttagtttaggtaccacagggtttatttttgtttgttcattttttttaatccactcacctattgaaggatatttgagtcaattccagttattggagatcatgtataaagctgccataaatgcttgcatacaggttttcatgtcaaaataaatacactttctaggcctgctgcaacaaaacaccacaaactgggtggctgaaaacgataaattaactctattagatttattaaaatcaaagtatcaacagggtcatgcttcctttgaagcctgtaggggtgaatccttccttcctgtttctagcttccagtgatttccggcagtccttgctagtcttccacttgtagacgcatcgctctgatctctgcttcggttgtcacatggcagtcctctcccagtgtctgtcttcttataaggacaccagccattttggattaaaaacatacctgctcaggtatgaccttatcttaactagttacctccacaattactctatttcttaacaaggccacattcgggtgtactggatgttaggactcaacatgtctctttaggacacaactcaacccaaaacacaaagtttcctttattcctgggtaaatgcttggaagagggattgctgggtgttgcggtcaatataagtttaatttataataatcttgtatctttctgccttgataaactcacatattactgggcatttttgtgaatttcctggaattatctaggcaataatcaagtcatctgcaaataaagaaaactatattatttctctccagcttgtatgtttttatttctttttctcacttactgcatggccaggacttccaatattatagatttggactagtgaaagagtacattcctaccttgtttccaatcttaggaaaaaagcacataatattccataattaagtataatattagctgcattcttttgtagatactctgtatctgtttaagaatcttctattcatattgtgctgattgtgctgatagtttttataataagttaattttgaatattgtcaaatgttttttctttgtctattgagatgttatatggcttttcttttttaatctctcaatatggtggtttatatgaaactattttaatatatagacacatccttgcattcctgggtgcactccagttgataaggatatactttccttttcacaaatagctcaaattactattattgtaaagaattttcatatttgtttatgagggatattgatctgtagttttctttgcttgttacgtatggtaggatatatcagtggcatcaatttttactggaactgctctttttttatgaagctatttaactgactttttggtggtatatatatgcttgtgtgtatgcatgtgtatgtatacatatttatgaggttgtacatatatggttgtttgtaaatgtatacgtgtgtgtgtgtgtatgctaaggttatttatcttttaatatctttggattctctcaagaacttcctctaaatgtataggcatagcattgttcaaagtagtccctataatctttttaatgtctgtgggatcaatatgtgtgctccctttttcactttggtaataataatttttgtcttctctctctctctctctctgtttgccccttggcctttctcgatagagattaataaactttagcaatattttgaaagaatctgctactggcttcattatattactccgttgctttcagtttcactgcttgtgatctaatctttttatttcctttttgtcctgcttgctttgctttttatttgctcttttttttctaacaggaaataatacaccatctttctcatacttacaaaatatttcaaagtttgactttagacttaatttgaaaggaaacttcaataacgtccaaaaagtaaatcatacccattgataccaaaagagtaatccctatatctgaagtccaaaagaataaggcaattgtcttagtcatcacagacagctattaaaaattaccatagactgggcagcttataaacaactgatatttatttgtcacatttctagaggctggaagtatgagattatgatgccagcatgattggcttctgacaagagcactctttcagttgcagactgttgacttctgtgtccttacagccagagagaggcttgagagagctatctgggttccactttaagggcactaatcccattcattagggctccacctgtgtcacttgatgccttataagacccaccttctcgtacccacctaataccatttcattgagatttaggatttcaaaatgggacccaccttgtaataccatttcactggcatttcagatttcaaatatgaattttgagggacgtaaacatttagacttctgaaataatacatagtcttagtgataaaataaaaattttaagaataatttcttatgaagttcttaataattttatggtagtaattttattacagattgtttgggctcctctaatttttaccatacaaggctccttaaaacaattctatcatctcactttcaagtctaaatattaaatttttccattatttctgtgccccattttttaaaaattgacatgtagtttgttattataattcatataaaggtagatcttgctcctcaagcttttatgacctcaactaaagcaagagtatttcgttacaccagtttatttaccccacccaagacgtgatgaaactgagtttgggaatttccatgctttacagaaacagcaggtgattcttacttagtaggaaaaactaatatgagttgaatgaattggggctaatttactatgtttaatatgtgttagtgtttctcccacaacaatgagacatccctaaggctaaaatacaatatcctaatattttttctggttttcatagctcttaccatgcagtgagtattaaagaagagatattatcaaattaaaactcaaattgaaatcattttgcattttatgttcaaatattttggggatcttttgcttacaaagaaaaaagagataaataaagaaaaccaaaaagaagcctcctgaaatgtgctgaagtgggtattttcataagcaactgattttgtttttatgatgtattttgaatgtttgttaaatcaagctatatcatatgaaaaaaatcaacaatatcaacaacaaaaactgctgtatcctcagtgatcctaacatatgtatgaaaagcaatattatttaaaagacacttttaaatgaaagaacatctgtcaaatcattaaaacgtgttttttgatggatacaagttattttaaaaagtaataattgccagtataaaggtggaagtcattagctaaaatattttcagattgaagtaagtagacaccaatggtgatactataaaatacaaaacctcttaatatttggttgtaccttaggtttttcttcatatatatgtagcattttcacatgtagtaagcatgcaattcttcattgtgtattattgtgctttaaaatgtatgcagtggtattacctatgcatcacaagcatcatgaattataatttactcacttgtactcctaaaattaacagttttcaatactttattactataaatgataacatatgaatatcttaatcatcaaagcattttttaacattccatattatttagtgttccctgaagaacaatgaataggtatacagatacattttttaaagtaaaaaattgatatgcacttatacaatcactaaaatgtctatgactaattaagaactacatatgcgtatcagaaggcaacattttatgaactggaactataatggaaaagtgggaacatttcttggtatcaaaaattaaattgagctttttcattgagctactgcaagaccttcacagagccaaggagcagctagcattttaattaatatatgaaggtttctggaaaataggtgagtaaggaaaggtgttggagaaatcattacgtaacaagctttggttttttatgcccaaccagactatacctcaactactgaaacaaacaaataaacaaaatataaaacaaaagcaaaataaattataacatagtaactgaaaataacagactattttaatagatggcaaatatctgtttaattgtaatacaagaatagatttctaaccctttgaactcctttaagtggtatcctgtaaaacacaggttcccaacccccaaggccatgaacagcaggccatgaacctgtccatggcctgtaggtgagggcaggcgagccagccttactgtctgagctccgcctcttctcatatccacggcagcattagattgtcataggagcatgaatcctgttgtgaactgtgcatgtgaagtatctaggttgagacctccttatgagaatccaatgccagataaactgaggcagaacagttttattctgaaaccattccccttcacccccccgaccttggaaaaattgtcttccaccgaactggttcctggtggcagaaaggttgaggaccactgctataaaagctttctcaatttttgaatatcatttcaagtaaatagtatttaaataagccacttttttgttgtcgttgagacggagtctcgctttgtcacccaggccggagtgcagtggtgcaatcttggctcactgcaagctctgcctcctgggttcacgccattctcctgcctcagcctcctgagtagctgggactacaggtgcccgccgccacgcctggctaattttgttttgtatttttagtagagacggggtttcacatgttagccaggatggtctcgatctcctgacctcgtgatccgcccgcctcggcctcccaaagtgctgggattacaggcgtgagccaccgcgcgctgccttaaataagccacattttgatcagctttgtttcagctctaattggggctttttaaaaaacgattgttttcctcttatctcctttccccaattaagagggaatataatgcactgaattttaattggtaattgcctccttcttgcacgtgtttgaaatcaccaattttactgcatcttaaccgacactgaggttccctattttgcttaaattgttacaaattaattaagacatacagaaatatagatacagatataaccttgtttaaatttgcacgcaggctaggggcggtggctcaagcctgtaatgccagcattttgggaggccgaggccggtggatcacgaggtcaggagttcgagaccagcctggacaatgtgatgaaaccccgtctctactaaaaatacaaaaattagctgggcgtggtggcgcatgcctatagtcccagctactagggaggctgaggcagaagactcgcttgaacctgggaagcagaggtggcaatgagctgagattgcgccactgtactcgagcctagaagacagagtgagactccctctcaattaaaaaaaagattgcatgcaattttatttttaatctattttatatttacttatttattaatgcaaaactgaccttacagacatacctgataggagatttcctattgtctgggtctgtggcagacaccacgcctacaaatgatccctgtggggtttcttcaaaaacttcaaatacataatatggaaggaggaaaagaggaggctcatcaacatcttccacctggatcttaatgaaagtggtggaagcctcagtgtggtacttcatgagctgctcaggaacatgatggtttttaacttttgctctaataccgtagtggttctggtgctcaaaatccactttctgcaaagaaacacagtatacacaaaagaaatggctttagtaacccaagatactatttagaaaaaaggttttacctgttaaattaagtctcagtggcctttcagttagatttttctttttatgtacatggatctctctgatataattgttaatcaggcataacaaatctgggtgtattgtcacttacctattttaatttggagataaagttatacttttgaaagcataaacatctaatgaaactgagaattaatttcctagtatttaagatattttccaaaaagttttattattagaattaaaaaaatgttctgcatataattcaaaacactctgtaataactctctcatctctaaaatccttgtctccataaaacataaattactggttctcatttcaattatttaatgagttaaaaactaaccagctacacaaaatatgttatgttttaattttgcgctattctgcaaggcaaataattttaacatgtctaccttttttaatataactattccttcttgagtttcatgattagtaataatgtcaaatgtttgcgaatcatcctcttcaatgctgtaatccatttctgcattctctcctatgtcattatcatatgccatgattgttcctatagaagtcccagtgggtgcagattcagagacagtcaagcggtataaacctttaaaaacaaaattggaggtattttggataaatacttaatatagacaacttgcaattatagttttttgtttgtttgtttgtttgttttttcgagacggagtctcattctgtcgcccaggctggagtgcagtggtgtgatctcggttcactgcaatctctgcctcctgggttcatgccattctcctgcctcagcctactgagtagctgggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttccttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgggagagtctgcatgcaaatagtagagttccaagaacgatagtttgattttgagggtctgagcctgcattacatcagccatcctggaaatgcaaggaaatatagatcgaaaggagttggtaagtgaatgtaatataaaaaacattttgtagtcaaagatgacctaattgatttggtcctaagaaataattgcagatgtatttaaaatacataaatataactacaaattgctgggcacttttttttttatttttcaggagtaacttgtgtaaaactgatatagaactatactatttttaaattattatttgcaattgcattttcatccatgttaatatatgacattactcatgtcaagcggcatcagcaaacatgcaatattttaaagaatggaactccttagaattctaaaaagaagcacatataataaaattcttctttaaagggattcctagttcctttagaagcatggaggaggcagtcacttcaaagattgcatttgagaccttactttttaagtggaataagtgttaatttttaagagctaatattttactacatttttagagcagaagttgaagactgactatatagtagtgctttttacattatagaaaaattaaaagaattgtttatgttattggaagattaaaaatcactgacattaatctgtagaaaacaattacattgccatgaacgtgaaagcagatgtttaagacttaaatgttattgagttgatattaaactattggtcttcaaaatgaaaaagaactgaaatattttcttcagtcaatattttgtctacataattttccatactttcaaaaattattttattgaacataatttttacaaggtcctgtcctagaggctggagatagaacaggtgacaatatacataaaagctgccaccatcagctcatattcttgatgataaaacagacagtaaataagatactggtatataagaaggtagtattctggtggaatggcttaaaattaaagataaggtgtaaagtattcactgtagatgtgacttttggataagaattgaagaaagaaaatgagtatctggggaaatataatttcaagaagaggaaaagccagcgagcctggagtgttctgggaaaagagaggataattgcctggtgttggtttcttagtaagcaaacaggcagatagaaacactaagatttcaagaggtaatgagacaggactggacaatggcagattacttcagaccattaggactatttaggtgatactaaacctaaggattttgacgtctgtgagggagatgggaagaccttcaagtgatatgatcagacgtgcattttaacaagattataaagctgtgttgaaaataaactaaaggagaacaatggtgtaagcaaagagactagatgagagcctattgcactaatagagacgaaataagatggtgccatgtgccaaagtgctagggatggagttggtgagaagtgttcatatttcggatattttctaaggcagagacaacagcatctgcagggaattaaattttaactctgagaaaaagaaaagtagaaaaagtagcttcaaatctttatgcaaggaaggaagagggtatgcgtgtgtgtgtatgtgtgtgtgcgtatgtatatgtgtgtgttttgtgtatgtgcatttgctccaagaatattgaaagccaggagctatcagaattgtggaggctatcaattcaggctgggggaaaaattatggttgacctgggtatggctaccataatctgagtgggatcactaattcttctaattcttcaaacagtggtgtttatatcgaataagcaaggttttggcttgaagaacatgaaacctggatgtgtgggtacatgagatgggaaaatctgttggaaaaagaggttcagaggaggggcagctggaatcaggagttcagttaagtgtgtgttaggttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaggttttaaatgtgtaatatatatgtgtattatatatgtaatatatgtgcattatatactatatatgtgtattatatatattatatatgatatatattgaatgtatattatatataaatatattatatatttgttatatattatataaaatattatatattatatataatatgcatttatatgtaatacacatatataatatatacaatgcacatttaaaacctaatatacacttaactgagctcctgattccagctgccccctcctctgaacccctttatatatatatatatatttttttaaaaatatataatatatgaagttgatgagtagacagatttacttttgcgaagctcaagggagaagttcagtctggagatgtatatttaatatgaggttctcagcccagaggtggttatgtaaagccacgtgtctggataagatcataaaggaatgagtataaaagggaagaaagacgagatcaaaggcctgactcacaaatgttccgaagtttaaagtatacaaagaaaaggcaaggaaggaaaaaacagagactagtaagacagaagaaaaagctaatgagaatggagcattaaggttttcaaggagaagttgatcaattacataaaattcttccaagaaatcaagtgttatcagaactgagaattgacactgcattccacttaggttattgatagaaatgatcagatcagtttggtcaagtagtgtggatgtaactcaaacggagtaagttctgagattttgaggtcgttaattggaaacaataagtatgaacaatattttaaataaatcttctctaaagagaaaggaagaatacaaagcatctttagctaagtatggaagtgaaggcaagaaagtgtttttgttttgtcttgttttaggatgtgagaaaaaacaataataaacatgtttcgatgtgatagatatgaaccagcagaggacgctgttcacacaagggagagggatgtttgagagatgcctttaattgggagggtaggaagtgttgcccacaacagagggtataggtattgagtatttacattgagaggagggtaatgggattcccacaagggaaaaccatgtggacaagagtaaggaggccagaatcagattcacccacactcgtatatgagtgaaagtattaagaggaataccatcatctcatattcagacttgagtaataaagataattttaaaagatattttaaatattctaatttattcaaaatattttaatattaaagtcaggaaaaatcagagggaaactgagaaaggtagtagaagcttcaggatattttatcgcagcaagttccttgggaattttcctgtcttccagagtcttctacttgctatttaataatcatctgcataaatttagaccaaatttatttaataaatccagacactatttcccacatattatatgccaattattttataaagttctgggtatttcatatttaacttggtgttctcctcttgccttcagaggccatattaatgttgtggacagaagacaacatatgtatcatatacatcatatgtgacactacacagagagagacgaaggtgcagactctgacccctttgcctatagtccatccacagaggaactgttttctcaacccatataacagtggtaattttttaatatgacaaaatttaaaattgtgagatagagcagaaattaaaaaatgagatttgtgatatttattgaaaaatcaaaagatctgataaccttgcatatgttggctacactgagtagttgtctgtatcatttaggtgtgggcatttgtgtgtgcgcacacacattaacagatattctcaagtctgtacaactaatgaatggaaaattcagggtttaaaagcaaatttgtatgatgccaacttcctgtgcttattcatggactcaactactggaaggaagtcagtgaaagtagcatttcacttgggccattaaaaatgacatgatttcacttgactttgaggaatggggcaaggaacagaaaaggatgaggaaaaaaaagtaatcaaaagatagttttgtttctgtctataaacaatcaataactaagaaatcatgctatggtatatatttttattggctcttttctttgttccatgctaattaaattttcttcctagcatgataattacttatgctttctggaagtgcttataaatgtattcctgtagctaaaacagtataacctgaaaaataaatttcctagaaaagaaattcctccaataattgcataagaaaattttacgaagcataccatgtgtttatgtttagcttgcagtaattgcttaaattattagagcaggtgtggcctattctggcttataaagtaaaaagaaatacaaaaagtcatttttaaatgattatctatggtttgcagaagaaggaccccacaaagatatctgtgtccaaattcccctgaacgcataaatatgtcaccgaaagtggcaaaagagaattaagtttgcagatggaattcaggttgctaattagctgaccttgagatgggaacattatcctgctttatccaactgggttcggtctaattacatgagtgcttaaaagtggaagaggcaaatgtgtgggttagagggttgtcagtgtgtgaagtatgtgacactccttgctgcttctgggatgtgtgggctaaatcaagagccataaagaggccttcaggaattaaggatgtctcccagcttacagccatcaataaaacagagaccttaactctatatacatgtaaactgaattctgctaacccttaaatgaactaggatcctacagcaagaaatgcctccctgaatcctttgatcataacccaatgagacccataatacatttgttttaagccatgaagttagtggcaatttattacagcaagaatagaaactaacacattattctttcatttgtatttaacatttaacatgaattaaaataatcataccagaacaattgacaaatttattttatataattttagtgttaatgtagtgcttttagaatgaaaactatataatctacttatatttaacacactcatatttataatgtaatgaagatgtagaatcctttttacttactttctttaaatataggcttattgtcattaacatctgaaagtttaattaatacacttgttgttccagacaacgctcctggctgaccaatcatgtccttggcttgaatgattacccaatactcatcttgcagttctctatccattttagaagatattcttatgactcctttaaaaatataataaaattccaattatttcattattaatcatgacaaagttctagttaatttcttaaccattgcagtatacattattttgctatatgttgaaccactgcaatgtgacagagacttcactagagaaaaataataaaaaataaattaaacatcaacactgcctagagtctagagtgatcatcacaatattaggaacactggtaggcccttaataaaatactatgttaagataatccacaggtagaaaaaaaagaatgtcttgtttttactttaacctattttctgctatctcttctaacataatatcggcttgctacagttaactttgtccccgaaactctgaagttagtatattattgatagatttgtaaattataataccaaatttatgaaataaatgtcatgcccttattattttgaagtctacttagaattatgagatctgaagaagacctggttgttgacccagttattttatgtgtgtgtgtatacacatatataatatattcaaactcaagataattaatgataaatattgcaataaatgcttaaattctataaaattatttaatatacatttattaactatcactgaaaagaacctaagaaaatcttaagacaggttcataagagaggactcaacatttctaaagatttggggaacacataaacagtcacaaaaaataaataatacccaatacccaaatatatcaagggcaaaatattcattaaaaattgtgatattaatgaacataaagatggaaacaatagacactcaggactactagagaggggaaggagggagtgggggagatagttgaaaaacttctgattgggtagcatgctcactacctgtgtgtgacgggatcattagtaccccaaacctcagcatcacagaatttacccatgtaataaacttgcacatttacgccctgaacctaaaataaaagtaaattaaagaatacaataaacttgtgaaaaaaatgacatatgagtataaaatgcacacctgatttcaaagactgagaacaaaaaatgtgaactatctccatagttttgtattatttgttgaaatggtagtatttttgatttattggactaaatttaatataatataattttttaaagaattgttatatgaacttttaaaagataaattagaccataacatgaggggattttagttgcggactaaagtgtttcacacatgtaatcaattatttgaatccaatggaaagcattcaatatgttgcacaagtgctgctagcgtctccctgtatgtgactcaggggagagggacctaggagtctttgttccccattaactgtgcctactttgctttcaacttttcctctcagccttttgactgaataaaggatatgtatttctggatcttatgcacttcagaacttatgctttcagtaatttaatccatgtttgtcgttgtccataccaacgcttctccagcaatgcaagtaatagtttagctaacctgctcagtatagttaaaaagtcagtgtgcagggtaggggctgggggtggaaagaaaacatggtcacgaaggcctggtatgacccagcatgggtttgtactctagacacctccctttcttctctcttctgcatttctccacactggtgttcagttattctaagagtttcaactctttcccacctcaggaatttccctaatttttcccatgccctgaaatcatcttccactctcccttccttgtctacagactcagctaaactttctgatttccgtgtattctgccttgaccacacaacataaagtcaacctgacttgttttctcccactgaaactttttggttttacttcataagtacctacagtggaatgtatgtgtgtattactattcatgtttaatatctatctgtaagttccaagaaagaagagtccattattatatcttgtttttgttactattatgtattgttttaaattttgcaatttgtacctttataaatctagcaagttgtataacatttggtacatattcagcctttctagacctgaatgtgtgagggaattaaagtctaatgttttgaggcattcattgcatataataaaataatttttcttccatacatttgaaaaaataaaggccatgtacattcctgagagaattaagaacataggtactcaaataatattttttagaatctgactctctcaagaaaccctaattgaaaaaggctgagacattcaatatttgctgaatgaataaataagaaatgtttaaagatccaacacaatactttaattctttaagggttttgatataagctggaaatagtattttccttgtattaaaaaccatagaattttacttctttggcacttctcacgttcttgggtgattagttatatatatatattttttcagtggagactataatcttctaaaggaaaaaaaattacatgggcctaatctttgtttaaaacacaaaaattaatttttgtttaatgaattagggtcatatgattgtttaaagaaaagagaaaactgtgttctacttattttatattcaattgattaatgcagattggtagagcaatattacaaaaagaatcaaatattgtattcatgtaaatcagaaatctgtaaaatacagaattatttttaggtgaatgtctcatatcaatgtgtacgcttagccttatactcagacttaatctcagtcattctgcagggttatgcagctgtatttcattgtggttttagtttgtattccctgatgactaatgaggctgagcatttttaatatgcttactggctttctgtatattgttctttgtcaattgcttataaatgttttttccctatatttttaaattgggttgctggtctctttttctaattcatttaaaagaatctttacatatgatttaaaccacatacataagtaatttgtgctatggacatgaaaaatccagtctcctagaagtatcagctaaaagactaaaagtaattaaatgcttaggaattgcaatctttttgcttattgacatatcaggactactgtaaaacatgtttctaagcagataatttttgctgacaattgccttctttagaatcatgttaaactttgcttgtttcattcacaaatacctgttgttggttcaacagaaaaatatggctggccttgaagtaagctgtagaggagacgagcattattaccacttgagggatcgtcagcatcacttgctgtcacctggataactaatgttcctaaagagaacataatacaggaaattaagattgtggttttattcaggatgaattcagttctgtgaagcggtctttctttaccaagcaagatgttgttacaaaatgaaagctcaattcacctccttgttcttaattgtaaaagtaatgtatttttttgttgttttttatttttttcaggcaaaagaatataacttttaatacaaaatattcctaattcctgtatgcaatatggaattttaaacatgtagattgatggcctaataagatgtagctattaaacaattcattgtaatgtataatttataaatcataaacttttccaaggtgtattattagtggagaaattaaaaggaacttggaaatgcttttcaccaaaaattatagtgtagcctgtaccttaaacaaagtggagaaggttgataaatatttacaaagattattgaattgagcttgaaagagtatccagttgaggataaggatgggcataattattcagctcctttaattctcttctctaatatacctacttcctttgatgaattttttaaaaagcaaagtaaaatcttgcagatattgataacataagcattctcattaaaattcagtaacaagaaataaaatcatatggaataattatgtatacatttaaaattagtgctcagatttttaaaatatttattcaaaaatattgagttttcaaagtatctttctgtaaacatggaattgaatgttatggatcttatttgaaatatgtatttgttgaaacactgtttactgtgtcaataagaatagcaacacgaatgacacaaaatcaaatagcttctgtggttttgtttacaactagcatcatgaattttctcatcgtagcccaattttataaactgatacactctaataggaatccattctatacttcactaacatgaaacttttgctgtggccctaaatagtacatattctttgctcttttgtcttaatatttttataatgctatttaacatttgttttaatatcatacagcatattctattgaagtagaatttcttcttattcacataattttatgggtaatacttttacctgattcaaaatgaatcaggaaaactttttgcctctcttttccaaaacttattgaataaccactcaatgtgtagacacttactagtttcagatgttttaaagtgaatttatttagtaatttgtgaaagtttttccaacaaaatagttaacagggaccatcactttcattgatccatattgcgcaagacttgttcctttaactatccttctatgcaccgatccacttacttatcccacatttcctcattataattctctatcatttctttccataaggggttcccatccctggtttctagaattatatttcctatctttggcttcagatacaatcatcaaaatcataccattttcagagttgactgaaataaattttagtaatatcagtctttagagcccctaagctagtactatacaaatgagaaccaagaagtccagaaaatgcaatgactcacaaaaggtgacctcacactttgatgatagaaatatgtcatacagttaggttcttttttccagtccagtttttttagcatgctttttctataaaataaattttattatatatatttaaggtatgcaacatgttatgcatatagatagtaacatgattactatagtaaagcaaattatatctatcatctcacaaagttacccatttttgtgtgtgcatggaaagagcaagtaaaatctactcactcatcacaaatctcaaatataatacaatattattaactatagtcctcatgttgtacattagatctctagatttgtttatcttacttatctgatactttgtattctttgacttacatacctccatttcctccctcttcatatccccgacacattattttattctctatctttctatattgaactttttttagattccacatataaataagatcatgcaatatttttattctgtgtctggcttatttcacttagcataatgtcccccaggctcatccatgttgtggcaaatggtaagattttcttctttgatgagacttaataatattccactgtaaatatatgacacagtttctttctttattcctctatctgataagggatttatttaagagaactcatacaactcaatagcaaaaagccaaataatcagattaaataattggcaaagaacctgaatagatatttctccaacgaagacacacacaaataaatggccaatggttatatgaatgggttctcaacatcactaatcatcatgaaaatgcaaataaaaactactatgaaatatcacttcacacttgttaggatgtctattattaaaaagacaagagaaggcaagtgttggtgagagtatagagaaaagggaacacgtgcactgtaggtgggaatgtagattcatgtagccattatggaaaacaatatggaggttcctaaagaaattaactataaaactactatatgacccagcaatcccactactgggtatttatttaaagaaaatgaaatacaccactagtaaagatatctgcattcccatgttcactgcagacttattcacaatagcaaagacatggaaacaactctcatttctcttgatttccctttgtatctgataccagtgtgtactccttacacacacctggattattgtgcctgctcagtaacctactgtacacctgttctctcaggtctcctcttgatcacacccatagaaagcaaagaggtagtgacatgccagagcaggtgaacattttttactgatgcttcatttacttgtaaccaaaagttacttcttcagtgtttttctcctgttgtctactaagtggagaatctaatgtattctgttaatagattacacaaaataatttccctgagtgtgtagaaaatctaaaaggtcaaattcttagaaattttagtggaaaaaatctgtgatattataaatattcagaataccactcacacatgaatttgatggggattttaatttctggggaaatatttgttattctttcttatgacacttgtggcattttaaaagaaccaaggctatagaattggtgtaattcaacaatgttttagaaatgcttactttttggtaaggactatcaatgagtattaagtgattcactccttacattttttgtgtgtgagaagatgtttatgtgtatatataggcatatatgtatacaggtagatctaagtatggtgtatttacatatgtgtatatatacatgtatatatacacacatatattttcagtaaatgtgtgttttacatttactgaaaaggttccctgatgttcagctctgccaccttctcatgaaggggttccctatatttgtataatcttatctctgattctctagttggctccactagctattcattgctccagggcaaatattcttgtctgaactactgtagttttgtcctaggcgtttgctccttattagtgcaactcctgtaggtatttttcttcaataaaattgccttgcagaggttgcagtgttcagacatagcgccattgcactccagcctgggcgacagacatgtatctgtatctaatcatatatctttatctcatatatatatatatataatatatatatttaagagggcaaaaatatgcagcagtatttccaaatatttagtgcttgtagtttttctcttaatttttattcatgccttggaaatgttggctgtaaaatttagatgaatcttagcaatgctcgatttttacaggaccctaattatctttgtttattttatttagttgttttctactttcttttccctctttcagttattattgacaccatgatttataaaacacagtttaagcaattttaaatcctcttggattgtttctatgtttttaaagagaattaagcctgtatgttttcctaatgagtaacttgtattcggcagaaatcctcaagaaatagtcaagtaacataaagagatcacaataataattaaatataaaagcagacagcaatacaaaaatatttaacacaattgtaaatatttatatttttataaagacttgttatttgtaagcaaatcaatttgtacattcacctgtagttaggaattagttttatcgtccacataaaattgaaaatattactatgaaaccaataaagtgtctttcagtggaaatgatcaattgtcttatagtgcccctttcctagttaaatataggttaactaacacttgttggtttagacaacgaatgtttaattcctacataattttttataagaacatatgtaagtatttcagcatttgtctgtaatatcagaactgtgtcatgtttgagtcatagtgaataccaccacaatgctcttttcaagtactggaggatttctaggcttatgtaattacttccgttcatgtcctgattattgtttactgtcagaatcactccgaagaggtttatgagaaatgcggctcccatccccggtcatcccatttcctaaaaacaacccactcatcactatgaattgctgttgtgttctaaaatattatggctactattctacataaggaccattgtttacacaggccatatctgtaacctcttgaaacttttaaaattgtatttccatggaaaatatatttcaatttttttatataaaggagaaaaataaaaaaaacaaagtacatctaaaaatcaacttacatttgcaataaaaactttttaaaaattaagaataaaaggaaactttctgaatctgataatgaatgcttttaagccttgacagtaattatatttaattgtgaagagttaaaacttttcctctgcaataataaaaagaaaaaaatgtttttctgtcactattatttttttcggcattgtactgaacttcctagacaatgcaatgaggcaataccatgcagttataacgcatttatagacaggtagataaataaatattggaaaagaataaataaaactaaataattaaagttaataatattttctgctagaaactcaaaatatgcatatagttacagaaaaacattaaattcataaatttagcaagtcaacagggacacaaatgttatataaaagtgcattttttaatatatgaatatatatatgtatatactctggcatatatatattcatgaaacctattttagttaaatatataatatatatgaaaagaaataaaatattcaggaatatctaaacaaaaactgtaacctctgcaaaacaactaaagataaattaatgatataagtaaatagatgaaaatactggatttaggaattagatgactacttaaaaataaaaaaatacacagcttaaaagctagctcaatcaaaatcctagtggactgtataaatggttaacttggaaagacaattaaaaaataagtaaaatttgtatggaaaaacaaggaccaagtatggtccaggcattttttgtttgtttgtttcttttgttttgtttttgtttttttgagaggaagtctcactctgtcgcccaggttggagtgcaatggcgtggtctctgaacactgcaacttccgcaaggcaattttattgaagaagaatacctacagtagttgcactaataacgagcaaacgcctaggacaaaactacagtagttcagacaataatatttgccctggagcaatgaatagctggtagagccaactagagaatcagagataagattacacaaatttagagaaccccttcaccagaaggtggcagagctgaacatcagggaaacttttcagtaaattctgcaaggtcagcttgatatctccatttatctgtccatctatctaacaccaattttgtgatataaaatttggcacctgctttacacctttcacaaatatcagcttaaaacagactgtagatccaaatgtgaaaggtaaataataagaaaaataagaatataaatattagaacaataaaactttcagaaaaaaagaaaaatagagggggaaaagcaaaaatttcagaatcagggcaaatatatgtatataatatttatggaaaacatatatttagtcctggggaatttgatatttttctcaaagcccaaatctctttttcaatttgttaaacatattttttattactcttcccagcctggattggttgttcttactctactgaagaagggtagcatatttagggtgcattatctgataagaacatgaagcatggtacaggtcatatatacctaacctctttagtctctcttcattcatttgatgaacattttattatgatagcattaatacttgcaaagtgggtcttactccattggtggatcaaaaattaaattctacattttatactggaaataggtatttctaacaaaagacaaataatatatatgaacattaataaaatcttttttagagaagattttaacattaaatatagcaccagaagaatattcttcataagtatttacatcatttaatgagtttcttagtttaactattttatcatacagtgcctttgggttatcccttgtcctctttcagatttaactatatcttaagagaagtctatttattgctcatttgtctgacagactgtttctcacactccatggaagaagctacaagtacaaagtaaatgtttgaaaaattcactctggcttattttaatgacttaataatagtcattttgtaaaacagaaaatctgggacaaatgcttctaggacatgatgacagaaacatagaagtaaagcagaactgtcctgggtaaaactgaagatctggtcactcaatctaccttaaaacaacagtgacaatataaagtggccaccaggatagcacacaaaatgaaaataacgtagcacgagttgtgtatattgaattgccacagccttaagtcctattattccctgcaatacaccatccagtaagcagaattgggtaactaccaaatgatgggaactctgaaaagtttaaattaatgagatccttgaaatcaaattagcaaggaatgtaaacagagagtgaaaaaatgctttttgggggaccgaagggtccaaagttcagcatgcatacctgagtggggtcactgtggctggatcagaggtgccagtggtatttggaaatgcaaagaatcaaaatgacttgtagtttgtatccattctaagtgaacaaaagtgtgcttagaaaaaaaaattctcttagaatcatactttaattagagtagcttatcagttcacttattctgataataaacatacaaatataattactaatgtaatcttgggttccattattgtgtggacagttgacattgtttgcattactctggagagacttttcataattgcaaatttaaaatattaattatgtctttctagctagtttccaaatcttggcaacttttcatagcaaaaggtctttataaaaataagttcaacacaatatttgactttgcttattttatcaatcacattctttgcagaaacttattgtaacataggtcagtggtccttaacttctttggcaccagggaccagtttcgtggaagacaatttttccatggtcagggtggggagtgggcatggggatggtctggggatgattaaagcgcattacagttattgtgcactttatttctactattactacattgtaatatataataaaataactacacaactcaccataatgaggaatcagtgggagccctgagcttggtttcctgcaactagatagtcccacctggcagtgatgggagacagtgacagattattaagcattagattttcataaggaacatgcaacctagattcctcacatgtgcagttcacaatagggtttgcaatcctatgaaaatctaatcccgccactgatctgacaggaggcggagctcaggtggtaatgcaaaccatgaggagcggctgtaaatacaaatgaggcttagctcttttgcctgctgctcacctcctgctgtgcagcccggttcctaagaggccacagacaagcaccagtctgtggcctggttgttgggaacccctgacataggtgacacaggatgtacacttgtaccacgtgcttgaaaggaaaacgttagtttggtcatctctggaaattgcatttactgatatatttttcatttttatgacagaaaattttagtgtgataatagtatcttaacagaagataatatatttgttgtgtgtgtgaaatgaagcattcttgtaatgtttaaaggtgctaacctgtataaaactacatagaaattttaaagattgagagcattaatgaaagcatcaataataatttatccaaacatcagatgtattctgccatcactgagtaaaacctgaggtaaaggtagtgtaactctgtctctgttgagttatgtaaattttattattaaccaggagttatgcagaggatgaaactattctcatgcagatgtttaacatggcttacaactttattaaatgatgttctttcctgtgtcacatagaatgctttatccactggtgattatgggaagcatataaacaaaaaatcataaaaagtgaaaaattttcctatgcagactaatttagatattatgtaagcaatagagaaattagcaacctgtggcgagggcattttataattaaagcttacatttattatggaatactaaagtacaggtgccacagtatgctatagtgtttgaatgccaagattccagctgtagatttcaaaatgacatttactttagaatgttatattttattcattttgaattcaatagtaaggagattaactgttcttttcttacaatgtagatataaatttaatggaaaagctatttttacatccagttttagtacaagtatactttgattaatctgaaacaaatttattgagatgttgggttgtataattgtcaacttcaatgttatacagatcaaataatattatagtgatccacactctgcatatgtaatttctgcaacaataaaacaggattaagatgaatgaggtgatcaaatgatcaaatacatgacataagagttgtataggtatatctgctcactccttcacattgggaacttattttattagtacaaggataattatttttctaccagtactgactgacccattcttgctgcatttatacttgagctgcaattactctacaacctaaagtctcgaagtgaaactcaggaaacagataatattttctcacttgtcatcttaactgggcaaagtgttcttcaaattttttatttttctgtccatagtcacctaaaaactaggtcatttttattatttttgtgctgcatttttgacacctctactttttataatctgagataatggaatttaagtaaaacaaattagactgtgtttaataaatcaaacaatattatatttagaagaataagaagagaaattcatcccagtctcagtcatgttcaactcatgttcccaaaggcaagagatttatagaatctaattcacaaatgtgataaattttgaaaattcatgattttttattttcctgagtattaactgaaattaaatttgtatagattttccatacaaagcttaaggtgaatttaatatttctataaaagctctcctttatgacatattgtaccatattgttgatgaagaatattaaattttctatatgcttttccaaaaaatgcaacttaaaatattgcataataattacagagatcattataacatattatatttgaatttaaaatctgaaatgccaaaataagcttccttaaatagtaaggtaaacagagtcttactcactagttatccccattcattttcaaaagcatctggttttgaaaataaaaggaaatggttattgcaagtggaaggaatgttggacacttgataatattaaaaatgatgccctcagtgactacagatatgaaaaatttggtggaggatatttatttggaaaagctccaaagagagtggatagtctttttactagacaatatattctccttgcttttattaggcagaaatatgtgaaactaaattttaaggaagtcagattttaaattttccttttgcatttgcacatacacagacatataaacaaagtctattaacactaatgatcattcataatgtgtacaatatcaatatctatttattatggttgttttccacgtaatgtgactggctaaagcatgtttcacttttagcaggattttgtgctgatttgcagaagataagttacccgactctgctttggtttaattgcttattaagtagtatactacacgtattttaaatgccccttcttttttttttttttgacattataaggttttaggtaaaactagcaaatattactgaaatggaagattacatatttgataggctggctattcagatacaatttcagaatgatttccatgaatttcacatctcccgaaatcttctatttatatcctaaactattctaatcacttatttagcatttttttgtccacccatgtactcactcatttatttattcaatccttccaaatctcagtcactctatgacttgtggtctaataaatcttatatttttggatggcagaaaaatagtaactttgcaaatccaaagtgacaattgggaaagcataatgttttatctcaactctacttgaaagttctagtttgaagttaatttcatttcaaacataaatgcagtcagtaaaagcccatcattacttgtaaagaaatgtgtgtttaataagcaacaagttaataattttcttgattttatctcatgacataatgaaatatggattcccttcagtaattcaaaccaaattctgagttcaagtgcagattcaaatataataataggcagttcacttcaatacaacagaaatatatgtaagaaaaagaaacagcaaaatgtttgcaatagttgtttttgaagaataaagtagctggctaggaaatttggaagtaaggtcaatattcaaaaacttaaatggccgtggatatagaaagataatgaagaattgaagttatatttaggtaataaaacccgcagtattcattaatttaatactgagattgaggaaaaaagataaatcacatataattttattaattgatttatttacttcacagtcaacacaaatgcaggaatgcttcagaaggaaaccgttgctagaagtttggcaaagcaatagaaatattcccctatttccatattatataacacttctaatagcaactgaccatcactcagctggcctctccctctcatggaaaggttacacaaagtgctcattagttcttgcatgatttcatacaaagcctggaccctaactggcactcacacagtatgtattgattacacaaattgaaaagataatttgtacctctatctcaaattgcaatgcacaaagagatttgtgcttgctagatattgcacagaccaaaccatcttttgcaatctctctgaacatctacagtggggctgcactgataccatgataccaataattctctcatgggttcactacccaactctgtaaaatggcagtattgtacctcctcttctctaaaattttacccatgctctctcaattactgccttcgcattatgcttcactgacaaaatagaaacgtttattaactgattggttatgaacaaatatgttaacatataatctgtcccttctataagtacaatggattccatgaccctttctttttttttttttttttcaagaacagtgttttagaagttatgtccttttactttgcttcaaataatattattctctggaatcattccccatagtatataacagtgctgttcaatttcctttcttaaaaaacaattgaatagtcataaacaagcaaaaagtcctcttgaccttcatctttttctacctagcatctcacatttcattttctccctgtggcgtaacaccttttagacttggcttaaatcattattacttcctcttattcttccttttatgccatacaatagtcttcagtgtgctgtaatagcacaaattaaactgttgtacttatcaaaaaaccaggggtcttcaacttaccaaatcaaaagtcaccactctgtcttaatcttagcctcacagcagcattacacacggttgagggatttcttcttttggaacatcttttctcatatttttcccttcttcctacaacgcttgccaatcccactcattctaatttgccagccgactgctttttgcttaacagtcaagtcagcctggatgcttttctcttctccagctacgttctctgccaaagggatctcattcattgccatgcctgacatacgtgttatatgttgatgacttccatattgatgtatacagccctgagcactctgctatggattcttttttcctagaatgtggtatggatggcctctttgtataattcacctcaaatatcacctcctaaaatgtcccgtttcctccagacaattaataatcatcatacctcacccatacataacacttttatactatacatgatcatatattacctcctttaattaaaataactatttcttatttgtatataactaaaatgtgtttcatattagcaggtaactcctttatctcctttacaattttatctatagtttcaaaggaagattcctagcatgttacatcataatatatgcaagaagaagaagaagcagtggcagaggaagaaaagcaagaagcagagggaggaaggaggaagagagggaataaggagacagaggggagggcagtaagggaaaggagtagaaggtggagaagggggaggaggagagggagggatgaggaaggtgaactgtttctttgcctacctaccaaaatagagtaatttaaagtgctatttacatctcataataatttgtcttgatatatattacacaggcaaatttgtttctgctgtatttaaagacctatgttccaaacaatgtagaaatacatctttaaattcctacctggaatgttaaaaatcaagaatcagaaaattatatgatgaaatatgtatttttggaatcattggctaatgaatcaagtaatgaggtaaagtagttataagcatgttaccgtaatttaaaatggccattatcaagtcacatttatttgtcactgttaagtaaatttttgaattaaactttccagtatattgtgctacaaaaattttttgagtgaataactgagagaagttgtgcataatcacaatttcccctttactggaaagacatttctaatttccaagacagtcaattcttatatcttatggaaaccattctctcctaaatgcattatatttaaaatattaacaacaacaacactgggttttgaaaagtatctttgaataaacacagccacacacaggtgttcaaccacttagttttgtcttagtggttttttcttcatgattttgatgtatacaatagagtctaataaattcacttttcctatttttatgcatatcttgcaggattatcttatttgcttttatgagatacaaaaatatattttgttttgaaaaagaaattcttgtacttaagaacctagtaaatgaacaaggtctaaaaacttacgaattgctcaaataaacatatctaaacttcttttattcctgtgaaggctgagatattttaataacattaatatgtagtacccttttctcaaaattttgatgcatagtctaatttttcaaatattttacttaaacatatttgtagaaggaagttctagtatagacccttaaatcatctacttccaaaacatatccttcaaattttaaacctgcttcattgttaatatatctttgatgtaaattaatatgcaataccttctggagacatctctggtacaatggcctcataaggttcatctaggaattttggttcattgtcattgatatccgaaactttgatgacaaactcagactcaggttccacagcccttccagtagcgatgtctattacctgggctcttaagatgtagagggatcgctcctctctatcaagcttctgtatggcatatatgtcacctgttctttcatcaatgataaaagtacttccagctccagctcccaaaagcttgtactggaaagaattgtttccattgtctaaatcagatcttagctgcaaatggaaagagggatcatttagtttccaaacatctgaaatggacaaatcaaaatcaagattttctttttatgtatgttaattattccccaagttaatgattttatattatttccacattacattaaatgaggcaaaatattaatatcaagattaaaatctatcaccagggagaaggaagagtgaatatttagtgtaaagaactatacacatttcattattctaaacagaaacaaaaataattggataataaagcttcttttgtaagttatgcacaacatagttggttcagtttttatttataattaaattctcagtcactaaaactatactctcaaatatttatactagattgggtccttgagatagatagaaagacaatttagtgacatttaaacactgatgttctatctcttgcatgaatatacatggaaacaagaaaatattaggatgaaaattagggttcataaagataatgataatcttgactgttcattaggtatttattacatgtcataaaatctataaattgctttatattagtgttctcaagtaattctcatatcaatattatgaaatacatattattgatatgatcaatttttctatagagaagaaaagtgagattttgttttacaaacttttttcagagtcatatggtctttgtgtagatatagaatttacaccacgaggctatcaaatcttctatgaggctgtcaaatttcagactgtccactgacaacaactcagttacatcttctttagcccttgggttttagccataaagtataaaactttcttctcaatatattctacctaattctcaaatacacactttcagcctgtgcactcattttcatattttcaaaaagcaaagtaaattagttcatcattcatactgttgaggtattatttagaatttttaatttatctgtaaaaaaacccgtctaattctgatatagttaaaatgatcacatagcttttcatatcagaattatttgtatgtaagagaagaatgtcatggttccctaatcattgtgaatccacattttcttgattcaccatttatgaaaatgctcttattcacagtaagagttcctctgaaaatttacaaagataatcatgaaatcagttgtaaacaaattcatgatttttctgatggcttaagttataatttcttatactggataaattaatacactttctttgcggttgtggagaaaatctgaaggtactagtaactaattttgcattttaataacatgccgaatatcaatgctatgtaatgaaaaataacatccagattgtctttctggtaatacttcttttgatagttcttaattattcctaaaagaaattcttcatgcgatgatgtaagaaattgaggaacaaattatacaatcaaatcaatatatcaagtgagcaatgtatggttcatatttttaaattatatcatttcaatatgatttgataatttatttgatattataatgaagataaattaagtttagtaataagtaaatatattgcaagtatatgtgcagtgtaattttcaaagacaagtaagcttgacatttttaagacccagatttaagggaagacagaaacaaaaacgaaaaagcttacttgaacaccagccttttaatgtcataaaatgcatatgttaaacacatttcaatcaaatggcctgtagtattatacaattttctatatttttattcaaaaaatattttcctaattaggctgctactatcaatttgctaaacaaatatcacttcaaattttcacttaattgtacttcccaatcttaatcatttttcaaacaaatggatcaaagagagttatcttgaacgcagcagctaaattgtatatttactaactcttttgacaagcacctaaacattcattattgttctttttgaaatcagtgattcacttgttttttaagcctgatgagtttgtgtagcagaaaaacatttttcagagtagtttcataaatatgtctctgaaatgaaaaaataggcaaaaccaatcactgtgagaaaggaggtaaacagagattcatgtggggagtagaaacaaacaaactagaaaatgtgacagccccagaggtggcctgtgttccaattacactgatgcacttccctataacaccttatttactaaaagccaatagctgattttagcctgtcaccccattcagtgatgggagagtatatggtgttctgtgcagtccactgtaaaggtagctagagactcagttactgagtcggcacctaactgtggaccttcttagtgccaactgtgcgtattatttacctgtagtctgagtcgaaaataaaaggggttgagaaatatttcttgtaatgtgtgtgtgtgtgtatgcgtgtgtgtgtgtgttcacaatacaccctcctccctgcacgtttggaaatacttgcctaaaatcctaatctaaggctttggttgaatgtactcatatacatttggctgataacacaggtgaagttctatggaatccagataccatgctaacactgcagctctcctgaaagggctagaaaatgagagttaataaattttgagtgcttcaccctttgggcccaattaaattttagtgccagttaattagcggttaaacttatttcagttcatttatctagagaaaaagccttatggaaaaggacatgatattgtaatcacctttgtttaaagaaaaccaaataataaaatacaagccaaaaacataaataggagatgctttgtctcattaaggaattgttcttaaaatatattcttttaagaaagtgaacataattattccttttactttaactttactaatcaatttaagtgtgtaggctcctgaagctacttaactgtaggagaatatggtattaacctgcttcattaaaaatgaacgaggggtaaatcaacagctacttagcgtaacagaaaatcgggctaaatactgttggtaaatgatatttgtctcactgtgactgcttagattcattaccaaaaataacgcaataaagtttccagatgttgaaaatgagggctgcattttcatacgggatactgaagtgaaatttaaaaaccagagctatccctcttcaagattttagtggatgttttaggtgcttgcaaatctgaaacaattattgatgctgctgtttgaagcttttcaatggcttcactgtaaaaatgtggaactcatcaaatctccaaacttctccaacatatttatttacattgttgtgctatttactgtaacattttaaataaataagtacctggccgatgtgatgactagtcgtattcatttcctctggtacaaaaaattggttccacacccagccacgcttcactctcaaatgagatcgcactggctgcttgactttctttgtttgagagttttctgttgctccaagacaaggccataggagaggaattcccaacataaaacgcagcagtaaataacagttcattgcgttgactcttttgattccaactattactcttcagaggaaacaggacgtcactaacaaaaatcttgctttcttttataatcttttctgattctgtgtaccttctatatacctaaagcgtcagaaacaaaacaaaatttgacattttaaaataacattttctcacataattactaaagacaggttacaacttctgcatctgacaaaagtggaataaaaataaacatttaatttatcttccaattaagctggctaattatgatttgtagctcagcaataatttgattagaataattataaatttccactcaggcactgctagttttaaactgcagtcataaatctgcctgaaagttgaaagattgctctgggagtctcctggattgacagctgacattgagatagacttccttttaatttgacttgcttactttctccattctttctcagtaaaatacaaactatctcattaaagcaacagtcaatccaggaggaaaaaagtcttatttttcctttttatatttgatagagataagcttcctcatccaatttcccaaattatggtattttatgtagtaattaaatagacaaaatgacaattcagcttaaaactggtgaattcaataatcagttacactgatactataaaacactgaatagaaagcttgcataagatatttactcttttttaatttcaaagatatggggaagaagtgtttatcagcttaacaaaaacaaaatcctcttaggacaataaatacaaaatgattgttcctgggtaagaatgggtgaatgtttgtaatatgtaagaatgatatgaaatgtatcttctagtatttaaatattaaaacaaaagactctggctattgagttttacatttaaaactttccattgacccaaggctctctcttcatgatgggtacctctaatccttatatgtaacttaatagttttgcatttccaacatctacatccagccaaatttgatttattttatgaagaaaaataattttgtaagattcacaatggagtttaatgtcatataatcaacagaaaagccagagttcatgttaggactttttctacatgattgtgttttgaatcttctgcatgtatttttgaatgactccttagagattttttaggtctttggctcgtgttaagaggagttgttaaaaaacacctaattaagaaagtacacagggattctgtggtcccggtatactccctttaagcagatgtattccttgttaaaagtttacttaatgaaggtcatagagaaattcaactgaggtgaaatttatctttatgttacgtatttgaaattcagataaatctgctctttagaaattgctaaaatatatatttttggtagctgatgaataaaaatatttggaactggtacaatattattcatgaaaaagattttttttataagtttggcaaattattaccaacactgatatgaagttagctggctgtgtttcagtgaatataatttttgggaactttatattatggtattttgatacatataaagataaataaaatagtgtaatgaacacctggatatcattaccctgtttcagtaattaccaacacatggtcaatattgtgtcatttctacacgtgctcactttttaatattaaaaccaatttcaaattcatatcattttaaccactgaagccacacacacacacacacacacacacacacaagtatacatgttatgtaagtgtgtatacacacttttaaacatcaaagcttaaaattaagaaaaaattttaatataataaaatattcatacagtgttcaaattaaaaatctttatctttgaattaagatttaaatatgtccacacaatgcagttttttggtacatttctcaattctcatttggtctacaggtttcctccaatttttctttccgtttatatgctgaagagtcaaggttatttgtcctacagagtttcacatagtctgaatgttgctaattgtatcactgttgtgtgattcagtatgtttctttatcctccatattttttataaatgtttaggggcttgattagaagtaatataaaatattcatcaaaaatattcatagccaatcctattgcatgacatctttagtagactaggacacaaaatatatgttcaagagaccagaagaaatgttgaacgtgttaagcagaaaaattgaaaaaataaaataaagattaaacttttagagaataatactacaatgtctgtgatgaaatacactgcatatgattaatggcatattattcacactgagaaaaaaaaacagttaaactgaagacaaatataaatcttctgaaaaaacataatgagaaacaagttaaaaaattaaaaatgaacaaactatcattgagttgtgagacaatttcaaacattctcatttatgtataactgcagtttctagaaccaatgaaatttagaaactcatacatccaaaatgtttaacaaaacttaagcacaggtgttaaaaaatattataccaaggagcatcatgattaaattactcaaaaccattaataatgagaaaatctgaaaggtagacaacgatatgttatatatagaataacaaagataaagttgttagcagatgtctcatctcaaacaatgcatgccaaatgacactgcagaaacatttttaaagtattgaaaatgaaaagaaattaatccaactgagaatttctcaaccaatcacaatgatttttgtaaagagatcagctgaattgaaagagaagaaactgagctgtcaggtattggaacagctaatccaaagaacatgtaaaaaaattaagaggtaagcctttagacacttagtgcaatagtataagcaagaggctaaaacaaaagaaattgttgcatctccttttttcatttcctccatggaacagcactctaattcagaggataagcacagacctgtggatcatttcattataatggtagtgctacaaaaaactaagtcattttttatggactctggggtcgggggagtgcaaggggagtgttaagagtgaaaaagtactaagtacattgtcagagtgggaaactgtcttcaaggtttcacccactttactcaataaggagacctcatcagaaatgctggagaaagacctctgcccaaggccacagataaagccctctttacactttaacactggggctagtaatgcaaatatgagaagagcatgacctaacagaagggactgtgtccttgactgcaactcccttcagagaatgcaatgcactggttgtgcatcaaatctggtgtgacaagggaatgttttcgcagtgactactgtactgccaggtcaagtctttatagctgcctatcaccaggcctgaacaaatcacagttgttacaccaaagccgtattcctaatcttcaataaaggaaagtgggatgaagactctttctggtgtacagcatcagcacacaaggggaactacaatacgatacatgattaaatgagtccttcaagaagaaataaaataatactagaaggaaatctggatctatgcaaaaatagaatcaccagaaatggaaggtatatcagtaaatagaaagaccttctttaaattataatatcattaaaggagaattggctgttaaagcaaaaataataacaaagtattgtggagcatacatcatttacagaagtaaaatgtatgaaattaacagcataaagattaggaatatgctattttaagctccataaaccatatataaagtggtatgatataacttaaaatagattataataatggtacatgcgcatataataaacctaaagcaactactaaaataaaataacagagtttactacaggctacaaaatagataaaactgaagcctaaagaatactcaatctaaagaaaaaataaaagaaaaaagtgagcaaaggacaggtgaaaaaaacatacaagtagcaaagcagtatgtttaatattaaccataataataatcactctaaatattaatgggataaaaaaatcaaagtatgagatgaggattattagatttttaaaaagactcaactatatgtctttaaaatgatttaaaatataaaggtacagtaggtaagaatttaaagaatgaaaaacatatatcttgctcaactctagtcaaaagaaagctacaatggccataatattagataatgtagattttgggacaaagaatattagcagtgataaataatatcatttcataattataaatttcataattataagtgataaacatatcatttcataattataaatgataaacaatgtcatttcataatataaaacaatatcatttcataagaattatgtcaattcattaacagggcacaacttttctaaatgtttatacacttaataacaatgcctcaaaataaatgaaatacaagatgaaataaaaccttattgtattacaagaagaaacacacaaatctataattcaaattgattcatttctattcaacattatactgaaaattctatccaatgaaataagaaatgagaagcatctagattaaaaagataaaaatatgtttatttacacagggcataaatacacatatagaaaatcttatgaaatctataaaaatactggtaaaatctataggtaactttagcagggttggaggatacacggtcaatattaaaatcaattatatttctatttactagcaacgcataagcaaaatttaaaatttatacaacagtacattttataataatataaataattcaaagattgggacataaatctaacaaaaatgtgcaatacctctctattgcacactataaaatactgctaagaggaatcaagaaaaatcaatatgattggagatatttatgatgatactggatcagaaaactcaaaatggttaaaaatgtcaattccctccaaagtgttgtataaatgcaattttaaaaatacaattaaattaaaattaaaatacaaaataaaattccaaacaggtatttttataaaacttacatgctcattctataattatatatgcaaaagcatggggcttagaataactcaaagaacattttaaaagaagaggaaatttggaagactatgccatctgactttaacacataatgctacagtaatcattatggtaaagtattggatcaacaaataatttagtagaacaaaccacaaagtgtacaaatacacctacatttatgtgatcaattgatttttgaaaaagttcaaaaggtgaatcaatggagaaataacagtctttgtgctaaaacacctgagtattcacttgagaaaaagatactttcatccatactttaccgtgcatgaggtcacaaaaagtgaatacaaatttagatgaaatacttgtaatttctttggcaaagatttcttacaacaatatcaaagtgcacttgttaaaaactgttaaattggaccatatcaaaatggagataatctctgtatcagatcccattgctactgtaaagaattcccacaactcagtgtcttaaaatgatacacatttattgtcttacagttctataggtgagatgtttaaaatgaatttcactggactgaaaccagggtgccagaaaggtcatgcttccacccaagtctctagaggagagtctatttccttacattttccagcttctcaaagtgtattctattccttgcatgccttggttcatattccacctctaggccagcagcagagcatcttcaaatttctctctactctatcttcacattggcttctctttgttgtgttaaatttacctcttctccctttataacgacacttataatttcctttaaagtccacttggataatacaggataatcttcctacctaaagaccattaactgaatctcatgtttatctacagagatcacagtctttggttttaggtgtgaagaccttgatatctctgcgagccattatgtggtctacctcagatgataattacatgaggaaacaagtcacagactgagcgaatatttgttaattatatatcttgtattcagagtgtacaaggactttcaaaacttggaaacagagattcatcacaatttttttaaatacgcaaaatatttaaagagacatatcacaaagagttgacatgtaaaataagttaaaaaatgataatcaacaccttcagtttcaacgggtaaatgcaaattaaaactacaatgagataccagtaaactcttactagaacgaatataattaaaagactgaccttatcaagtactgaagagaacatagagcaactgtacctctcatacactgctagtgtgaatgtaaaatcgcatgactatttagaaaacagttctgcaatttgttaaaaagttaaacatatacctaccatatgatccagccattctagatattagctagatatcaaggatatctatctagatatctacctaagacaaaataaaattatatttccatatgaagatgcttacatgaatatcagagcaggtttatttgtaacagaaagaaactgggaaaagtcaaatgtctatcaacaagtcaatgtactaagaaagtgtaatatgtctatgcaatgtaatgatactcagtagtgaaaagaaatgaactactgatacagtaatatccaaaataataatgagtaaaacaagcctgccaacaaattcaggttgtgtgtttccttttgcatctaattttagaaaatttaaaacaatcatagtgactgaaatcagactaagaactgtgggaaaatgggggtgggaggaagatcaggagggaaggatgatgaagggacatgaggagacttttgagggcagtgatgattgtgctcattatctgtattgtgatgaaagtcttagaagtagaaatatgtcaaaaattcaattcaacttgagtatatgcagattattgtgccaattatacttcattaatgttgttaaaaatcttgacttgtcaaaacctagaaaaacaaattagacaactaaccgtggaacaacagataatagatgtttctgatgtgttatgatatgacctttataaagaacattgcctataaagtattttaccaaaaaaagttgaaagctaattttcaagttatgggaaattaacctgtaataaaagaacaaattaaacaggaaacaaagtaaacaaagtaaaaggaaacaatcaaacaaacccaaattgtgtctttctacagatttgctacccacagtgtaatctgtggaatagcagcatcttactacagatgcgaaatcttgagcttcttcacagataccgactttgagtctgcattttatcacactcaccacaaggtctgaatatacaataaattttaaaaaagcattgatctaccacaaaattgatctagtttatttgacatgtcaaaaaaagcaggagtataggaaagatattgctctagattaagaaagatttaagatatactagaactagtgtaaaatgtgggcattgtttgggtcatgactttacaaaactgtttttatatttgcatttttatggatttataaaaaatttagtctgtataaggtataatacatactaatgtagagatgagcaatagatgataatgagaaagtattgccagtttttttggtcattgaatgtttctttcttgttatataaaaacacgccctatttttagtcgtgtatacttgaagcatattggtattagaaatgacagggtgtcttgagaaaaagtatattttctttaaaatatctcaaaaaaatggaagataggcaaaaccattgtggtaaattgataataattgttgagttcgggtcacgagtatttggatagttgttcttttattattcacttatgcttaaaatatacgtattaaatcaacaacaaaaatatacagcaattcgtacttttaaatcaatatgttaaacaaatacaagtaattactgtaataccagctattgatgacaatgtatagaaagcagaactatacaacactcataaaatggaaaatttggacactattttggagaataatttggccaaaagcaataaattttacaatgtgtatataaagtagcagttgtattttactattttatacctagagaaatattcaaatttttccactgggaagcaagtataaattggattaattgaaaaaagaatgtttaaattaggataccatatgataataattatataagtgtttcacaattacaaggcaatgtcccataatactcttggcataaagcaattagttaagttagtaagtctaggcagagaaaactgacaaaatttgtcatggtaattacaatgattgaaataagtgaaatttgtctaaaagttgaaacttagaagtttctgcaagattctccttcctcgaaaacagtttaaagtaaatatgacaaacaacaacactcatgacatctgggtcatttttctaccaagtgctatttttccctattaaatatatgattgaaatatttctcaattcaatttaaagttaaaaatcatcatttataattctaaggaaaaagccctttaatttgaacactcttagataaaacattcaagaaaaatgaatggtagcagtaggtatatctcaataatgaaatactgtggctttgtttatactcctctatattccaaactttctataatggtcatacatttcagcagaagtgaaaaacatttcacataatgctccacttctgattgaagactggtggcagctgtcagcattgctagactgagaaacactctgggctgaaaccaggcaaataagaaaaaatgctctcgcctgaaatgggccctggataaaccagcagtggcattttgccctgcatttccaatcttgtttatattttccaatcagatgaatatgctaaaaaatctacctaacatttcagtatgaagaaatgctaatactatgtcttatgttagtgtgtttttatattttctcttattgctaatacctgggaatgttaatccatatttattttcaaagttgtaaatatatttcaaaataaaagtgcacttatattagcacaatattagatactaaactaattataatcatatttaaatagcattattataagaagaaacaacatattatggccaagtaaaattgcgagtatgtttgtgatgattaatattaggtgtcaacttgattggattgaagaatccctagatagctggttaagtattttttcttggtgtgtctgtgagggttttgccagaggagattaacattagagtcagtgaactgggagaagagtcaccctggttgtggttgggcaccatccagtcacagctgccagcatggctagaacaaagcaggtggaagaaggtgggagaaactggcttgctgagtcttctggctttcatcttcctcctgtgctggatgcttcctgtccttggatatcagactttaggttcttcggcctttggactcaaagtggtttgctgggggcctctcaggcttttggccactgaaggctgcactgttggcctccccgcttttgagactttgggactcggattgagcgactactggcttcctacctcctcagcttgcagagggcctatctgggacttcaccttgtatccgtgtgagttaattctcctaataaactccctttcatatatgcatatatcatattagcattgcacctctaaagaaccctaatacaatattttatttaatgtgttaattacatcccatatgctaggacttatattcagtaattttaagtgacctgtcctgtaaacaaatgtattcataactactgatcttaaagacatcaagtgtattctatacactgtactttattgaatggaagaaaaaaatgcataaatatctaacactgtgacatctatatctaatggttcactttgtttacattgaataaagatctataaattacattttaacgtttggaccattcttcaaatgacaaaatatatgttttctattatctcttcttagtatataatttttccccttgttctaaagattcttgaggtcaagtaaaaaaaataagtcagaatgatggatttgatggctgtgtgggggaagacataagttgaagctgggaaatgtggatgggataaatttagaaacttaatcctgtttgtgatctcttaaaaaatcaagggaaacttggcagcttcacagaatgacaccatgcataaaaagactttgaaatggctttctcagaaccactagtatgaaatataaagaaatgtgagtggatacagtttgcatacataagtgaaaaggaagcaatattttggggccaaaaattttaataacccatgtgtcaactctttctctaaacattcattgcacagcactaaaatgtgaaagatcattttctgttttatttatgaactctcattaagcatataatttgcatacttactgtcaccaaaaaaaaaaaaaaaaaaaaaaagccctctgggacagctacagcagtgtgagtcagaatagctatactggagcctctgatgccctctttgacattacacagccttccacattcactattgatgtgaaatcctaagatatacagcaacaagtgccatttcatttttgggctggatatcatgaactttattcaggagcagtggtagaggactgtggattaatgagcagcatatgtgaagtggtaagcactgacaacattaagactgagtgtgcaaaagttctaaaatgaaaagagatagattccaattggttaaataaatgctggtgaaatttcatattcttagatacagtatttcactttttattcccctccacaaactatcagaccatgatttgcccttatttgtcaagggtaaatttttgtatgctcctgtattgaagatttgcctaaaacacctttatcagtatagatcttaattatgtctttaccatctttgcagtctgattttttaaaattattgtacttttttatgagcctttggtgctctcagtgttatacaaaaataaacatcagacatataagcattgataattatattctttgtttaaaaaacatagtgacaggaatagaatgaaatgaagggcatctgaaatttatagggttcgtgtgagaaaaataggaataaaaacatgattttctttttttaacttttattttgtgtttggaggtacatttgcacgtttgttatataggaaaactcatgtcacaggagtttgttgtacagattatttcattactcaggtactacgcctagtacccaatagttgttttgttctgttcttatcccacctcccaccctctgccctcaggtagggcccagtgtctgtagttcccttatttatgttaatgagttttcaccatttagctcccacttataagtgaagacatgtgatatttggttgcctgttcctgagtgagtttgctaaggataatggcctccagctacatctatgttctcacaaatcacgtagaccaaggaaacagaatacagagcctagaagtaagactgcacacctacaatcatctaatctttgacaaaaacaagcaatggggagaagactctctattccataaatggtgttgggtaactggctagccatatacaaaagattgaaactggaccctttccttacaccacatacaaaaatcaattcaaaatggattaaagacttaaacatgaaacccaaaactataaaaaccctggaagacaatctaggcaataccattctgggcatagcaacaggcaaagattttatgacaaagacaccaaaagcgatcacaacaaaaggaaaaattgacaagtggaatctaactgctcttaagaatccctgcacagcaaaataaactattaacagactaaacaggaaaactacagaatgagagaaaatatttgcaatctatgcatctgacaaaggtctgatatccagcatctatcaagaacttaacaaaaatttacaagacaaaacaacctcattaaaaagtaggcaaatacatgaacagacacttttctaaagaagacatacacttggccaacaagcacatgacaaaaagctcagtctcacttattagaggaatgaaaatcaaaagtacgagataccatcttacaccactctgaatggctattatgaaaaactcaaaaataacagatgctggtaaggttgaagggaaaaagatacacttacactgtcggtgagagtataaattagtatttacattagttcatttatgtcatcattgtggaaagcagtaaggcaatttctcaaagagctgaaaacaggactaccattcaacccagcagtcccactactgggtatatacacaaatgaatacaaataattctatcataatgacacatgcattttcactcatgcacacatgaatatacataccataaaggtacacgaatgctcattgcagcactattcacaatagcaaagacatggaaccaacctcactgctctttagtgacagactggataagaaatgtggtacacatataccatgaaatattatgcagtctgattttaacttaaccatcacatgaacacaggctatttcttattactttcctgtgtgtttgcagtcaaacctgtacaatattttcatgtttttctaaaatgtgttttttctcttaatgttcttatgacaagatatactacagaaaaataaaacactgttttacttctaatatctaaacaggtattctactattcctttgattatttcagaagataaactcacataaacctgtctttatttttagttttcatgtacaattaaaaagcactgtaaacactctcaatagccaaaatccattcactgggaggaggtacataaaattggtctcacagttgaacaaacgaccaaccgttgaatacaaacattaaaaaatttatgtcaacatgttgttactcagcagccacataatttggtgccataattgtcaagtgaaataaagaaacggaacacatacaatataatttctttaattgaaggaaaaaagttgtagacaaatgcagggaagaagtcctggatatatataatataaattgattttatataaataaatgttattttgcaccatagtaaagaccaagagagtcactctctactgactttcgggttattttcccaaatagtttgagatggaatgttctaaagacagtttgctggagataagagtagcacatgtggagcaaggatggctgaataactaactcaacaccaacacttgctagttccatcaccttggacgaatagctcgacctctggttgtctcagttgtctcatgtgaaaattgaggataattattatgcctctcaaggtctgtgttcttgatgaaatgagttgctgcatccaaaatactgtccggcacgtattaagagttaaatgtttttagtgagctacatgaaaatagctattgacaggtgaataataagcatctagtgatttctgcatttctcaaggtcgaaatattcagctattttcatttctgctaaaaatatacacacataaaaagctttgtaaatgactattgcaaaaatactttagtatatattttccctgatgtatatgttccacatgtattttcaaattatttgaatgtcattattttttttctaagcatggttaagtgactatgacagatacatattatcatgcttgaagcaatacatgatattgcatggacatatataagctgaaaatgagcccagtgtgactcagaacaattatattttcaaagaagactaattacgacttaagggatgaaaaatattataatctatgcacttatgcagtttgaaactgaatctaattagaaattgtcttttctatgacctcttcttggttacataaagctaattattccatctgtgaaaacttgtaaaaatataatgtattccggaaagctcatggaaagctgaaatattgagctcaactaagcccagcttctcatagagaaaaacagatggcaattaatataatgtctccatttttagaaaaatattgagtaggcgtggccaaaatgatatatcatagacttagaatttgtggtgatcagagagttccaaacctttcccaaaacaaagaaaaacagaaaaacttaaaggttttgaaaatgctactaaaaaataagaataagagtttctcttcatcaatttaaaaaacacatcttacctctcctcttgggaagtgaacacatgaagcaagcaaatactataaagccttcgtgtgaaacaaataggaacacatggctctgggggactggagtggtaatattaaaatggggaagtagttagagaatattacctatctttcttctaatttgagagattctttataaaaaggaaaaaaaaaagaaggaagccacaaagtgtctataaacagtcccctttcattccaaaagcacctctgtagtaccatatagaggagttaacatggagagttagtggcagattttacactatgtggtgaagtctattttaaaaaatgatactaacattgtctcaatgctcatttcaaaaaggtactctgtatttttgtgaatttatttaaatcttgtctgtgtagttaaacacagaagcaagaaaattaatattagaacaatgttaagaaaaaataaatccccttcttgaattgttgtggctggaatatcttttggaatgcgtattacctattgtctttattcccacttccatgcctatccttttatttaatctatttttatcttatattaacattttaattttattagttagttacaatatgattttagtcttaaaagaaattatttggatcttctaatcagtgcttagaagcacctgcattaccaggacattgaaataattgttctgtttctccatcaaacaccctagatccatgaccttctattgccttcttgaaggtgatatttcatcccagcactctgactaatcctgctcttcagcaaaggacaatataagtaagagaatcaataataacatggaggcagaattgacaaaacttaatgaccaactggatgtcaaaagaaattgcctgtgttaggagtgtcaaatgagagttgggaaacgcagaggttaagataccttcaaaaatcacaagtgacaatgctaactggtgctggttactccagactcagaaggaactgcgattgctatcatgatattcttccttccactccatcactctaagaaaagcttaggttcagatttttaagacctcataaactgtccctaaattctgaatgactaatcggatgaaatggctatgactggtatataaaacaaataaaaaaaagaagaactaaaatgttttggttactgtggtagacatataattgtttaccaatatgtctcttgcaattgcacaaggttacatgactggttttactaacaagatatgagtaaaagtgatgtacaccattttcgaactgaaacactgaaaggcctatgaataattgtctcgtctttattgcttcctagtttggcaatcagtagttgaaggatggtggagcctctaccaagcctgcgtcactgagtgactgtgaaacttggatacacttcccccactaacttccacctgatgtttgtggtaggaggttgctgagaaatggaaggttaattggttactgtaatagcctagctccccgactaacaaaatcaactgtgtctctaatgccataatggtactcatctgttctcttagtaatttgtctcataattcaatggtacagtaaatattatattcatttcaaaagagaagaaagatcaaggtgagcttgtacaacaactcctcaaaaaatgtcattttgttgaatttcatttcagtgtaatattgatgagaaaaaagttgattcactgccagagccactatctgtgttgagtctgcacattccccccatgtctgcatgggattatctggatcctccagtcacttcccacttcccaaagctgtgcacatcacgctggttgttcatctacaaggccccagtctgagtgagtgtgaccatgtgagggtgatcctgcaatgggatggcaccctgtctagggttggttcccaccaatctccctgggtttctgggataggctcctgtcacccatggccctgaactggaataaccaggttggaaaataaacgaatacaaattattgtaaaatgaagatttgtaaagtacatgatcatcatacaaatgcaggacaataaactatgctgggtaggaaagagttcagcgagccagctgttatttgttaattcttgtgtttgaacttcatagtggccagaggtgatcctgacaatctttgttttgccaacattcatttcttgatttaacccatcaccacaactgccagtcactcactgattcgcccaaaattgggtaaataatgatcttactcatttttactaatcatatatatctatatctatatctatatatatatagatacagctcagatttatttcagtgtttaatattagaaatgttttggtccttatttataagtttagtgaagtttttgttaccagaaatatgtcatagggactaaactctcctttatctcaattagcctctgataaaattggttttattacacagtgtttcacttaaagttacagtttgaagactgaagtggaatatatgcagatacaccactaaactactgattagggaatcatacatcccaggcttcttttgatgattaatgaattaacagctttttagaaagcagagaataaacaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacgtaaattatatttgacaaattgaatgaatatacatatttgaatatatatacatatatatatatacacacatatatatatatatctgtaaaggcaacatgaaggattacatatttttcttcgaaccaacagtgtatttcattttcccaagaatttctaacagtatttatttctttgttcttatgctttcattaagaagatatagtttcactttgcacttgttgaaactctttttagccactgcttagtatagtaaataaaccattgtattcaatttgacagtttttgctgatgttgtgatagtagctacataatacctagacaaacatatcatccaaatgttcctttctccaattatcagttgtcctttcagcacatctctctataactgtaatatctataaatttactctactatcaaaaataatacttagtaagcaccactgccaaatggtatagaaagtactattttgttatggaaaagatataatataaacatgattttataaaacacaatccttcgtgaatggaaaaagaaaactaaagtcatgcactttgttaatttgcctttctttatgtatatatatgtttgtgttgtgtagaatcagtacaaaatctaaaaattaatataattatatcacagaaccacataaatctgattcacatgaactgagtgaaatataaaaatcatttgatccaggcctgcaaaagcactttatttgacaatagcagtaattatgactttaacaaatgaacaaatatgacaaaactattattattttgttagacctcattatatttagtttaaaattttattgtgaatgtggagaatacctcaatctttaaataaatatgtagacaaataagggttagtttgatccctcaatttcagggaaattgtttctacagaaacacagaatcatttcaaaagcttgacaaaacagataatcccactccacagctactgattcatgagctgggtattttttttaacaagcctcaaagatgactttacggtaaatattttcaggaaatatcatcaccatcatcatcttgtcaaccatactgagtgtttactctgtgatgattactatgcaaagataatggcattccttaattgacttgtcttacaataattctatagtatatgttctattatgttgctattttataaatgcagatactgagcatattgaagttaagtaacttgtcttagccataaagcaattggtgggattggaattaagacaaagaattttgctttctttagagctggtacctttaaccaatgtctttgcagaagccattttctggaatacgtatatctttaaaaaaaaaaaaagaaaatgcatgtagaagttggttaacacttatttatagaacagtgtttttcaaacttttcataatttattctcctatcagaaagaaatactgctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgacccgtaagtagaatctgcataaaatgtaatgatttgtacctccatgataccatagtttcatgacactagtcaagattcttaaacaatctcagattgagtatcttcagctgcaagacgatttaataaatgtaacctctagatcttctggataaatcccattaaaaataacagaaactgtagttagaatatatcaagtgtttaataaaggtcctcatgtcatataaacatgagatttatttaaatacttataatgtctgacttctttaaataaatgcttattaatcagttcctggagtgcataagataatcactggtaatcacccattgctacaagaatcatcaaaggagcagctctcaatataaatgctatttaagccatgcaggagagggctccttccaagtcagaacgattgaaaacgggaaatatttgctatgatcatttacaaatgattttaggtgtatacaccgaagattagtgtgcacagtttctattatgtaaaattttcagagttggcagtagacaacagtacaaatctatcataaatacttataaaaactaagagagtttagatagaattttaatttagcagaaggttaaaattcttaccttatattgtcactgtcacgtccgaatatagattttgaaaatcattgataatctagcaacttacaagtggaattctatttacctactttcctatttactttaatggaaaaaacattcctgaaaagtcatattggtatttgaggaaaattaaatcttggggttctattttgaagacattttttgcacattctggacataatatcttcagattatgtggcttcagtgagtatctgcctactgcatcacaaaacagtctaagcaatccatatttatctcttttctaatctccagacctacagaactactttccacgaggcatttcaaagtgcatactgaaattcttactttctattcactcttccacctaatcgttatgttccttctttcccttaatgaaatcagcatcctgttgaaagctcacacttgaataaaaggttcttctctaatgtttccttcagctaacctcccatatacatacatttgagcatgaagcctgactagagatgaactatgattaattctatgtcttaaatccctcaagtaaattcatttacctcctattacctccaagttcttaattcataataattttaaaatctttattttgtacatattcaaatatgaacaaataattgtacatatttatgggatacagagtgatattttgatacatgtattcaatgtgtgatgataaaatcagggtaattaggacaacaatcacctcaaacatttatctttgtgtgtatgtgttaggaacattctgaatcctctcctagctttttaaaaagtataaattaaattattgttaaccatattcactgtacagtgctatagaaaagacgaatttgttcctcctctctagccataactttatatctattaaacaatctttccccatttcctcttcttccattctttcctttctctaataatcataattcttcactctatttctgttagcttaattttattctagctttcaaataacagttagaacttgcagtgtttatctttctgtgcctgacctatttcacttaaagtaatgcagtccaggttcatccatgttgctgtgaatgatagaatttcattcttttctatggctgaatagtatttcattgtgtatatacaccacattttatttattcttttatttcttgatggacacttagttttcttccatatattggctattgtgaattgcaatacatatattgcaatacacattggaatgcagatatattttcaatatactgatgttctttcatttcaataaatacccagtagtgagattgctgaatcatatattacttctatctagttctatttttagtttttggagaaaccttcatactgttttacataatggctgtactattttaccttctcagcaacaatgaaggagttccattttctccacattcacaacagtatttttttttagactttttgataatggacattctaactggggtgaaataatatctcattgtgattttgatttgcatttccctgatgattagtgatgttgaaaatttttccatatacttattggccttagttcataaattcttgttataaattgtttataataacagcaaaataaataggaattgtatttttgaaagtaaccaataatgtttctggagtgttaaatactgaaagtcattttattttcaatctcacatctgtgactctatcttaaagaaataaattgatatctaaaatgttcttatacaaaaaaatttatcaatgtattatttattgtgtctaaacttaaaacctaattgctgagataagccatgtactttttgacatataagttctcttaagtgtttaaagatgttggataggattatggcaaagatatttggagacttgcatagtagaaaaacttagtagtcgaaaaaacctcagggtatcaagaaagtagagttctacatcacattgtattaaaaaataaactagtgttaacagatgaacacaaaaatatatatattttctaatttgtcactgaaagagaccacaacataaagaataattctggttatttcttccactaatgtacaccataagtttccaattctgatcttttatatcggccttcaattaagaaaaattaataatttgctgtatagctgaagagaagttttaggagtgaatctcaggaaacagaaataatgaattgaagggtaactggaggttaagaatgaagttccacaattcaaagtagtctttcaaagaagttgctgagagagggaaaacagagagttgggatgatagcaatgagaggtttggagttaatgaggattttttagaagatagataatgtgctgaatgaaaatgggctaaatgccccactttttaaagacccaactgtgtgctgaattaaaaatatctgtttcatgtacaatgacacccacaggctcaaagtagaggaatggagaaagatctatgaagcaaacagaaaacaagaaagagcaggagctactattcttctttcagacaaaacagacaactatcaaaaacgacaaaaatcggcattacataatgataaagggttcaattcaacaagaagacttaattatactaaatatatatgcacccaacactggagaaccaagatttagaaaccaaggtattgaagacctacgaagaaacttagataaccacacaatcataattgggagactttaacaccccaatgacagtatcagacacactaatgagttagaaaactaataaagatattcagaacctaaacttgacactttaccaaatggaactaacagacaactacagagcagtccatcaaacaacggtagaatatacattcttcttatgtacgtatggcacatgctctaaaatcaaccacacacttggccataaagcaattctcaacatgttcaaaaagcccaaagtcatacgaatcacagtcttggaacacagtgcaataacaataaaaataaataacccaaatgtccaacaatgatacactggattaagaaaatgtggcacatatacaccatggaatactatgcagccataaaaaattatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtggggggaggggggagggatagcattgggagatatacctaatgctagataacgagttagtgggtgcagcgcaccagcatggcacatgtatacatatgtaactaacctgcatattgtgcacatgtaccctaaaacttaaagtataataataataaataaaattaaattaaaaaaaaaagaaaatcactcaaaccatacagttacatggaaattaaacaaattgctcctgaacgaccttcaggtcaacaatgaaattaaggcagaaaggaagaagttctttgaaactaatgaaaatatagacacaacataccagaatctctggaacactgctaaagcagtgttaagaggaaagtttattagtcttaaatgtccatatcaaaaagttagaaagatctttacttaataacgtaacatcacacctagaggaaatacaaaaacaagagcaaaccaacccagagttaacataaaaaatagctagctgagctgaaagaaatggagacatgaaaaacacacataacatcaacaaaaccaaagttgttctttgaaagaataaataagattagtatagtactagaagactaataaagaaaaaaaaaaggatccaaataaacacaactggaaatgtccaaggggacattaccaccggccccacagaaaaaaaaaaaaaaaaaaaaaacctgagagactctatgcacacatagtagaaaacctagaagacattgataaattcctggaaacatacaaccacccaagactgaatcaggaagaaactgaaagagattaatagtgagttccaaaattgaatcagtaataaaaaacctacccaaaaggaaaagccttggactagacgaattcacagccaaattataccagatactataaagaagacggggtatcaattttactgaaactatttcaaaaatttgaggaggatggactcctttctaactcgttctataaggccggcatcattctaataccaaaatctgtcagagactcaatagcagaagaaaacttcaggccaatatcctggtgaacatagattcaaaagtcctcaacaaaatactaacaaaccaaatacagcaacatatcaaattcaatccatcatgataagattaccttgtttcctgggatgcaagattagtttaacatatgtaaataaataaatgtgattcataacataagcagaactagaaacaaaaatcacatgatcatgtccatacacacagaaaagcttctgataacatttaatatctcttcatattaaaaaccctgaaaaaaaggcataaaagggacatacctgaaatataataagagccatctatgacaaattcacagcaaacatgatactgaatgggcaagcgctggaaacatttcccttgagaactggaacaagacaaggatgctgactctcaccactcctatttaatatagctgtggaagtcctaaccagagaaataagtcaagatacagaattaaaaggcaaacatataggaagagataatgtcaaaatatctctcttcacagataatatgattctatacctagaaaagtctgcccagaggttcctagatctcattaaaatttcaacaaagttttgggatacaatatcaaggtacaaaaatcagtaacatttctatatactgagaacgtccatgctgagagccaaatcaagaccacaatcccactcaaatagccacaaatagaataaaatacctaggaacacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattaaaaaaaatcatactaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccatctcaaaaaaaaaaaaaaaaaaaaatcatactaatgttcacaggaaaccacaaaagagcccaaagagccaaagcaatcttaagttaaaaaaaaaaaaaaaaagctggaagaaccacactacctgacttaaaagtgtactacaaggctacagtaattaaaacagtatggtactggtacaaaaacagactcatagaccaacagaactggttagagaacctagaggctgcatatccacaaccatctgatcttcgatgaagccatccataataagcaatggggaaaggactccttttaaataagtggtgctgggataactggctaggcatattcagaagatttaaactggaccccttccttccaccatataaaaaaatcagtacagattaaatacttaaatgtaaatcctacaactataaacaccctaggagaaaacctaggaaatactattctggacataggccctggcaaagattccataacagactccaaaagtgattggaacaaaaattaaaattgacatgtgggacctaatcaaactaaagagcttctgcacagcaaaagaaagtatcaacggagcaaacagacaacacacagaatcagagaaaatatttgcaaactattcatccgacaaatccagaatctataaggtacttaaacaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggtgggaggaagggggaaggatagcattaggagatatacctaatgtaaatgacgagttaatgggtgcagcacaccaacatggcacatgtatacatatgtaacaaatctgcacgtggtgcacatgtaccctagaacttacagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgatgtgaatgtaaattagttcagccactatgaaaagcagtttggagatatctcaaagatcttagaactaccactcaactcggcaaccctagtagtggattatatcactaccattcaactcagcaatcctagtagtggattattaactatatatttgaaggaatatatagttctaccataaagatatatgcacaaatatgttcatcacagcacttttcacaataggaaagacatggaatcaacctggatgctcatcaacaatggacataataaggaaatctgacacatttacacaatggaatactatacagccataaaaatgagatcatgtcctttgccccaataggatggaactggaggccattatctcaagcaaactaatgcaagaacagaaaatcaaatactgcatgttctcacttataagtggaaaacttaacattgagtacacatggacagcacagtaatagacactggggcctaacctacttcagggtggggtgaggagagggcgagaatcaaaaaactatctgtcaggtagtattatcactacctgggtgatgatataatttgtacactaaaccgcagcaacatgcaatttacacatgtaacaagctagcacatgtaccccctgaaactcagagttagaaagtaaaaatttaattgaagctataataaaatatagaatactaaaatggaaagtacacttcaaagacatgctataaaaggtaaataagaatatattattattttgatacaaaatattttggaattcaatctcaagataagaattattttagtttcaaattgtataatataaaattgaatgtttagcctctttcataaaggatataatgtaaaaaattgtatcacttgttttatatttattttttatattttctgcatattaacttaaattcatatttgtaaaactttattttgttgagtttattcagagtatttaatcatgaaaaggtattgtcaacataaaacgtggtgccagatggactaggttagcacaatgtttaatgctattattgcatattttggggattttttttaattgtctgctatgagctgtgtatgaagaatgactaagtaatattcagccagcacggaaagagaaatatcacattttgtcatctttatgtggaatctaaaacaatggaactcatagaggcataaagtagactggtatttacagaggctggtggggtggggcagatgaggaaatgaaggtcaaatctcagacaggaggagtatgtttcacgtttcagaaggggttctattagacagtgtggcgaatacagttaatagtagagtattctacatttcaaaattcctaagagagcaaagtttaaatgttctcaccacaaaaaatgttaaatatttgaggtgatggatatattaactagcctgatttaatcattccacattgttttcatgaattctaacatcagtttatgtctcataaatttattcaattataaattgtcaattttcaataaaaaataaatattgaaaacatcctataaacagattaataaattgttttaacattaatggcatgaatataggataaataaatttctactttttaattcccaaaatgagaaattcaagaatatcaccttaattataaacaaaaatgtgtatggtataaaacaaaacagaagtgttttgagttttttaaacacagaagacagtaaagtatacgtccaagggttgtatgtaatgggttaaaaatatgtatcaacttaaggaaggaaaacagtcatgaacgtttatgaaacagtcgtgaatatagttaattcatgttacaagctggatttaaaaataaagatagataggatatcttaagtatgtaaatcctttgaaatttgtgccagatagaataaacatactttcttttagtacttaaatgtaacagcatttagtataatctaaatgcgtgactgggattattgaataaataaatgtgactttattcctaaaattttaaattatgtggactctgaacctgcaccaaattgtcaataagtatacagacagctagaatatgctgttgaaagggatgatgttttatataaaataattccttactttattttttaaaaatctggcaaccctaaagttctaatgttttgtttcataatatttaagggtcagttaagtaatgtcttgctgagatttttaatatttaactcactctcttaaaagtctattgctttttccttttttatgcacaaaaaaatctcaatgacatgattataatctcataaaaatcatatttgtgagttaagaattgtatgttttaaacactggtttaaaaatgcaatacacacacacgtacacaaaatgacaacatcgctttgtatctttaaaaatactttaaattaaatttcatgtaagtggttttattaaatccatattgtataaaatgacatgaaagttttataaataattcacatggtcttgaaattatcaaaggagtatacacatgcattcaaaattatctgttaatagagaaatgtgtagccaggtacacatatgtgtgtgaaaacatcaatacgcttatttattattaaccaataaatttggagtcaaatcctcatatgcctacagggttgggttattctataagcattcgataaaagagagaaaataatcaaaaataaaccaatgtcttacatagtctcccaaagaaaagtgttatttagaagaaggggaattatatccacctgacgagtgacattatagcccatttatttctcatcaaatactatgggggaagagttacattttgctttaccagttcaagagcaatttcaagcactgtcaagaagtatttgcttagtgacaaatgacactactctcttgaaaattcagagatgcatctataccttttctctttgcctttattattattctagttacattttatgtttatctttatgtttagtagtattatctctacatcaaggaaagtcatatattctccaccaggcctttttaggaataaaatagatggcaaactctctgacacaatttaactataaaacaacttaaagtcaaaaaaatagcgacttcttttctgtgatgtatttatgatttgctcatttccacaggaatgacatttctaaattttgcacacagataaaactgcctaggttattttaagacatgactgatgtgccaaaattatccccactttaatacagtatcttgcaaatttgcaaatttcatttatcatgaaacttcttagaattaaaaaacagctaaactggatctactgctctggtatgttgagaaaccactgtcctaaaataacatttcaaatttcacgtgttgtgccaaggcaggatttttaaaaatgatgttttgctttaatcttaagacatacttggatgattctgaatataattattgagtaattaatgtgacacattttgacaaaggtatgtattctagagtatgttttaaattcagacaagcattctcttaacgaatcatatcagcatattcaagagggcaggcatcatttgaaaaggaaattgatctgttacacattttgacaggctttagagcatttagctgtgttctctcaattgaaaggtggtgagagtgggtaaaaaaaaacgctgtaagggtacagtttatcttgttttgttttgatttgattttaaagtggcaaacatctttctagtcacttttgcaaagacactcattttgtcaatcaggggctgtcttcaccattgatagaaaggattcctgtgggattattattacgttccatacttagttgtgtttcaacttcaatctgtttcaccaaagcaaagatacaggtgatagaagatcatcgatgttaaaggaaatcgtcgtgacaacaaatttttcttattcaccagcatggttctcaaacacttggttaggagcaataaattctcatgtaaagaaggtatatagaaagatcaatatctccttttaaacagtttaacacatttattcctaatgcattactactcactaacatgctgaatactgctatgtaatgttttaaacataacatatatttaagagtacatgctaagatcatgagtggcaaaaatgatcagttgatatttagttatagatgatatgtatcagattatatgtagctgtattaggagaaattcctgaaagatggatctggtttcttaataatgcataggaggcatctgtgcacatcattttaaagcatcttcaatttatgataatttaatcaaaaatttttttatgtttcttgaggaaatgtaccttacaaacattcctaagtgaaaaacaaaacaaaacaaaaaatataagtagaagacatatgcttttcgatatatgcagatgtgtctgtgtgtgcctaaaattataaatatttcactggagcctaagtaaagaatttactaatgtgtaagactgtaaaaatcagatatttatataatgatatgagcatttcgttcactgttataaaggcttggtaaagtggaaaacatatgtaaaggaaaggagatctggtggtttctaaatgacataaattgattgtttaaaaattttgaataattgcagacaataatgaaatgcttattccttttaaaaataaattgttagttattttatttggtcaatataaatgttcacattacattgaaatttaaattctttgaaatcaaaaattatagtaagtaggcatactgctgataattacaatattaagaatttgaaaaaagaatatattaatgcatataattttacttaatattgtaactacatctaaaacataaatatatattactaaattttcaaatattttatctaaataatgtctttcttacagatatattaattcaacaaatgaattaatagagctaaaatataaattgacataatctaaagaaaacctttgccactctatttaggtattttttgttgctaaatattttatgtttttatatttaatagatttattaaatccctttggtaaacttattttgaaatattttattataattagttattcaattaaaattgcatgtaccaaattagaattgaaacaatataaaatgtcttttacagtatgcattttcctaatttatacttttcttaatttatactttcatatttgagaaattaccttttgtgttatgtataaatgttataatacatataggtaaattaatatgcctgtacaattttaggcatatatgtgtttttattcatagcaatgctaatattttaatttttttggaattataatatacttaaaatttttcatatttattctgtatatattttttctcatatacttaatgatgacaactctattgttcatattacctgatatacatggtaaatacatgataaataaaaaataaaaccctgaacaaagaaaaaagtgcaaagaaagacatgcaaagaaaggttgattcatttattctaagaaacttgagaagttttaaatatcctaacataggtgtaacttccccccaacaccaacaatctgtattacagagatggagaactgttctcacaaatacgtgttttgagaaagttcagtacaagtacacatcatggttttaaaatttttagaatattttccttatttcctatgtaaatattttccttaatatttttagaatattttcctagcaacattttgtcatgtactttttgacctattgactcattaaagatgatgcatgtagtttataatatgcctgattatcacagtcttacctttgtaacttcaacttctagaagtt

SEQ ID NO: 1578 - DNA, 205743 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccaccaaggttctgagaaagcttgctcttccctcatcatgctttccacctttccttccccttgggttcccagcgtcaatcctgtgttttgcaagcgtcggcctttcacgggaactgggaacttaaaatgtagcctgaggcaccgttttcgttgctttgggcaaagctgcagccgtagaggccaggaaagtgtgtcagtcactaggcagtgagacgccaggcttagggcgaaaaaagttttcctggaactcgggagctggtggggagtctctgtcacggactgagggttttttgtgtttttaaatgggagtctctgggtaaaggggcggggcgaggaggcgaacgagacaaccttagtattgtttgaattgaagcattgcgagggaacaatggcagaaaaaccgcgttttctcccaagtcctgttccggccctggaagagctgctccgggcgccacactgggatcctgttcgccgagcctgcccctccacgccggccgtgcacagccctgccgataccgtgggtgcagctggcgactgcactgcgaggctttgtccattttatacgttttgtttaaagagtaggagccacttttactgagctttatgtaaccatggctaaaatgaagaggtttggtaggtgaattcggtgcaggactcaaatgtttagacaggagctgaaagcggagggagctttcgagatgtccgctgtccctcctctccttactgtggccgatggagtagccctgccctgtggcagccggggcccaggtggattcctcctgggaacgacccctccctcctcagcgcgcactgtgccagagcagtacacaggtacaaagggcaaacgtgttcatgatttcatttgaattctgttgtttttacatcgttctgccctgatgtaaaacaaaccaggattttaaaggcagtgagtgatgaggagctactcccacttggggaagagctgctaactttacttttccgctgctgttggttccggttcaaagctcggtttgggaagtaagaggaggactcggagactttgaccagagcactccaggccaaagttttcttccagttcaggtctgtctcttcgtcccagccccgacttaagatcagaacctagatatttgaactagcccagtgaccctgtgaattctaatgcacaggtctgtactgcatgtaagacttggctcagatttatgaaccagaagcaatgcatgcacgcgcacgcacgcacactcaaagaagggggcgatccctagaaaataccacatcgggctgtgtgtgctttggttgtgctgccacctgcacccctttgtcccttagagccacttttataatttccatatgttcatgcctaaggatggtgggagtcccaggtattcttttctgaactcatcctaaaattggtagaaagaccaccaagcacctaggtctaaagatctaggtattagcctgggcatggcggctcacgcctgtaatcttagcactttgggaggccgcggcctgtggattgcctgagctcaggagttcgagaccaccctgggagaaacacggtaaaaccctgtctctactaaaatacaaaaaaatcagccgggcttggtggcgcttgcctgtaattccagctactcaggaggctgaggcacaagaattgcttgaacccaggaggccgaggttgcagtaagccgaaatagcaccactgctctccagtctgggcgacggagcaagactctgtctaaaaacaaaacaaacaaacaaaaaaaacctagttactaaacatagctctgccctaatctcttaaatccagagccccagtttccgtactctgaagaattacggcttcacagaggccaagtgccctaaggcagataggacacctctatgcctccccaaaacctcatcattgctgcaagctcacccccagtctctttgactctttgatctttggatggcaccaagaacattgattgcccagcagagcttctcaaagtgcaggccccctagacccccagacctaaaccctgaaaggcttgttaagaagtcaggccccatctcagaccttcaggtcagacattccagggtggagtccgggactccgcctccccacatgataccagaatctgggaaccactgagctacagtattgggttgagaggcagttgagattacttgccaattcactttattttcctgggctttagattctaactcaaccaaaaaaaatagatatttttaatcattttactagggacctagtaatatgtgttgttaagagacatgtagtttgttacgttcaacaaggggctggtcttctacttactcacttcttggtaaccactggctttaatggctgttccttgtgaaataatgtttcaattttcaactgtattgattaaagatttttcttaattgtggcaaggactctttcctgcgtaggtcagttcaggaaaaagggctgccgctgggagccctttggcttgttttgtttcggaagcagctaggatgggcagtgaagagccttggtgattacttattgggcacttcctgtgtgccaatttgtctgtactaatgcttctaatcctcacaagcaagcacactgatgagctaggtaactattattacccccattttacaggtgagaaaagccacaaagggtttgcagccctcgcccaaggttcctgtctttgtaactgaatgagacggattagaacccaggcctcttcctccacaccgagcttcccagggcctgaaaggtggccgggagggcactcctgagtttcagtctttgagtctcctggggtgtgggtgctttcttcttggtcttgaccgtggactaacagtggagcgggcactgattcctaggaaggaggctctccccctccttcctcctctgcttctcccactgtgaggatcaggggcagcaagtgaaggagagaagcaagacccttcccaaagggaggaaaggaagccgaaatcccacggggcagcctgggctctagactcagtgtgaacccaggtgatctgtgtgggcacctcaggacacactccctgctgtccaaggtgccctttctaaaggtgcccttgtttgaatgtggtgccaagatgcacaaaatggcttcgtgtaaggcagtgtgacacaggggtcccatcccagacttgaggcaggtgacggggtgcagttctcagtctggtgggcagctgaggggctgccgcctggggcggacattcgccaagcctctgcgtcctagttctcctctcccccaaaacggaggtgttactcatcccacccacctcatagatgggggtgctgtgaggtgtgtgggtgcatgtgaagcgccttggagggtctggcacagcctgggtgccaggaggtatcccctgggcctgtttaagggacttcccctcggctgcctattctaaccttcatggaggcttgaaagcactcactgtagccgctctgagcattgtcacctatctccagaggctggcagcagcctgagggatcaaatatgcagccggctgggtggtcacctgaggacctctggccgggacctggggccacaatagacgtgggttcacgtaggcatcagtgcggggcccctgcctgccaccctgccgcttagtttccaggctgtcctcggggctccagccccaggaaattcgcctgaccttcctgttggctgccaccgccttccctgccctccaggccggcagctgcggtggcaagtcctttccgcaggctttggtacagggaggagaggtgttcatgccgcacgaggcccagagctttctgtaaggatcgggaaggacaattctttcctgcatttcctggagctgaagcgctattgctcaaaacatggccctctgagaagaagggaaaagcacggggttcctcctctgctcgtggataaacaagcatatctcagctctctggaggctgttaaagtcttcctccatgggtggcttgtaggacttggccacgataaataatagcagagatttgtcagcagcatcccagaaggagaggtgggtaggaagggtaaaccgaaaagcgcaggagaggaaacaggctctgtacgaccaggcggctatgtttacaaccagagagagagaggtgaagaggaaaaggttctagaatagaaaaaagattttgctaaaataataaaaatcaaagaactgtgtttaattgtgtttctggggagagggaaagaaaatggatgtgtagtttaaataatagagaaactcaagggaaaaactgagtgccatggagatttaacttttcaaccctgtgttgataatataatgaagagatcaccatctagaaagtggtttgagaatgtctcattctttttatctgaagaagaatgtttgtctttgattagagggttttagagaaagctctgaaactggcctcatgctttgtgtctgctggtgtctactgtgtgatcactgctgaaggtaggaggcaatgtctgcaacccccagccttggctgatagagcttgtgaatcagggaccaggaatgacacaatagtcttgagaggccataaagtctaatccagcctgttgctaaccgggttctgacttcagggcaagacactttacgtgctttggctctggagcctggaagagaatgttgtgtggaatggatctctcaggtgatcaacataccatgagtaagttagaggtcagcagtgagggctggcctgtgcaggtgtgctaagacctgtgagggtgagccggggtctccgctgtgatgctggggatgagaaagcccttccagataagctccagaatagaatctatccagcctgcaccaggatatcgcttagaaatcaatatgccacatgggactttttatcttcacggtgtcgagaagcttctggaatccagtaaatatgtgacatttctcagttgagatgaggaaaagggcagagttcctggatagtcccctcttgctgtttccctctggtgcccactcccttcagttaatgagaccctgtcaggacaggtgacggcctaagtgactcactgctcttgatttcattggtggctccggaggacggtaatttttattttggttacccctgaaaggagaaggcggcatctaattctagggagacttcacaggtgtctccagtcctgttgatgtggccagagagtgaatttcaaaggacgtgcgagcagccggcgtccacccggcaggctcccaccccggtgccccgcgtccacccggcaggctcccaccccggtgccccgcgtccacccggcaggctcccaccccggtgccccgcgtccacccggcaggctcccaccccagtgccccgtgtccacccggcaggctcccaccccagtgccccgtgtccacccggcaggctcccaccccggtgccccgcgtccacccggcaggctcccaccccagtgccccgtgtccacccggcaggctcccaccccggtgccccgcgtccacccagcaggctcccaccccagtgccccgtgtccacccggcaggctcccaccccggtgccccgcgtccacccggcaggctcccaccccagtgccccgtgtccacccggcaggctcccaccccggtgccccgcgtccacccggcaggctcctacctcggtgctgggttccagcccctcccctgtctcctgagctcctggctggctcctgagtactctgcttcactgtcttctgttgccttggatgaagctgccttttgaagcaacatgcttttttgtaaaaccggctcctttgaagtgcagcctggtatcctggggcgggtcctgggacagaaaagctgcactagtggaaaaactggtgagattctagcggaggctgcagttcaatgtgataatgttgatttctgtaccaatgttgatttcttagttttcacagaaatgtgccatagttttataaaatgtcaatatgacatcatgatgtctgggtgaagggtatacagggactctctgtactatctctgcaactcttctgcaaatctcaattgcttcagaattttaaaatgctcccaggagtcagcagccagtcacatttggtgtgcatgggtcagatggacaagtgcatggagaaggctgaaagcagccagtctcgaatgagcagatgtgggcagcaagagggaaatgttgctcccattcttttctctcatagagtaagtgaacagaagtctcttccacttagtggaaaatacagcagaggtagacccaagcgaagcctgagtaaaaggatttttgtcccctggccgtgggtggagtcatttgtgaagacggggaggtttccctgtggagtttctgcagcaccacatgggaggcccggtggagctgtcatggggcctcttcttcgctggggagggaagtggccgctccgttgtttcctgagcccaagatggaagggcaggcttgtatcacagtgtcgctgcaaggacagaaaactgacagtggaggagcccggtgctgcccatacgcgctcacccctaggaacgcatcaggcagtaccctcgtgccctcctgggctgcacagaatgggagcccccttcccgcctgcctaggaaaccccatgggccacagggacgggcaggtggcaggtggctggtggctggtggaggacttaggcctcctgcacacgtgggtcacctgatagaaagggacaggccatggcagtgggattcagagtcccagcctctcagtggcctcagcttctgtgttagttaggggccaagggaaaggggcctggagccaggatggccagtggctgttgccttgcacagttgcctgtcatcaccctgccattgataactggaaatgagaagcatgagcagagccgcctctgcccggcccctgccagttctgctctgcacaccctgtctgcactccaggccttagccccggggggataaggatggcctgtccctttctatcaggtgacccgcagcaggtatcacacacctgcacatggctggagcctctgtcctttgcaactgaggcccatttcagggtctagctaaagtgtcttctccactgataggattttaaattctttaggatcgaggattataagtcatgattgtagctctatagacttgaaacatttgtcttcacccatcatccactttttttgtttgtttgttttcgtttttgttttagaggtggagtctcactctgtcacccaggctggagtgcagtggcgtgatcttggctccctgcaacctctgcctcctgagttcaagtgattctcctgcctcagcctcccaagtagctgggattacaggcacgagtcaccattctcagctaacttacgtatttttagtagagacagggtttcaccatgttggccaggctggtttcaaactcctgatctcaggtgatccgcctacctcagcctcccaaagtgctgggattacaggcatgagccaccacgccctgccatcatccactttttctcccagtaacatgtcttctttagctgacattgctgttcccacagtccaagttcagggcatcttgcatcggccctcatggaatgattcatgggtacctttatctgcccgaggcctgaaatacagtgggccctcaacagagcttgttacataaatgattgcagttagttggcagcaatgcaagcagatcctttggatgaggagtacagtcatggaactattaataaaagaggagattaaaatgtatttattcttactgtgggtttttttttcccaaattatctgctttctcccactggataaaactagccgtatatgatgataaaggaatcatggatcagtctgaaagatttgcattttttcctagggattgtttcaaccccacccatagaattcctgttttgttgcttttacccagttcagtgatctctcatgtgggaattagagaagaatgtgtgtttttgaatttcatggactgattatctggtacctggtggtaaatattatataacaatatttttccacatgttgagtgtttttggatccctgactgtggagtaatgggaccctgtgagatccaggaaaagggcttctgttggtgcacagggtcagacacacgtgccctggactgcatcaaaagccatggtttgtccacgagagaaaggagatgccgattggcagccgtgatgcaatcattgcaaactgtgtcgggaaggagcatcgcagcgatgcaggccctggagccaccagcccggccctccttcccgctctgtcctccccgccttccagtgacactggctccagattaggtgaaaggaagaggtcccctgggagattctttgtgggatcaccagaaccaaacctaagagagcatcctgaagatgcttccagcattccagaacctctcggagcagctaaaacaccctgcgaagaaacatagcaaatcctgtttgctgagccactggtgctgcaaactgctctaagccacggatggttcacagatgggtaaactgaggcatgtgcaggaaggcacctggtaggtcaataggaacaaagtggggagtgaaacctagaacttgccgattctaaaacctctgctcttaaccactggctaggtgaataagccccagccacagaatatatatacacgtcaaaatacagaaattgtggtacatgtaaaacatagatatgtatattatatgtagaaaatatgttatcaatctacatggaatatacagacatagatgatagagataaaagagagagagaacacacacatacatatgcaccctgtactcacacacacacagacacacagatgcacacatacatgcatgcacatagacacacaggcacacgtagacacacacatgcacccagcacacacatacagacacacacatgcacatatagacacacttgcaccccacacacacatacagacacacagatgcacacacacatgcacatagacacagagatgcacacatagacacacacgtgcaccccacacacacagacacacacatgtacatatagacacacttgcaccacactcacacatacacacagatgcacacacacacgcacatacacatagatgcaaatacacagagacacacacttgcacccacacacacacagaaacacatgtacacacacataaacacacatgctcatgcgtgtacacacacacacacttagccggaggacgctcctggtttctttcttcatgggagcagccaaggcagaaaaagactatacctgcctctggggagcatcaaacagacctgtttctttagggtcccttctgcagagaggctggacagaggcgggagggtgactgagtagcctcatgaactctgaaaagtaaaggctaagatgactgcactcaggagaggcccttaaaggatgaccaagaaatacatgagaatgggcaaagggacaatttcacctgcagaaccaagagtcctgcagacacaacccccaaccggccctctccaagtctggcttgaaactccgggccactggggtaaatgctgctgcagctatgtaaaggggaaaaggaggggcaaacacggctttatgtttggctgttggaaaattctgctagtcctaatttagagaaagacttactgaaacgctatgggcaaaagagaccttcccaaaattatcttagacgtacaggaaacccagtgggcactacagagagacaggggattccattttccctggaccaatgccagcttccttacgctgggtcttctctcaccgccccgtgtttgtgctgctgtttttcatggaagtccccatgcgccaacaggaggataggtgtggtctgttaaaaagaagtggagcctgtgggcttgagcccagcgactgggaaaagtcacttttcctttctgagaatgcttgtcttcatctgtaaacgggaatactgaaaactatgtcccagggtctcatgtatgtgacattcgttcattaaatgaacatgtctgatgctgctaggaataattcactcacgagttctagaacaccatggactcgtgtctgggtcagagcaaggacaagcaaggaaccgtgaagtctgatcagtgtgtgtgtgcgcgcgggtatggtttgggttgtccaaatatctgacccaactttactttaaatatgtcatctaggattattcatggtaagaaagcaacctgcagacgttcactatttgagagccactttatttgttctatatgagacgttcagtacgattgattttgtatgcagttgtactcatcagcaagcacctataagagcccccactcaccctgctcacaggaaatgtcaggactcaggcatgggccccacagaaatagggccagctggggtcttgggttcgaaactgctgttgctgctgcccagccaggtgatgttggtgcgagtattcaactctttacactgtagttacatttctaaaactgggttaaaatagttcttaccttatgcacgtgcccagaggagcaagaagaaattggctgtagagagtttagcaatcttagcattgcggtgcttgatcaacactagttcacatctacctggctttaggttgttgttttttaggtcttcatcctcaatacctaaagaacttgaagccacagagagtgaagttcaagttaactagagttattgttaactctagttaacagtatgaaataatgaaatattccatatttcattatgggcaggttgggggttgtgtctgcaggattctcggttctgcaggtgaaattgtccctttgcccattctcacgtatttcttggtcatccttgaagggcctctcctgagtgcagtcatcttagcctagagttaccttagccatggtactgggacaggaggaagtgggtcagcaggactggtgggtgcgggggcctgtggggggaggttttagtcttcacgattctggtgcctggagtgctgagaccctggtggctctgagcagatggccgctgagtgagaactggtggagatgcgccttcctgatgccttgagacggttatttccattttccttaagtttaggaaatgtcacccaaaggaaacattttaatattaattaaatttcagtcaaggtgtaactaacttatttccagaacaaatggaaacacttataaacaaagaacaatttgttcaaataaccatgagatgcaagtataatttagcaaagcaagaaaactcaagaggctttggtttggcaacatgacataaaaatgcagaacagaatcttaggagagagtttccttcttgagagagcagaaagattccctccataccatttcctagcagcgcaactacttctcagattagcatggaaaggcctcccagactagcccgtaccctccaacagccaggtgagtcaggccaagacgtgggttccctgaggaagattcccgctggaaatttcagggaagaacctcacctccttccctttcttccttatttggtagttgtcctaattgtaacaagcatccaagttacaattcaagaccaagtagggacctgaggtgatctcctgtcctgtctgaaatccaccttcctttcctagctgttcccgccagatttcagcgccctcttcccttctcctcccaagacagtcttagctcagacaggatttccttagtcttagtcatcagctcttattgtccggcctcctccttcctgttgtaaaacaaggaatcttaacagcaagtaggccaaaattgtgtatcttcagtgatatgtcaatttcctgccggtaagtgcagacatcaggttttgtggtggttacccacatcaaggcgccagaggttggaaaagtcaacgcatttctagttaaggcacaccgcacagtgagttttcagctgtctgccttggcttttgtgaatgtgtctctgtccacccgaaggttctggttctcgcatactgggctctccttttgccaggcgcagccgcacaacccaggaacagtcctaacccattacataaggtggctaggcggggctggcgggtggcactgccaggtcacctccgggcactgggtgacccagtcattggccccctacggcgaccccctgccgcgtgggtgccactggcacctcccctggactcccagtgctgtgatttctgggcgatttctctgctctccaacaagagtgatttgttatctgcttctcacctgattggaatttaatggtctagaaacaaatgagttatttcactcaggagggggaaggaagtcagattagtcatgctggtgcttgatttttttttaatccaagaattctttacttaagaagtaaaagcaattaagaatagtactgaatcctgcctagaagttccagaacaaggaatgggatgacaccgatagatatttcaaataactggaaagtttagttccctctgaacaaagtctaactctgaggccatctgcttctttttatatcaaaacagagcagcgtctcaaagaaaataagtgtatttaaaaggaaagatcataggtagatagaattcatccgttttaaaagttgcctttttctcctttttatagcacctttcaaaaacatctcttctttcaacacttctagctcatcagtgagagagaacaaaaggctacaactgttgattcaggcaacatttttgccttcatgttgatttttcttcctcattgggtttaattaactagagtgtctaagaataaacatagaaaaaaggcctgtttcatgggcttttcttagtctttcacatttaaaaaaattaccttagatctttattctttctaaatatttcatgtgtttaaaaactaggtaactttcctgtaataaaaaataaaatcttggcacattatcaatatagcacctaccttacaaacacagtgttgataaactaaccatctgaagataatcttactaatgtcacatcaggtctcatatatgtgcgtatttatatagtgtgcatgtgtgtgtgtgtgtgtatgtgtctgtgtgtatatatatatatatatacacacacacacacacatagagagtgtacatatatatatacacataatgcaaacctgtgtccatttttaatatttttttcattgttttaaattgtggtaaaatatatgtaacataaaatttaccattgtacccatgtttaaatgacagttcagtggcattaaacatatcacatttttgtgcaactgtcaccattgtccgtctccagaacttgctcatcatcctaaacagaaattccatgtgcattaaatacctctgcatcccatccttcccccaccctctgttaatctattctactttctgtcactttgagtgtgactactctagggacctcacagaagtggaatcaggcagtgtttgtccttttgtgactggcttacttcgtttagtataatgtccttgtattagtccatgttcatgctactgataaagacataaccaagactgggcaatttacaaaagaaagaggtttaatcaacttacatttccacgtggctggagaaacctcacaatcatggcagaaggcaaggaggagcaagtcacgtcttacatggatggcagcaggcaaagagagaatgtaccagcaggggaaatgtcagatgcttataaaactagatctcaggagaactcactatcatgagaacagtatgggggaaaccatccccataattcagttagctccacctggccccacccttgacatgtggggatgattacaattcaaggtgagatttaggtggggacacagagccaaaccatatcagtcctgaagatgcatccatgttgtagtgagtggcagaatttccttcctttttaagccccagtaacagtgctatgctttttaaagttcttatttttaaactcagttttgtttctttggttgacaggtttcaaatggttaatgtcaggtattgcaaatcagagaggtttaggaaatggcgatgtgagacccagctccagatgaaggagcagggggcaaggaagcctggggctggcctgcctgcctgtctctcggaggcggcctgcccgtgcctctgttcttgatgtttgttttgctttctggtaaacgttcaccactctcccgaaggaggttggcttgggccgcactgagttggtttcctctgggacaggcatgggaagctgtccaggagggaaccgggtgtctgggtgggaagccagtgagcgaggtctgggttgcccacacaggtgcaggcaccagacctaaagcagttctcctggagcagttcctgaagccccagaactgcgtgagattcctcaggaggaggacaggggatggacgcgtcaagacaaggggagaagacatatggggaaccccgggaggggctgtgagaggaggctgtgatcgggtgcaggcctagatcttccccatggcttcaccaaactgacggtcaccagcctcccctcttcctgtggtactggggtcagaagatggagagtggagacagggagccgatgtccacctctggtcactgcccttcttccctgctagacttcaggttgctaagggctgggaacttggtttattcatcaccaggtcctcccacagcacaggaccttcacatagatgctggagtaattttattaaatcagtgtgttatttaactcttccacggggaccctaagatagttaaggtttctctgcaggcgcagctggcagcatgatcagaggctactgaggccgcccgagtcaggtcagctggagcgggagggcggatgcccagaggaggctaacaaagggcgtgttgccatctcctttttacattttgaaggctttggcatgacccccaataccagctgttacaaccaacccagcctgggcactgttgcacagtctaggaggagcaagtagacaaagatagggatccactgattctatgaaaacttgcagctgattgaggggaggtgtcagtccatgggaagtccataccacaggggttgggagctacattccccagagttcaagggcctgttgctgccccactgccttagattcctatgactggacatcagaggcccactggtgactctggaatttctgttgcaccctctgtggtcagggagctctaaccaggtgatgccccgatgcctgggaggaggagcgcatccacaggcagttccttgcctgagatgatgtcaggcatcgggatgagggccccccctgtggaagctggacagccgtcttgctgtttgcttttatattttttgagttagtcatgctaaatataatgtctctgcagctgtaaaacctggagctgaagagaatgagtgtctgggaagctgggggccagcccacaggctcctctcctagacagacagagcatgcaggatgcccagtgccagcttcccctacctgctacctgcagtattgcatacaataagggcaggtggagttgaagtcagaaaattccaaaggaaaggggcttcctcctccacaccaaatctaagcacaggccccaggtggctccctgaggacagggaccaagccatgggcacgctgcccccagcgcccagctgggcatctgctgtagcagctggagtctaagccacacaatagacagagctggtgggaggaaagagagagggaaagtcgagattcctggccaggaccgaagctaagtagtttggggactttttgttcagaatcacaacacaaatcattatgctgagtgcgaaaggcatggccctcaaaaatgtgcaccttgggtcaactgaaggttcctctctcattggtttcacttgatttgaattacagtcgaaaaaattattgggtagacagacattggcttatctgcaaagtcaaactaatgcaaaatatgcttcaactgcaagacagagtgccaaactatttcaatttaatagcatggtttttttttttcttgagcttcaatgcaaagggaagccaggcatctggccagtgagcagtctatgagctgagctgtgcttttcttcagggcaggcagaggttggccagtggccttcttggcactcccagaaactcagcttcatgggcgtcaagggtaagaatgtggaaggtggtctggtggccaaaatcacacagtccctggatgtggtggtcaccatccaccaatgtccactggtgggcgataactggactcgctccttcttgacacctgtcctgctgggctcttgatattgaggctactggaggaaggagcttgcctgagaaggcacttccacaaggagagggatctgagtccacaggggaggggaggtctcttcgcctgaatgcatgagaaagcatactggacatgaagccccagtcctggctgggggtcagaagagatgggccggagcagcactgcccgaacggatgcacgtttgactcagccgatttggatcaggcaggtctggggctcctgggactctgcattcctaatgctcccaggtgatggtggtgctgctgcccagggtgccacagtgagcagcaggtcctagaagacagcctctggagggctcttctggcctcgggattgtttctgccttgagtggttgctttctagcaatagaaaaatgtgtaggtggggcctcccggcccctggaatctcccgccaatctttaaaacgtggtgaggaccaccctacgcttgcctgctgattgatacagctttaggaattgggtgagggaaagataattttcatctgttggttctttggaagggttaaggaatttctcatttacaaagctctttatcttttgacgtgtgggactgagccttccaggatcatgtcatgcctgagagcacgttcgacccttagcatggcaaaagcagccttcacatgcacaaggaggatggggagaagaggcatcgtaactgactgtatgaaaacgtctgcgtccccacaaagatggactttcttacaccatccaccttagctcagccttttaccaaagtttaagccacatgtgtccataataataatcggaaatcaacgcatttttaataagcatttagaaccaatgatcagaaacagaaagtgacactaatgctttgtggagagtttacccgaagatttttttctctttgaaatgaagtcaaaagcacattcctccccacctgttacctccctaagttgttaaaggcagccctgtttctcctggagtgatacttgattctccctggtgatggtctgccatgcattgatgggctctagttaaaacatctctcagacagagtcctttggaaaattccatgaaagaaaccgcctattagagataaaagcaaaggttaagtaaccagatagatcatagaagtgtctcccagggaaatcgtattggaagatcagtggctgaggtaaaggacgctgggcttgaacacttaactaaggctgcctgatcactggaggcttcctcctggaggcttctaatccccgtgtcgcttcagcctttctgtcttctcagattgcttaccccggtaggtgctgcccttcccttcgggacacggaagctacactttgctttgtgcattgtcaaggaggagaaacaggcacttcctgccttatgaatgtgtcctgttcctgaatttcttttttttttttttagacggagtctcactctgtcgcccaggctggagtgcagtgttgagatctcagctcactgaaacctccacctcctgggttcaagcgattctcctgcctcagcctcccaagtagctgggactacaggcgtgcgtcaccaggccgggctaattttttggtatttttagtagatacagggtttcgccacgttggccaggctggtcttgaactcctgacctcaagtgatcctccctccttggcctcccaaagtagtgggattacgggcatgagccaccaagcccagccccgaatttcattttaagtcatttgctcagaacccagatggcacctgcccttcgcccaggggtgaggagcttccacctcggagttcaaattcatctccatcagtccctgtggaacctgggaggagatctgaatttttttattggaaaatgcatcccctgtgagatgaatttataatcctccctcagcaagttgctggtagaattaaattctacagtgtacataaggtacttaaccacagtgtctggcatagaataaacacccaaaaggtgcaattcctgcactttcctctctatcctcgtgcacctaaacctcagcctcctctgtctgtctccctagtggcagctgccagccttctgctcccctgagtcacggcgtcttggcaagtactgcccaaagtgtttcaatacagagatagctcttcagcctctctttcccttagcacattgcaggccccaggaattgtggaaacaggctgtttgaggacatctgtcatttgagctttcactcaccccagcatgctggggcccttcttgggccctgcagccttcagggcgaggtcacacagaggggacacgctgggcccttcctgctgccccgcgcctgtctggctgcctcatcagtgactcctggtctgctgggaggtgcccagtggaaccccctacatcccatccgattcctaatctatttcctggtggtcaacctggccctctgctcggccacctgtggacagcactgccttcccttgagtgtgggttggttcccaacatcagagcagttcacacagtctcagatggcagtcacccgcccgctcaagagcgtgaccactttgtgacctgatcaaagatagacaataagcttggcttcgtgataagcctgtttaatgtatcccctcctcttattcccagaagttttaagaaatattcaattagcgactcagagtcacaacccagatacctctgcctgtctccagcagacaccgctcccaccccagccctgtggttgctaacctgggctagcctgtccccagcacacacacacccctcctgctccaactctaaggtgctaacccaggctggcctgtccccagcacacacactcttacatctgctccctccctggtttatgattcccagggggcccccacccatggaatttgggcgtccccagttactctggttgggttgtttacccctccactggcttgcttcctgcccttcccggggggtcctcaccaacccccaagagctcagcacacacaatcacccactccgggtatttcagacaaacttctcctcgcgtcacagaccacatttgattccatccaaaacacaatctgtgatatcacctccaccacccaaccagccgtcccagcaggtcagtctcagaaatataactctgcattttacatttgactcttgtcatcaaaagacaagcaattgaatgtgctttagagtgattctcttaaatagtcccagatggtttttaagtgtgtgtctttctatagtgaagagattgggggtggggtgttgggttggaaaacaaagaaattcagcttgaagtagtcagcttgtgttgttttaggagaggaattcattctgtgggtgtcagtgaagcattaaaatccccccaacagctccagagaaatagttccctgctgtggcccacaccccagctaattctgttttcgtcattagttaaggcagttgtcctgggtgaagtcttagcacttgtccatcatcttttaaaacttaacgcttgaagcaaagttgtgactgtaaacagctttgcaactcttcggtcacacacacaaaatgattcatttctcatagtcttagtaaagtctaaataagtttttatcatattttcctaaaatcttttttatgaaaggttttttaaatgatgaagtgatgtatagaactgttaactcaaaatcatacaccacaaacctcatcaacctagactaatcactctgactttgcagtaaactgtaggcaagaaggagtcttcagttaaattaatagtctggaaaagttgatcaggaatataatctgtttaagaaaaaaatcttcttaaggaacttctgggacacttacttgtgggcaaaaatcaaacgttcttgataaatattacgaatttgtttaattcgtcctgaagagcctctgtcggaggaccatgagttccttgctcagttgttggattgtttaaaaatcagttaaacattgtttctgttttcaaaattttccaattcagatattttttctgttccaccattaaataaaattaggaatattttccactctggcttggcatgggagaagagacaacccctggcaggcaagttcactgctatctgaagcaaatgcggtgcaagctgagatttgtgtccatcgagcattttactgtctttctctgtctcatcccttggtttcatgaaatatgaaaatagaacagcgcacttttcagaagaaatcgatggctcagacacatttaccttaatgggctgctgggcacgtttaattcaacgactgtgcggtggtaaggatggtagataaggacattgttctctgaagggctcgttctagaccagcttgcccagactgctgtgaaggtgatccaggggcccagagcagacagagagatgacgcccagagagacgggcgggctccgtcacccagcagcgtctcctagcagatctgagatcctagcggatccaaagctaccatggagccctagtccactgcagtcttgataaactcatgctgtcatctaattcactagctaaatcacttcatatattagatcactttttgagaaaattacatgactcactgtttttaaaagcctgctttggaaatgatgaacagaaccttctagtagtccaaaacccattgagctttgtagaacaacattatggaacaaattttatacttctttgaggtcctgtattctggcgaaaaataaattcttcttctattttagcacaatgtgtttaaagcccataatcagatacagaaatagaaaacatgctaatctgaataaaatgaagaagtaaatggagaagtttagacctttaagcaagttgcttgttacttcaatacttggggtattcgattttttaatgcaaatgttttcaaagatacactaattttgaaataatgtaagacaccactgcaatcactcttacattcccggtagacctctgagagcagcaaccaccctccaccaccccactaacatcatcttgaatcaacgctttaagaaaaaacatacttgctgcagtggttctggagctggagaaggaagatagagccagccacaggtgggcgtgccctgcaggggaaggcgtctagtggtccctccgtaccacagagcattcccaccctcttccctcactgcgggtgccacatatttgttgtggtttctttgtggttgtcaaagccaagtttcataggtgttatctcactttatcctcatggcatccttggaaatagagggcacaggtgcagtcataccaaatacagacaaaggaaaaatgccagtggaagtcaataacatgcctgaggcctctggtttgtgaagagctggtgctggaaccctgactttcttttactcaaagggtttgtcccaagcgaattattccaggtccacacggctctgtttgaagtacttcggtggatgcatccatctggtattctcaaccaccccatgaaagagacagaggaaggttatgaccaccacggcactggcaggaggagagaaaaacgcccagtgatggctcagcacacccagcaaagtgcataattccagagggtgaagggtgagttggtgcgtgcagtgaaatacgatatgacgaggccaacttttcatctgtttaaaggacaagaccaagtgtgacagattcaagtatatgtctttaagttgccaaatgaacactgtgtgtattttgctttttggtaaatacaaattactcttctgaaaatttggaagcactgtgacagttttctaatgaaattagacggagaatgagttttaccattaaggactcaaggctttccacggcccctttaactgagaatggaccttgattttgttttgcgagtcactcttacagctgcatgacttcatctcaagcaagctaaataaaggaattttcggtattataacggtcactaagcagacaactgacgtgtcagcgattagaaggggtaaggtttcggggcgagtgtggaaagatactgctgtaacacgatgttttactcggtggcttcattgtgtaggtgggtggcgagtcggaatgaagctgggaggcgcggggtggaggcgggggggcagccccaactccagagctcttcccagccagaatgtcagtctgattggggcaaatcccctgaagtctattgaaactccccatctgcctgttcacaattcatctaagcaactctgaaaagaggataaacctcctcaggccagtatttctgggattctgttatggttcaaagcagagtgcatatctttgtttttccaagtgtccgatgtctgtctacctctcctcttggaaacgcttctccgatccgcagggcacgatggggtccccgcggcctgcggtgccttcccaggctgtatctacatgcagcagggctgacttgggccttctcctttaaatgaaagacctcctactagatactttttgctgagagcaattagtttccaaaacagcaattaagaagagtttgctagcagtaactgccagcagagttgcctgttttgacctattttggctgagtggttcctctctaaatggtttggtaatcagactattaggctgctggggagccttccccaccacattcctctatggtgtgtcttccatctacccgatctcgccgtgccatcactactcatgaaattgctgtttaaataaaccctgggtgttcagattctcttaggatcagtaatatttttttctttccatgcagctttttttttaaaggaaatttactgatataattttcttctagaaagatcacaatggtcttaccatcctccaaaaatcagcttgaacattttatactggtcttaaaatatgccaataaaatcgtgtgatagtgccaggccattgcaaaggacagagaaagtcatatattacagttcccaattatttgagaatcatcctaaaagaggaggtaagaacagggttatttgagagatagaaaacctaccccaaatctccataataatttttctgcagtagttttccttttactcatctcagatgtccaggctgttggaaagaggggacgaatcctaatttttctggcttattaacgtcaacagtgatgaagtcctggagccaggagagcagccggccgtggctgccttggcccatgcagactcacgcctgaccctcgttactgggccgctgacttccacggtgctgagaggtgggaaaggaggtgcacccacagcccatgggaggtggggagggtgatgtgttcacagaccgccggcagctcttgattcaaatcattcacaaccacaaagccaagtttctaagaccaagggcagtaggaggaatggaggcaatattccaaacaccgactcaaaaccaccaacaaaagaatgtgctatctagtatttactctcacaatgtttgcctttctctgattcctaatgagttcaagcacttttgtatagatctactggccatttggttattctctctgtgatctgccacttccagccttgtgcccattttcctgttgggtgtcattttccatacccacttgggaactctttgtatcctaaatacagtcgcccatttggttacctgtgttgcaaagaccttttttcactctgtcttttctgtcttaatgatgtccaataagctgatgcctacgttttattgtcatccaatttatcaattttttatggttagtgttttcccaagctcattcattaattctaaattttacaatagattctgttgtgttttctgtatgtaaaatcatgtgatctgcaaataatgatggttttacatccttttagtcattatacttttttcttttttcaaccttattatactgtctagaatatattagcaatgttaagtcaagaaaggcttattagccaagtatacattaagtagacttcaccaaaaagctttgaaatgcatattgaaacctacataagggctatttgcagaacccaagctcacatttaaaaccgcgggatctccaaaatagctttctggactacctttgaatggaaagggccatggcaaacaattttccaagtcctcctcatctttagttaggtttcggtcagagattcaaatgcaagagggatgtaaaccagggatgaagtgatagtggcagcaacacaagttcgttctcctgtcgcaatgatagacaggacggctcccacacacagcaccttcttctagagcacttttcctcctcttctctccttttgtcctcttgagtttgaacattgatggtggtacatgatgttcctaaaaagacaagcacaggcagatagagagaaacgttgggcccacggaaatatgaattcatccagatttctactgtgttaacttttaatagaggaatccccttctatgtttgtaccatgtgttgccatccttaaaaactctgtgttgaaaggtgaccaatgagtccttccagtagtacctggtttccttagtaattgacttgtcacatatttctgcatcaacagtattctcaaatgcacgcttactttcagcaatggtgaagctcactgctgagctcaaagtccttcacaatctgaacacacggtgctatttccagaagcccaaattcccatggtagctatgtaagttgtatctctgagtcagcaagaagtgggtgcatgaggcttcccaacccaccaggtccttgcaggcagccaggcttgcttctggagagggcagagggtgaagggctgcagctgtgcatgtggtcagccccatcatcctaaggagatattcctgagtgtccaagaaaagcactgctccaccctactttctgaccttgacttatgacccctccaggggtgtagtgaccacctgaaggccactggcccggttactcagaaatgtacctctttgaatgctgcctgcctcgaggtgtacctctcatcatcacagaaggaccaccgcttactctttgttaatgaaatctgagatgcttccaccttcctattcttggaaaacattaggagtcccacacctcttgcagccctgatgtcctgggacccagtgtccatcccacatccagcctacttcgtccaagccaggtcctctgagctgtttgctgtgacattcagaggcagctttgctatctgtgaggtgtgttctggtacctacaggctccgtgagcactgtctttcctcactgatctcttctttaattctcttcatgggggcgatttcttgtagcactttttcttctccaaacattttctaacttacctaagatgggttatgattgaggtgtcccctggctacgacctactgcacctgagatgggaagaggaccgctcacgaaccgtggtcctgctcccacaccccaataatgtacaacttttcatatcgggacacagccactgcctctgcgagtctgaactcgttgccatatttctgtgtgcttttattctgggccttgggcagtcccatctgttttgttgtatagttatgattataaataataagagctcttaccttgtgtgataagttcttatcacgatctaggtcctgggcaaggtgctttacacgaatgacctcaagtgacctttagattaaccctctgagataggaactaatgtcatcctcatctcacagacaaagaaaccgagtctagaaagtcaggtcatggtggggccggcaccgcccatggagctggacttgggtgctggccccatgctcctgctgagttcggctggatggcagtgaccatgcttgctttgagggcgagggtcacacccaggtgtggcctgtgtccccaggtgcctagacacggcctgaacacagaggcgtttgataaaaaatgtacaatatgacgcacagtcagtgcctctctttggggctgaatagcgcatgcccttaggttggacagtaaaatcggccttcttgacattcagaaaggctgacccagctttggaactctgcttggtttgtttgttcgttcctttgtttatcaagcacagcagatgtggcccgcatctaacctgttgtgagcaccaccaccatctgcatgttggaagtgcctgcacgatgccctaaggattctgttccagaggcttcccttagatgagaccacagagcagccgtctgcctggggagcagacccatggccgcattccagaaagagtgttcatgctcatttctactaaaatccaggtttcgcacttggaagcggcttcccttcccaagtagaaacacattccatttccttcatacctgtcgtggtcatggcacactcattcaagatgtttatgagctgaacatatttgctccttacagtgtggatttatagtctaagaaacttggaaaagcctccatgcaggatattgtgagacaggtcaagaaaattccattccccaagaacaaatgttatgcagccagtatataacaatgctttgtttatgcagagcatttaggaatatggagaaatgcttaatgtgaagacaaagtaaagatgcaaaattgtatagaaagtataatccgagttatgtagaaagaagtgcaagagaaaagaccagggaaaatgctgaacgttctcccggagcaggcctgcttcagccctcggtctgattcagcacagtcagatccacgcagcccgtcttcagtccagggaggaggaagataaagagctgggggcccagctccaggtgacctcaactatctctctgtccctcacctgtgctgctgccctgatccctgggcatcttccctctgcagaggccgagcccccagcctgtgtcacacttctcatccctgggcttctccttggccctctgggctcaggtgcagacattcatggatcctgttcattgatcctgtggttgggagtctgctgacctcctccactgcctgcaaccgtgtctccaacacaggcgactcctgagttctctttgtaatgcttcagccatggctcctgctgtggtttggctctgtccccactcaaatctcatcttgaattgtagctcccataattcccacatgttttgaaagggacccagtgggaggtaactgaatcatgagggcggtttcccccatactattcttgcggtagagtaagtctcatgagatctgatggtttaataaggggaaaccccttttgcttggttatcactctctcttgtctgccaccatgtaagacgtgccttttgccttctgccatgattgtgaggcctccccagccacatggaactgtgagtcctttaaacccctttttctttataaattatccagtctcacttatgtctttatcagcagcatgaaaatggactaatacagctcccttggtgcccaaagtggtgactgagctccagtttcttgtccctgatgtccactctggctgatccaaacccatcacatgacaaggcttggccacccatctccaaggtggtgacattttactctcaaactgaagaagataaaattctgggatccaaaattactagatgcctttcttctatggagtttaaactacttcacatatactatttcactatcctcacaccacgtttttgaaacaagggtgggaaacagatagttgtggcacacactgttcaaagtttccacaagatcctggaagtctgctcccctgtagtgtgctttgcaaaaagaagactctcgtgggcttctgttggcaatgtagactcatccagtctcctgtggatggccacttcattacttctaacccacctttccccccagagctgacatatgtgaaaatgaagactgcaaaaatttgcctctatgtatcttcttggagttttttgatttttaacttttttagtctcggctattttgaactattttctccactgctctaatacattgaagtagagaattgagagtaggccatttcctcttttcctggaaaatattctgatggctctctttgataatttgtctgattgtctcaagcataactgatctttcatgaacacgcagggaatcataatggcgctgcactcggaaagttgagtataatggtgctattcatgaaaatagatgaattcaaaaaaatgggaagcgaatatcaaaatgaagttggacaagtaggtttttataggctccataaaacaaaatgcatcttagaagaggcctgggaggtgggataacaatagcggccgctggaggagggctcctgcgcgctgcccagggctgggctttctttctgatccttacgacgacctggcctagtaggcctcatttcatctgtaaaggactatgttgtggaggaaagagttaaacatactgttgttccctttcctggggaaagggggtccctttttatctgcatcaggggttttgcttggggaatataggaggcaggacatggacctcagggggtggcatctcatctgcaagcagctcatctgggagcttccttcccgaggatgtttgaacatattatatacagagccttgaccccagggccttattcctgaagctttcgttgatcagcttctgggaagcctccagcaaaggcagttcttcctctgctccctctgaagcagttcatgggaagagtcaccacattcagcctggggctggcatcctctggacaacatccattcccacgtggcctgggttgcctctgtgctccttcacgggacactcacaccagttcctatacaggttacatcagaagttcccaaatgttgctctgggtactgcactggttagcaatgcagttttcaaagttccaaggagaaatgaggggaaatgaggaaaacagactgcgtttatctatggatgctgatgctgttttgtacacgtaggacgtataatatatgctcactgcattcaatccgtaagcctgtaggccagtgacagttgcagtcctggcgctctgattccgcggttctggaatggggcatgggcgccggaagttttagaagcacccggcatgatgctgatcacagccaagtttggaaaccactgggctcgtgtgaaggacactgtaccctgctgtttggaatcataaacgtaagatttaaaatgggctttcctaactaataagtgccagtgagggctcaacagctgatgggcagtggagtccagagtgatggtcccagcaagcgttccagcggcatctgccaaggctggaagctgttgccaggctcgagccagagcagcatgggcaggaagctcctgatgggcagtggaagtgagattggaccagcgtcagagggcggatgtactggtggcaggctcagagagggttgccttgggattcacaaagcatggcccatggtgtccagactgggggcttttgaaggcttaggctgatgttcccccttagccacacccttgctatccaaaaggtcctgctccacatctgaccgcaagcagccctctgacacagtgctggaggctctaagaatctgaagtctgcctgtcccagggaagtccctgcagcaggttctgctgtgtgtgtctgtgtccccaagacatttttcaggacagctttgggaaaagcactttttaactgttaaaaatagagagagcattgatacttgtgaagatatatgtactcactaaaatatatgcagtgagcatatattcactaaatgaacatgcattgaaagtaaacagcatgatgccaagggcttgaagttccttttcttgttgctttgtaggttaatgaggccaggggtgtggattaacagtattctggaatcacacaaaactctccaaaggaaccatttatgccaccgtgataggaactgcgtattgctcacttggatcctaagctgatttttaaattagatctttccgtgatcccttgttgagtctgtttcatgtgcattttattatattctataaatatttcactagttgtttctaataattagagaaaaagtgtctttcatcaatttaagagagaagggaatagtctgttaaggctgagcagttactgcatatgaaggctccaatggtgagcttctaccattagctggcaaaaaagagcaaaaatgcaatggaaaacagtgagggagagagagagagaaagagagagagaggagagaggcacagttactgagccatgtggccaactattaaaactaggagaaaagacacagaaaatgttgtgtgtgggggggggtgggggtaaaatgctccccctgaagagcactgaggctctagggagcccgttaaacccagataattctactagagcaggagggagctggcctgggccttcccagttagcactcactgaaaacaacgggcctctgccgagaagctaaacctgggaccccagggatggtttatctggaagattaggggagaaacgtgcaaggcagccaaggcaatccagccatctctgcagctgggaaaaggagtgattgttttcctgagctgctagcctggatttgcagaaggaaagaatgccttgtttctgtcccctgaagacgcaagctgaaaaaatgtctggctgctcttcgccgccctcccaggttctctcccacagccaagaacgactggctgctgccctgagccgggaggtcacaacgcttgtggagtaaggagctcgggtttttgtttggggctttgttttgttttcttaagtatctgcaggacaatgtttggaagagtcgtatgccccataaaaggaagaaaatggtgctcttggattgtaatcagtgacttgtggttggcagttatgcctctgccttcagtactgcaggcctgtgccttccacggaccttccctaacatcatttctggagatgatggggccagctctttaagaaactattttttcacgttatcatgtggtaagaacagagatgaacctcagagatgaagagtgtgattgagctcagagaaacttcagtgacttgattttaaatgggccaaacagttggatttcttttaccttttgtgcagaaagccttcgtttagagaaaagaggactgaattctgatggacagtaggtgtgggaggggcagcatgttatcacaatagcatcgtgatgagattcctggatggagggaatcactggtgcttgcatatttggggcttcatcttagggaagttccctaaaatctctgtagcacccagttttcgtgggaagaatgtcgtgggagcaggggcttccctgaccttggaagcctggccggtcagtctcaaacgagtttactgcctccgacccaattgtgaggactgagccagagggagtgcatgtcagcctcagcctccagcagcacagcccctttctctacaagcctcagatataggggaaaaaaaacaaaaacagagtcaaaagtaggtcttcattaataaaagactgggatctcccagaattaatcatcttgctcatcttttccagttctggaaatctgatctttgaacctggtatcctcagtcttagcacaatacctgggaccataatagatgctcagtaaacttggtgggaggaaaaaatcaaagaaggagtcaaaatagaggtgctcggtgccgaggagttgctaacctggaccatccaaataatgacagtctgtggcacttcagaagcattccagaaatggaacaatggcactccatgaagctgtataaactcataatgtatcctgtaactaacccagtatagaacagtaacactgtttacactgattggaaggaagaaggttcatcctggcggtttatgacattgccagaatggcttgaatccttgagggtgggtgacaggtagagtggataataaatgggcctcctggttcacagagcctgagaacctctcacccaatgggcacctggtgcccctgcagagtccagtctaagaggacaattttttttttcagatgtagtcttgttctgttgcccaggttggagtgcctgatctcagctcactgcagcctccgcctcctgggttcaagcagttccctgcctcagcctccctggtagctgagattataggtgcacgccaccacacccggctaatttttgtatttttagtagagatgcggtttcaccatcttggccaggctggtgttgacgtcctgacctcgtgagccaccgcgcccagccaaggacaatttactctagccacagatatggccatggtcctcatgtaagctgactacaaatacagcaaatccacctttccaaagacttcattctaaagatgtaaaagaacaaaaagagataaaggaagaggatgagaagacttgagaagagtggaagtgtagaaagaaaatgtttaaggttcatcccctccccaccttggggagttcctttggcagcatcttctgaagggtacttctcctagcccaggggcagaaagatccagtcttttggggcagctgcggaagaaaggagagcagtcctgtagctcatgaagacattacgaagcacaaagaactgcacagggacagagagtctttagggtctcgagctcactctatgtccttggctgttaagttccccgagagcaaaccccagcttctcgcttgcttcaggctctgcatgtgtgagtgtgacccttgggtactctcggggcgttttcagccatgcgattctggggacttcagaggactctgttcctttctgactcgtgttccggcgtctgtggattgctcccaacaggaggaggagtattgtctattaagggaaaagatttcagtgacctggcagcagggagcgtcgtcagtgtttgactgtttatggtatgtcagggagctggttcctggcagtggcttccccaggggtggggaggggtgtgctgggggtgacaggaagcactgaatcacgacagagaagggaaagaagcccgcccgccacttccggtgttcactgagcaggtcggtggccagcgctgccttcgcatcagaaccccattttaaaacacatccaagcgcgtggcgtcatcgggacgacgggcttctccccagtagagtgtcagaccaacaccgccctgcacaaagctctgtgttccctgctttctgtcatgttcccacccatagccagaaatcccagctgctggccgtccagcccctatggagcagtgactaagggtggctgtgggactcactcacgagccttaggttgggtgtacatagtttgtggctgattaggtgttgttaaggatttactgttcagggctgttgatttctgccactggcttgtcttctcccaaggacaaggggcctgcctattggcttttagatcttagcacttagcagactctcagaagtgtttgctagaggacgttttctggggaatgtccacctgcactgatgaaaacaactcagtaacaactccactttgagaggagcagagcaggagccttccttaggtgtgcgtaaggggataccggctttaaagacgccaggctgagttgctgtgtcaggattgattctttacttctccatctggaggtgtttctgctttatcagtttctccttgtttccagctctgtctcgctgccagagggccgacgtttcctggcttttgttgtactgtggcacacagtctgttttgaaaggacaggagcataataaaagcggatatgaaagaagggccagatgacatcacatagaatactggaggaagtccgcgtttgtggatgtttataatctcagcatgttagttgtttgtaatatgataagagcacttttgatacataggaggactacaagccttgttgcttagacaggactcacgaatttttatcttaggctcatagtgacgaacagagaatggggatcttggcctggatcccaagtgaccctggctcattggttgacctcgggtacaagattcggcatagatgagccatttaaattgtgcctaagccagctactcattgaattttttaaaagaaagagagagatagaataaagaaagctaagaatttgacttattagagatgaattagcttactaaattttttccttttgaaatcttacttcagagaaattgatggtacctagaacttaacattaaatcaagtaagacccttttaaggtgaattctggaagccatatagagtcagcattatatgcatgcttactcagtgaaaatcctaaagcatgcaagtgtctccataaagagcaatctccttgaacaataacagtgttgacacctgctgttccccaggtctgtatcgtgagatggaaatacaccagcatcttcccccactaggggaagatgataaaatgcaggttaagaacatggaccatggatgctgggtacttcctgccgggagccgggcactatcctcacctcttcccgtgggttaatctcctttcatcctaacggcaaccccaggaggcaggaacagtaggttctacccattttttaaatgaggaccctgcagggcatgtgggatgagcattcctcacaagaccgcccccacgaaacatggcctggagcccgggcacccttggtccaaagcaaatcaagtttctcccaaacacagtgccattcagagcaaaccaaatctgcagcactggagacccgcacacccgactggaagcttagggcagggcaaaggcacaagacagcatcatagcactctggagcccaggaagaacccatcttcttgcaaacactccagattaagcgtaaaaagactagaaaaatcaactgtcttcatgcactggtataggagagcagggtagagctggctcctaaaatttcacactcaggagactctaaaaatcgtgctcaaacctaaaaatgtgtgcatgctaattccaaattagccttatcgacagaggttagcgtccaaaacttggtctaacctagtccagggaacatgcaatctttgcaacttcatactgcagtgactgtgtgtgtggtctctgattgtccatcgaacacaagaattaaaatcccaacaacctagtgaggggcagagaggagtgggattgaaaatccactgttgaaatatccaggtagataatccactcccaaataacggagtgctgcctgcgcctgtccgtacccagtgggtgctctcctctgctggccccaggagtaggcgtctgctgtgacttagagcagattttatgcacagaccttcttccaggcagagaaaaaactaccgagtgtgagttcacagcaaaggcatcctcgatccctgctgatgtgggaaggcataggtacacgccgtctgaaagctgccaggcgtgattcacttggcagcgtacctccaggagaaagggcggggcagaaattcagaaattctaacccagaagccaggccagcaggtaggtaaagtggctgtcgcatgggtgtggtgttgtccatggccccaaagcccctgggactttgatggtcaagtttgcaaagataaagctgcaggcacctgaggctgagcctgcccgggcagcgcagcgctgctgtgtgccaatgcaaacggggaccttccttgcctagaccagtcttcaccaaccagaacagaaatcttattgtattctgaaaaaggattcctggatctctttcattccatgcttttcagatttttttctcccaaatttagcacagagggcaggttttgaacagaactcttaaactgaaggtacttctctggaataaatagcttcaagagatggacccactttgtttattaccaacagggctaaatatttaccttagacctatatgccaatactaaccacatacacattttcattcattgccaaagaataccaagaactggcatgccgtataaataattaaaatttagtgtagataatgtgtgaggtaatgcttatattagatgatgtctcggtgaactctctccctaacgaaacagaagaaaaacaacatagctcataaatatgtaagggtatttattctaaatgtaacatgtgaaactcttcactgcatgtgtacctatgagtctgaaaactcacttctaactatgattacattgatggcctcttgaacaagagttaaaagctccttgtaacttgttcttctcaacacggagacagaacaaaatccctcaggctattaaaaggatgacatgacaaatagccttcataaaagatggtcttttatgcagccaattttcttattagttatttgacgacaacattgaggtttaaatgagtagccaatgagagaatattgaagtaggctgtttgttacagcacatctcctctaactcatacttgctgataggtaattggaacagaagagaatgatgtcagtatgagatggaagtcatgttagttcatgcgtgacatttttcccagcatggtgtttgtaccactgagtaacaggatagctgagggtaagtagaagaatacacatcagcacagcaaactgtcaaggaatggaactctatacgagaccccagggccgcagtattctctctcttgcctcgctcaggccacatactctccttagaaatgctttctccacagctcttcccaatctttggtcatcctgtccttgctctctgcagtgtagcagtctcagcacttccttacacccccttctatgaaactatgccatcacttttcttcaagataaactgttttatttactgcaatatttctttacttgagaagttaacatgtccattaaactgtgctattatttgtattaggattgctaccaattttattaaggccctagttacaaagttgcatcggtattgagtggtctgccccagctctgtttttcccatggacctcggtggtttgctgtgtggttttgcagagtgtgagaatttttcagaaacagtcatatactgtgttacagcagaaaagcctgttcttaaaaagaatgagtggggactagatgtgaatcaatgtgatttgactttcttcttcccaaggtgagtggctggtgtgtttgagttggtcttgactacactgacaaggaaggtgagggtatggaggacattccaagctgaaggaacagtgtgtacaaacgcaagttctttgcgaggatggaacttcagaggtgttcatactcaatgcattgaaaatcctcacattccctcagcatgtaaaataagtgattaagcattccgctgtagttgaaagaaaaagagactttgaaagtggagggaacagtggatgcaggggagcagaaccccagtcggcgggtctcaggagaagcgaagcctgctgttcctgggaagcagtggggtgcaggaatcagaggacagcagatgctggcttcacaccctcaccttccctatgggtacagtcgaggcctcctcaaacacaccagccactcacctgggaaagaagaaagtcagactcacattgatgcacatctcgtcctcacccgttctttttaacctgatatgggctctcaactaaagggttaataccagaagcacccacctagctaagtaccgacctagacagccattagtgatttacaaaaacatgaagggtggccatctatattaggggtggagaaggacagggggcaagggaaggtggtttctggcaattggtccactgacacacccccagctgctgtgtgggacagaagtcacgtgagtcagatagcaacacccaggctctcatcttgttccatctcatctgtgcctgggcatgtgtacctgtgcacagggggaccaccttctgcaaggtagctggggtgcgtgttagttctcagaatagtgccagctgtgtgtccacttcatgatgacatcaagaagatgggctttgggatcctgcccacacccagctccggggcgctgctgatgtatctgggcaaccccagccaggatcctgggctgcctctatcaccctcacaacctgggggccaggagccagcaatgaaggccagtgagaggtgaatttggaaatgaggagctttcctggggtactgaaggaacagtatcaaaatacttgaaaagaaagagaactctttcttgtttgaggcttttggggcgttgtttcctgcgtaactcaaagccttgggaatcccagacagaaagtcatttaagattaacttttgaaatcaagtgagtaagacctgattcaaaggagaatttagccatgggttaataaatatatctaaattgcaatgaaaatcttcagcggtcttagccgttgatcccgtggtcaccatagacaatataaggagcagtgtctatggcaggagtgatggaacagatttcaggaagtaactttgagtgagagaagcaggggccccagaactctagtgaccaagacattcgaagacaggcaaggaaaccttcaaatgcaggcaactcatatttcgacggggcaccctccagtgctccgagatggaaattgcctgcatttcagtgccctgttctgtggctccagtgctctgctgtatgcccactgtgaaggctgcttgtcacctgtgctgcccagctcaacccggcccctttggtcgctgtcctgcctgcctgacggctgacgacggccccacacccatgtctacaccctgggtgtttgctgtgtaggttccaggcttctagaccagatgactcaagatgaggcacatgtgagtctccacccagcacctaataaaaccacccaacaaatgagggctcagctcctcccggggtgaaggccagggtgctctgttgactaaggggaggccatgaaagaacggggaagactggctctggacagagcctcatcccctgcgcttatcgtggctcactgccaagtgcgaacacctgggtccacgcctccgcatgccgggcccgtgtgcacacctgccttcctcgctggtgagagggcgcatctcagcctgcttttcgcctctagaaaggcactgagtgtgaactgtgaagaagtggccagggcagaggatgtgtgtcaggaaatgccaagccccctttcctcactcagccagatggcctacctgtcctcacctgaaaccaggcccacccatgctctgagatcatctctagcccaggacaaggcatttccaaggcagcgttggcttagactatgttggctgggcttcacctctcattcatgtgtcaggagctctaggccggggagccaggcattggagaccctttagctgggaaggctcggggggctgagttacatcaccaaaccctcacagcagccctgtgcaagggtgccatcatcctccctttgtgcagaagatgctgtggcttcaaaggaccagtcacttctctgcctgaactcttgccctttgctacatcattcatgttcccagttggcccctcacacctgctcttcagcatcctgggttctcagcagttcctacctggggccctgcctgccatccctccactgtcattcagcctgctttaaatgtctcaggatgactaatgtcactgggatgtgttctggccctggcctttggcccaccacacactgcatgccctggcagtcaaattcctgaattttttctggagccagtcctgcccgtcaggacccaagctccagcactaaagtacggctgtcagaggtggccctgccaatagcacactgtgtgtggaaaacacccagacattgagctgcctgaggagaaatggaaggtggcccacttggccggtcattgctcgttaaaatgtaaaggtgtgcagatatgaaaacacggggcttgttgccgatgactcaggggagggcaccgaacgtcatgcctcctggttatgtcttgccgccgtgttgaaccaggatggggaatgatcccattcctcaggtattcgtctgggagaccgtaaaggattgcttccagacaggaaggacgtctgtcttcctaaagagtgtctagcccaactcgttgaactactgtcatttctttctggttctcctgttccaaatacacagcctgagctcctccctccttctctgagtctctcagttccatgaggacaggcatcgacgcagtcataactgctggcactcactggcattccagaaaagcccatggggcttattcattgtacgtgggggagcgcccctgtccttcaggcatttcaccatcttgagctggtgactagttcaagaccattctgtagagtgaacacatttatttaggatgcccttgaagtactgttaaacaaaggaagctgaattggctggctttgctgcccggcatatagaagaaggatttgtgctgggtggtacaactgtgacctgcacttcctcttccatataccttgccctgctaataccatgttggaattatttccttaatttctaaagctgcatgtgcggaaatggcttatatttcctgttttgataaactaatagaactttactgagaaccttgttcccgagttggctttcttctcttttggcctcttttttgattaaaatagtaattctaaaagtccagcttgactggacttgtgtcaaagacaaagaattgtatagattttttttttttgccttgaaaagataactttttagctttcaaaaggatgataactttttaacaataggtaatgttgatcttgtttgtcacttggcgtaggtttttcagtattcctctgtggagggaatttgggttagatgctaggcacaatccaatcgtcagctatctgtaaattcccttcagaggatggctcttgttggctggaggtaaattggcttaaaaagacttccttggacaagaagtttcttggaacatgtagaggacaaaatattctttgttttgggacagatgagttttgttcttgcgattcatataactcgattactgctcattttctatgtgcaagttgagaacaatgaccagcattttttttcattcgtctacatggcatccactttaaatgatactcatgtctgaagagggctgggtgcatttccatggtttgttcccttgctatatgttgacaatttgcagtggtagtagagaaatagtagtctcaaagagtttaaattgtttatgtgttttgtttcctggcattcaggttgtcatttaaacctatttttttagtgtcctaaatataaggaccaatctgccatggagagaagtgacattgggcagttttctccacgttttgagatgggcgattcctcagacatctaccaaggaggacacccttttccccggtggcaaaggagggactctccctctgcctggtggcacaggatcctagtgaaggcaacacgatactctcttctcactgtcattgggtcactcacagaagagccagggcagcaaccaggaggaccggatgtcctcttaatcctgcagctgccactcttgatctctgctccaactccactgtatcccattgataaatgacagagtctctgctggcagccaggcagctagtgactccaagcaagaaattctgcatttgatcctgataggagcctggttcaagaaactagaacctggttttccttaaagggttccatgacttttattcttccagaggtaaaagactcaccaaggaatctagattgtgcatctggagtgatttgatgtctatggtaaatctatccatgcaaacagatggattttcatatcttcttttttttttttattgagacacagtctcactccgtcacccaggctggagtgcagtagcacagtcgtggctcactaaaacctccacttctcgggttgaagtgattcttgtgtctcaacctcgtgagtagttggtattacaagcgtgagccaccatgtccagctaatttttacattcttagtagagacagggtttcaccatgttggccaggctggtcttgaactcctaacttcaagtgatccaccgcctaggcctcccaaagtgctaggcttacaggcgtgagccaccacacccagcccaatttccacatctttctaaatgtaatgatgccaagatttaaataagactccaaggaaaagaatttccatatatgaagtcaaccaagaaatccctcactcaaagattcccgttctgcacctggaaaaaatgtctgttgcattccaattgagtagaatgtaatctaaggtttctggaaaacacatcttatgcctttacatacactgccaactggctcctaaacatttccaattcctacagttttgaattggcacagcaatgctggctaccagtttcagaacaggaaaaagaagagctctagaaggatattttgaattttaaaaaaattaaaagagagaactacaattttttttagcacttggagggattagaggctcagccactgagtccttagggctcagagccgccccagatgcagcacaggtcacagaggtcaaagcaaggtccaagggccatcacttttctaggacagacatgccaggcacccactgagtcatggaacatgctgaacctgtaataactcctaccttctgttgcacccagggtgatggttcagtggtttccagctttctcactatctctaaacaaagcctgttttcacaatgcccatccgaccacctagtgtagggctttgcaaacctcggtgtgctaacctggaagtcatgctagaaagcaggttctgctccaagaaaggtggggtggggcctgcattcctcactagctccagggtgatgctgatgggccctgtccacacagcacacttgccatggcgggggccagctgggagagcagctgcccttcagacaagcactcatgacctctttgactttgtgtctaagtccctgcctctgatcagttttcctctctgtttccctcttattccctcccattttatttgtggtacaacttccaggtaaatcttcctcaaactctctgtccagtgtcttctttgctacctgctctctctcttgtttctttctttctttatttttattttttctttttgagatagggtcttgctctgttgcccaggctggagtacagtggcgtaatctcggctcactgcaacctccacctcccgggctcaagccatcttcccaccccagccctccaagcagctgggaccacaggcgtgcaccaccacacccagctattctttttgtttgtttgtttgtttgtttgttcgtttgttttgtacagacagggttttgctttgttacccaggctggtcttgaacccctgagctcaagcgatctgcctgcctgggtctcccaaagtgctgggattacaggcatgagcccccgcacccagccttctctcctgcttctttgctgcctgtggctttctctaccctgctcctcccttgccggcgtgggttttgtccctaagaactggtgcaagaatgaccggtccttcatctcttccttgcagctcagagactttcaagtctaccttgcttcttaggtttatgctgctttggacacttatttcctaaaatgtataattcacatttatttttcagaactattccttttggttccacaacactaaagatgtcaagagcttacaataatcagacttagcaccccttccctttgtccacagtgcctctgccagcttctttaattcctctgcctttcttgaaggagcagataagtccaatggggtctggcctccaggttggtgtgtgatgagatagttggcaaggtaggactgcctgcaggtcctcagtaaatgttcattcatttgctgagggaagtaatgattcatccccctaggcaaactccttccatgatttggaatttaggtctgaagtttcctggccaatgcgcctgggaagccactgagctggctgtcagctgagtagggactaaggatgttcaactgtgggtactgaaaagcggcactagattgaaatggagtcctgagctgcaagttggggagcacagcagtgttggagcatcctgaaagtcataggaagaatgggcttcgagtcactccaactcaggatgttcctgattccctgataatgatcatgatgatgatgatgatgacgatgatgatggcatgaaggtggtgccctcctaggcctggaggttaggggtagccagtctgtctctgctttctagcagtgagagcctcaggctgtcaggcagggaggttggccttgggaggtaggcatagaaggaatagtggagcatagcagagccctagggcgcaggcctgaacacagccagtcctctctgtgaacaggataatgcaatacttaaggacccactgttcctaatttgctctctaaccatcctcttcttcgcagctcttaccagaatttaaattatgtgggtttagttgtttgtttacttatttcaccttcttgtctacttggtcacctgccacagggcaggagcaatgtctaatctgccccctactctatacccagagcccagcacagtgcatggctcagaggaaattcacatcagtgatcatgagtgaatgaatttgtaaagtgaaagcgtggatgaaggacctcccagccccttgccctttgtcatgttagtttggaattggggatgtgaggtgtcctctcactggtgcagttgaaggaaggtgccggatacggttcagattcctcggtggtcccgagttccctgggtggggaggttctgtgtgcctatgaggaggtgagagtcaggcattctccagggagtagggtgcccccaccagctttcacaggccttctgtaaaactggtcccgccaggccttgagtcctttcctgccttggggtgaaggacacccagacaaccacaggagtttggccagccgggctgaacggctacagcacgccccacgagcctggatcacgttccacacctgcagtaggagctgcaggaacctcctggccctgcgagcttcagtggggtcagcagccaggcacacctgcagggggcgtcagtgagagctgggcattggaattgccctacacagttgctgccttggaaattcagacttgaaatgagaaattaatggaggattgaattgatgtttctttcatgagcctgtgattgttgtaaaaagaggtgtgtcaaatgcttggtgagacccatgcaggattctttaaagaacactgaggcaaaccagaccttatagggaaaaacaggcctcacggagactgaagttaaaatatggaccagggccagtgtttcttcatgaagggggtgagcagagatttgaggaggctgcagggtgggaggaaactcatcatttttattaaggagttgacaagaataggatcgcggcttgtctttgatttgcgttaagcagtaaaatgaagggataggctggagggctgagagcagggtggcagcaggtgcgtgcagtcggtatgcctctgctggagggagtggccaggccacagacatgggacaccacatagcagtcctcacactcctcctctgaggtcctcagggaggcatttgtgtctcgagactgtttcagagacccatgtcttctcaggagatgccaaggctcaggtcagagacttgttgagtttttaagagactgtctgaagcacacaccctgccctaataagtcaatatttctgttcctcctggagacctcacattccaaagtgtggtacttcgggctcttgtaaatgttggaattcctaagactctctctggaggacaggtaagatgtcagtgggaacacacatacacacatgcacgtgcgtgtgtgcacgcacggctggcatgtccatggaaactgccttggcgtggaatgagcagggctgcctctcaatgaggtattccttccctcacaatatagcactggagccatcggtacatgtagaaaagtgttactgggaggtatcttaatcagcctacaagtcctagttccaaaagtaagaatgcatcattcatttttgagtgggttatgaataactcactacaactaaatacagtgaatatcgtaaacctagaataaggagtctgttagatcaatttgaaaccattcaaatcatttcaacctttgatttatatggagggatttggcaagtggctttaaaatcaaaattaaaaatagcttgggaaacagcagatggaggatatgagttgatgctttaccctatagacccaggaggcccgcctgcccttcccagacaactggccaatgaattattgggtcaactgaggacctctgccaagcgcctgttcatgcctccctcacgtgtagtaaaaggcatgaatgcgccagcccatctagtcttgagctttggtgctaaactttctggcttagtatggagttggatttctagaaatcacatattcaaatcatgggatttatgagccccattgcagataaacattggagccattgaaaaattggcaaatacctaggatcgtgttttcagggcgtgagaggattttatatatgtttacttttacaccataaactccagctgcctcattacctcactcaagacaaaaagatcactggaaagaaatgtaaaagctttcaaggtactgttttctctgaagggtttgggactttccactttttggagttttttttttttatagtagtaactgatgcatcagatactatattaggtaaagaattataagaagaacataaaaaacgtgaaactctcagatgagagttctctagtagaaaattgttagctgaaagaaaaaaaaaatcacccatacaaaaggaacatggagtcattgctggaacccaaggccaactcttgccaggaggttttgggtcagaagcctgcgtgtcctgcccttctgccctggactatctggaagaccctgctgggcggcagtggcagagtgggcctggccatgccacttgcacctccacgtggacatgcagctggtgacaggaaaggggaaggttccagcagacccgctatcacaaaacaacttacagagggagtccccaagtgatagtcctgtttagtcattgacacgtaactcagaagagagtgaaaaggctgtggtaaaatacaatttgcttaacattggaaagggttctgtcatctggtaagttttacttgcatgataaggtttcaatcagtgaacaccagaagccagccttgtccagggtcccttaggtgtaactgtgtgataatagggaggctccaggcaggctggcagaggctggctgagggtgaaaagctagattaagattcacctgtgagccactgctcacctgtttgtgtggggagggctgcagtagctcaactgtgtgtgggagagggctgcactagctcacctgtgtgtgtgggggagggctgcactagctcacctgtgtggggggagggctgcactagctcacctgtgtgtgtgggggagggctgtactagctcacctgtgtgtgtgggggagggctgcactagctcacctgtgtgtgtgggggagggctgcactagctcacctgtgtgtgtgggggagggctgcactagctcacctgtgtgtgtgggggagggctgtactagctcacctgtgtggggggagggcagtaccagctcacctgtgtgtgtgggggagggctgcactagctcacctgtgtgtgtgggggagggctgcagtagctcacctgtgtgtgggggtggagggctgtacagctcacctgtgtgagtggggagggctgcactagctcacctgtgtgtgtgggggagggctgcactagctcacctgtgtgtgggggtggagggctgtacagctcacctgtgtgagtggggagggctgcactagctcacctgtgtgtgggggggagggctgtactagctcacctgtgtgggggctgagggctgcactaggtcacctgtatagggcggagggcagcactggctcacctgtggaatgaaggttgtactagcttacctgtcaggggagaggaggcctgcgctgagactcggctgatcagaaaggggagaaaagagggtcactctgattgccatcatctcaaaacgtttaatactgtcacgatttgaaaggaagagctaaggtacttgtccagtagcccaatctccaagtccatctttgatctgaatgttgagatcaaggatgagaaacacctttttgccccatcgggattgcccatccagggaactccctccatttcccactgactcacttaaggttgtatctccttctctgatgaaacactcaatggggtcacccacttgcctgaataggtcctgaggaaagcctcttcccggcattcctcctccttactgagcataagtgtgtcccgtagggcgaaggggaaagaaagtggacttcctctgccgacacccctcaaatgaagtcgcaagtgatatcggtggtgcagatgagggtttggcatcccgccagatgcacctgccagtccctcctcctcacatggccctccctttgatcaccatgatgggtgtcccatgagggagccaccgtttgcaccgacacctcctcctcccctccgtggtggcccactcctgcccacctctctgggttccccgccagcattttctccaggcacatgctccacatgtccaggcagaaggcagggctgctgcccatgccccggagtttctcatgcatgccacaggcctgctccttcctgattcctcacttcacatggaatccagattctcggaatgttctcctgacgctgaaggtccaggactttgcttggcatcgggcagtttataggcacttttttttttttttttgagacagtcttactctgtggcccaggctggagtgcagtggtgtgatctcagctcactgcaacctccacctcccggttcaagcgattttcctgcctcagcctcctaagtagctgggaataccggtgcctgccaccacgcctggctaatttttgtatttttagtagagacggggtttcaccatgttggccaggatggtcttgatctcctgaccttgtgatccacccgcctcggcctcccaaagtgctgggattccaggcgtgagcgaccgcgcccagcctagtgagaactatttaaagactccttgaccatagaacatacagcaccaagggtgaaccctggtctcaactgtggactctggtgatggtgatgcgggcagactcagcgattgtaaccagcatacaggttggttccaacctgtacatcctggtgcaggatgtcgatggtgggggatttcaggggtgggagagacaggggtatattggaaatctctggaccttacactcgattttgctgtgcaccaaaaactgctctaaaaattagtctatttttttaaaaaagccttattgaatgttttgaatgaatcgtttctagagttggaaggattctcaacagatgatattttaatacatgttgtagttggcaatgtttaggtaacttttctttgccttgtgttttattgttgcagggtgtgaagaagtttgatgtgccgtgtggaggaagagattgcagtgggggctgccagtgctaccctgagaaaggtggacgtgtaagtcacagcattgcaataaataatattatcttcctcatacagtcatgcctcgcttaacaacggggtaccttctgggacacgtgtggctgggcagtttcatcattgcttgaacatactggagagtactcacacaaacctagatggccgggcctactacacacccggctgtgtgataaagcctgttgctactaggctacaaacctgtacgtaggcagttgcgacacagtactatttgtatatctaaatacagaaaaggtacagtaaaaagaaagtaaaaagatgtaaaatgggactcctgtgtagggcatttaccatgaacggagcttgcgggacttggaagttgctctgtctgcgttggggagtgcggggtgcgtggatgtgaaggcctggggcgtgaccgcgcaccactgtagatccatcaacactgggtcttaggcggccctaaacttacgttttcaatatttttctttcttcagtaataaattaaccttagtttactataacttttttactttataaactgttaaactttttaaactttttgactgtttttgcaataacacttagcttaaaacacacattgtacagctgtacaaacatattttctttttctacgtttttattcgatgtttttttctattaaaaaaatttttttttactttttaaacttttttgttaaaaacaaagaaacaaacagacatgggagcctgggcctacacgggctcaggataatcaatatcactgtctttcacctccacatcttgtcccaccagaaggtcttcggggcaataacacgcatggagccgtcatcccctctgggaacaatgcctgcttctggattcttcctgaagcacctgcctgaggctattttacagttaacatatgtacacatataaataggagtacactccaaaataacaataaaaagtagagtatagtaaatgcagaaaacagtgacgcagttgcttgtcaccaagtgtcatacactgcatgtaactgcatgtccacactttgatgcaaccagcaacacagcaggtttgtccccaccagcaccaccacaaacatgtgggttatgcgctgggcagatccggtgtcatcttagggcaccactatcttcagtgcagtctgttgttgaccaaaaagtcatgatgcggtgcctgattgtacttccatttgaaatgagagtgtcttaaattttctgagtaagtcattgcatactttgctaagaaatttaatcaattgtattctgttccactagaacaaacaataatataatgcaaaattgggtcaatgtataccactttcctacaaaattgagagcaattttaattttcataagcatcttttctttcattcattgttcattataagtacgtacgtgtgtttgcatgtgtgtatatatgtgcatatataaagcaatgatgttttatagttataataagcagaaatgtcataaaaatattctgtaaagaaaaaagtagttgcatttatactgcaatatagttatacaaactagggagcactggcagttgtatcattgctaacaattctcactttgaaaatatttactccctgaatgtctttgatgtggtccgtctgatagataagtaagaggaaaaaagggtaccccaaatcatcaccattacatctggcagaatttgaaatattgccctgatattggatttaatatgttcaatcaaagtgattgatctctgattctgttgcctttaaaactgatatctttaaaactgagtcttggtgttacttggtttaaaagtattatttatatgtgcacctttaagtccatcttgcatgtgtgaaggtgtggggagtagtattttgttttatgacacagcctccttgcctttattccctggactcatgtatctaccctaggacacatgcttgtctacaccttcgtttggcaaatgccaggttgtcaaggcaactggaaactcttccctgaattgccctgatgttgttggaatcagaaattataacagcccttgggtgtccaaatgagtttccccaagttgaatcctgaagtcagtttctaccgtagccatttcccatccctacctgccaggaagaacgaccctctgctggagcttggcctccagggctgaggtgcgatgccgctgcctcctctcctgtgtcccctccacaaaatcaaatgggcacagttcgtgatagggaacctctttataaatactgtcttcctatttcctgacctgtgactgatcattatttcactgtcaaaaatcacaactgaggaggcttcctgcccctttgatcaaagctcccatctctccacctgctgcattcatcattagttgcacttctcaaaacagttatttttgtttcggttaagcattcctctgcctgctgtggggactttatggtttagaaattgctggttgaagatcatttatcagcacttaacaaggctaaataatttttaagtttatggaagccatttcacaagatgtaaaattcccctgggtctcatgctatggattttcccaacgacacttctgtggcagtgatgagaatgcctgactgcagactctccaccccgcagcccttgactggctcagccttatatgggcatggatagaattggtggtatacacatatctgtgagactagctgtgtgggacggagttcgtgtctagagcgactctgcattcttctccatgtcatcagataaacagaacccaaacaaactgagtagaggtgaccggatctgttcttttcactttctatgattatttaatgcagaatcaacatagtaacattttccataatgcctttaggagaatttgattcttcagtaaacatagctagttcagattatttcagtatataatggcatctgcatagcagtgtactgttacacgatgccagaggtcttttcagtgaggttattaggaggggatttctaaggatccccaagactctgtgatttcacgaattcacagcacaggcattgagacctttttatttcccagcgtccctagtgaaggaaacaccttgagtctctttctatactttgccaagtaaaatgaaaaatcgacaccttctggttaatctgattaacttgagtaatccaaaactccgtgtgggcttggctgtcctctagttatccagacgggttatcaacactgatccaattaagctgtgattggcagctgtctgaagggttgtacaaaagacagaggcaaacgatacccgccccccaccccggggcctggactgtgggatccactgtgcacgcgcagcactcatgtggcctgaaatctggctgtacctgtacctctgggtgctgcgtgatgcttgacactgtcatttcacctgggccgaggcccgtgctgccaagggaccacacagccagtcactggagtgtgttaacaatcagcacacagggctgctctgttaattcaggtgagaccctgaacattcactgataaagtgatagaaatagctgatgataaaaggtaagaaagagatcagtgatgccatttaccattttcttattcctggagatattcttctgtgtgttacaggagacaattactctcaggactgctgcatctactgtattaaaacatttttaagatagagcatctgtttcaatactacaaatccggtgcatgtggcttaactatttattaattaacagattttcccaaatgtgctcttgcagaagcattgctctgtctgccctacttttggactgatagtatttttttaaagtaagataatacataaaaatagcagctggacagagcttgctgtcgaaagggctgtgtgcatagtttgttctttcccacagcttcccctggggtggctcccgtctctcttccctgtggtgctactgtaacagccctggaaatgcctggctgcagactcgccacaccccagcacttggctagctcagccttttatgggcatggtaccccagttcatctgtgcgtcaccatggtgacagccaacatcggaagttgtacgtcactggataacttttggacacgaagcagaaatcacaagcatactatggattccagttccaaatggattctcatgtgaccagtgaatgagctttgggtcaatttgcagagctttgttcatccttgggcggtgagtggtagactctcccagcagggagagaattgcttcacccagacagaaccacccagtcccatagataattccagcaagccacagagttgaggcctgaagaggcaaggcaggagctgtgtaccggctgcttggcactgcccacttcccctccctgggcagagctgggaggagctgagccaggagccagcccatgtcctgtagttcacgtacgagcacactgacttcaggagggaaatggcctctgcaaatctcacacccagattgtggcagagtccaaaacaaaactcaagtctggggacttagacaaattctttttccagcataatcatcttctgtgtccgtactcctcttcccatatgtcagcctagaagagtgaggctctccgggatgcagggaagaacataggcagcgtgagaagagagtttcccctcgttatgcaagagttatggttccctagttaactctctaaccacttcttcagttgttttgtggattaaaaaataactttaacaaatgattcagggctctgttgttatttgagggtctgtatttcaaataatctctagtaagcatattggaataattataaatgataagttcgattcattgatactgcatgttctcagatttacccctccactgaataccaggcaatcatcagcaccaaacaaggtgcccgcccctagcacctttcactgcagccctcccaggctcaagcagttctcctgccttaggccctcaagtagctggaactataggcatgcaccaccacacctggctgatttttgtatttttttttttttgtggagatgggattttgccatattgcccagtctggtcttgaactcctaagctcaggcagtctgcccacctcagcctcccaaacttctgggattacaggtgtgagccaccacacccagccttctttttctattctcttttcagttttctttctttatacaccatggagatggaaggcagttgaatgggaagcatcaaagtgagtttcagttacagaatttctgtcagagttatcagcaccacgcaatgtaaaggttaataatatagaaagcagtagaggggcagataggaaatcggagtcaacaaataagacagctttgctttgcttgttaactcacctagcagatggtgaaagtcttggatttttccaagtaaggtcaattttagttcattatttcagtaacttagccaggttcctgttctcccccaaacatctgatttttgaccataaactctgatcagataggttgtttcaaattttttaatgacatcaaccttcacagggcacctcctatgtcctaaggcacttgggtattccagaaactggtaaatatgaagactggttggataactccgtgttgggaattagtgagatggtcaaatggccctgtcacacgacaacagggaaaagagaacccacgtcatcagcccctgaacgagtgagtggaggcctctgcatcactcagcatgcatccaggcggtacccacagtgccccctgtggcctggcagctgcagctgagagcctggagactatgcttctggaaggttgcgattgacaagctcgctcaagtaagcagtggctgagtgcttagggcaacaagttgtgtttagcgactgcattttttcatgtagctaagagtttcccacagtctatgggtccctggacttgggtcaaatagtccttagcctcaccagatttcttaaattcaacactataaatcaaagtaaaagaaaccagagagaaactgagcaaaaatagctgccaagagaagagggaacgagtgctcggggcgggttggaggcagataacgagaaggcaagaaaattctttgtctttggctcctgctgtcagctcagaggggtcatcttgagatgaaaaagaaaagtccccagccttggggaaggaaaggagagggtgccccacgcagatatgaagcaaagccattggcaagatattctctctaaggagagcagcggtcttgccaaaggcatcttctattgtgtattgccgtcataaaccctacccttccatgtagatagccaggattttaaaataaaactaaatcttccccaaggagagaattgcgatgccctggcagcatgggcacttttgtgtgggtgtttccgtggctagaggggttctgaaatttttgtatttgtagtagagatggggtttcaccatgttggccaggctggtctcgaacttctgacctcaggtgagccgcccgcctcggcctcccaaagtgctgagattataggcgtgagccactgcacccggcctctgtcttagttctttgaagatgtgggcatgtgtggaataaaaacatcagtgctgctggtcggacctctttgcaaaccaactgcaatttttccagacagatacttttaaacggtgtgcccagcatacttagaaaaagaaatctccagctttttacatgctgcacagaaagggcaaggaattagtcagaaatagcaaaaacaccacctggcttccaggcttttatagccctgtctacacatagctctcactcactttcaaaaccatgcagttatttttagtgtggctttggagcaaaggtggtctggctcatccagcgctgcaggggctgtggcaactgggtcccgtgattattttctgtgggtgagctccaaactggcccattatctatcaaatcctcaatggtgttatagtggttcttttgacataaaatatttatcatatgggtgggatggcgagtggaggaggggccagaaattcgtaattgcttctctctttgtcagctgcataattaactcaattctaccacaatttattaaaagtcccacttcaagagaatggttaaatctcgctggaaagaaagagccacattatgctctgaagctccaagtttcagaaaatattctttttgtgaatatataagcccaataggtcacccatcttggtcttactttcatgaaaccctgactttatattgtgctttcttttcatctaggatttactatctagaatagtcttacacatttgctatgagtttcctgtctctccactctccccagatcctccctctacccctggctccaaactcaacggagattggatgttcagtatggtaactgctaggcacatgcagctatttcaatttcagttttaattaattaaaatgaaataaaatttaaaattcagttatcctgttcactagccacacctgaagtactcgcatagccacaactccagaagatgactgctctgtttacttctgtattcctggggcctatgcagggcctgacacatggtggatatatactaagtatttgttgaatgaatacatattgtttttaaattttagtagccaactgtggctatgcataatccactgcctgtgttaggggccaagtttcctgtttttcaaggcattttctctcttgcttttttttttcgaggcggagtttcgctcttgttgcctgggctggaccgcagtggcgccacctcgggtcactgcaacctccacctcctgggttcaagtcattctcctgcctcagcctcccgagtagctgggattacaggcatgcgccaccacaccctgctaattttgtatttttagtagagatggggtttctccatgttggccaggatggtctcgaactcctgacctcaggtgattcacctgcctcggcctcccaaagtgctgggattacaggtgtgagccactgttcccggcctggcattttctttaattagaactagatgtctcattgaatggcgcaccaaagtatgaacctcgagactttgtcacaaagggctctgtgaccttgggtagggcacatgacttctttaaaggagtctcctgagggcttcacaccttgctcaaatgggccttccagagctttgcacacccctccccctacccttctctctgaacctgccctttctccacgcaatggccttggctctccaagagtcaccctggccccattgcagcccctgctgctggggcatcctccccggttcattgactccttccttctcttacaccagtgccttacatgcagttgctgatagaaaatacatatttgagcgttgaaggaatgtaaaactccattgctaaaacgaagctagggcctttcttaggatggaggacatgaaagaaaatgccacttccaaagctccacactccatcagattgacaagttagctgggatcagataataatagccatttcatgtcttgattaaaaacctcacacagactccacagaactgttgataaactagagcaaaaggaattcacagttccattcttcttataaaccaaactaaaatgctgactttcgaaatccttttttccgacctcctgatggaaagttttgacaagtgtagcactgaagcatttccccctctctgctagaggagaaatggcaatcttcaaagaccattgttttgttttattcgcttccaattcattcttagtaaacaattgcaggatttctaaaaagaccagaccatagtagttaccagacatgagatgctttctaaaagctactttgaatagaaatgttttctctgaatctgtcttccctcatgcagcaggaagaatgtctgaagctatgctaccttcatatagaaacagcgtccacagtcagtcttcccagttgggtttatctcagcggtcctttagaggtggtctacacaagactctaaatgttcctgcctgtgagcggtcttctactagactacttcaataataaagagaaaactactagattgttttgcaaagttttgaaattactgttgttgttttcttctggagacagtaaaataatagccaaggggagaaaatggcacaaatgatcaaaccaagcaaccgtatgcacattttcctccctgaggggcctttgaatttgccacctaaatgctgcatgcagtgggtaccccaggaaggaggaaatggggtcccttcatctctgctttattttgtccatcattaaatcagaaggacatggttagtgtccttcatcttcgaagggtgaagatggctgcatacattgtctgttactatcattgacattagggtaaacatataataaatgtatttttaaatgaaacagtcatttcaaaatgtccttaggaagctggtcaacctgaggccctgagctgcctgcacttctgagccctctggcatctcacccaaatgagttcattgtggtgtagaccactgaagcgctcaaggtgtcagaggtctgactcacctgggaagcacaaagcaggccttccaaaggccatatgtccccactgattagaaagatcaaaacacccctgtccctttcctctctgtgtccagcctagaggtttgcattctaggagaatggcagcagccagacacctcccaggaacccaatgtaagccctgtatcgatggcagcttcctgcgaagccactgtgagcgtgtgaaaaatccccaccgtaggaacaaaagtttttgtatctaaaacactgttggggtgaataactcttagaggtttggaaccagaaataaagaaaaagaacaaaataaaatggaagtaattaatgttgggtaaataatatctttggcctaacaagttcttggctccattgtcagcatccgtgttttctattaaattgttgtctttgtgaggcattattacagttcttccctcttaaagtctgttttgaataaagaaaccgaaggttggatgaattctatagttaggttggtctctctctaatgaagattaaagttctggcatgtcttagctctgcatggcaataattacttttaaaaaaatgcacttagggtggtgattatggcattgtaaaagtcttatgaaaatgagatgtatgtcaagagaaccttactatcaaaatcagttttgtgcattgcacccatgcttcgcatctgtcagcaaaagcaggctttctcaggtttggtgaaaggaatattgccgtggcctttgaggactgatgagtttccactaatttagagcaaaattaacagaatcctatgagcctggaggaagcagttcacttttgtttgtgttgcttttagcatactgctcatttcaaccctgcttagagaagtggcagatcttataccctcaggcagctgggatatgccagccacagagggcaagatccataatctttaacagattttactgtacacgttcacagccccaaccggccataccattgcaacctaaaagaaagagaggattgaataagcagtccagaaaattcaagcaaaactctgaaacaggaagccaggcttcctgcacttgaaggccttggggtaaattcctcatcatttaacacctgaaattttgcaaatatttggacttctcttcgaagaatgatagaattattggtctagaacatcgactagtcttctcccagccccgtattcaggaaggacagaagaatgcattggagactgatgaatatccactctgttctaaggactccagggagagaaattggatagactttactggtaacttaaggaaagacaaaaaggcgtaggtttatatatatccagagtaaaattcacaaaggcctcaagtcattaaaggtattacatactattgcaaaagaaaataatccaactcccaaaagttgaactaagaaagttcctcttcttccaaataaggttttacttagagactttcagtcccacttaaaacttcaaagcaataagcttcatttcacagcttcactaaatgaaacctaatggtagacatgcctttgactagacataaagtaagcattctttctagagaaaataaatagaaagagaggtttctttctatttccttatcagcttcacctctttcttagaaatgattgctcgtctggacagcatttgtcatgagtttgttttcactttaaagcatgaaggggagagatgaccagggagtgatacccatctgctcatcttcaaggattgcgtaggagttgagctgtagaggtttcactgcagaaagccagtattgtcaagaagcatcctgagaacatgtaattaatctctacaaatggtagaatagttacattagtgccataatttgttatatttaagctatttttctaattcacaatcaactaaggccaaagaaaagggggggggggggttgagctcaataatagcattaggatgtttaatgtgaaatccaagaagactaaaataatacaattaggccaggcgcggtggctcgcacctgtaatcccagcactttgggaggccgaggagggcggatcacgaggtcaagagatggagaccatcctggccaacatggtgaaaccaggtctctactaaaaatacaaaacaatttagctgggcgtggtggcacgccacctgtagtcccagctacttgagaggttgaggcaggagaatcacttgaactcgggagttggaggttgcagtgagccgagatcacaccactgcactccagcctggtaatagagcgagactctgtctcagtaaataaataaataaataaataaagcaattagagttacagtatggctattcaggttgaccattcctaatccaaaaatccaaaatctgaagggctccaaaatcagaacccttttgagcaccgacctggcactcaaaggtcatctcgttggagcattttggatttcagatttttcagtttagggttgctcaaccagtaagtatgtgcagatatttgaaaattcaaaaaactcccaaatccaaaacacttctggtcccaagcatgtcagataaggagcactcaccctctgatgagcttcaatcattgtgagacctttaaaatctaacaccattaatagagagcactattaacactatggacaagtggttcttccagccagaatgcccatcggtagcactcaacaggtggcactatggcataggctatggttaataaaactgcaacaaaggaaaattttagctttaacacgtgccgacttctctgcagcaatcccacccttcccgcctcagcttacaaatacgcactaactcagatacctcaatgatactcaggtgactccagccagcctcaccccaaagctccccattgcacagatgagccttctctcccatcatccacccaccagccccctgtccagccccactttcttcaattcattgatcgcagcacagcatagggaagaacatgatttattgaatcttttccatcctaaagtattaattatcaatagctgcaatataccctgacttcataggaaaacctgcacctcattctaatcaccttgttctgagcgtctcactttccttcttaggtcttgaccttaagatttcaactttactttctagccgctgcctgatcaacgtggagtgaagtgaaatgatttccccctgtatttggaagctgtacttctaaaactctgtcctagaatcacatcactctcttttaccaaccagattattgcattgcattggctcactagtaatgtatttctaccaaaaaaaagaaaaaaaaaacaagggttttttttacttttgacaagttttttgttttgttttgttttgttttgttttttgagacaaagtctcactctgtctcccaggctggagtgcaatgtagcaatctcgactcaatgcaacctccgtctcccgggttcaagcaattctcctgcctcagcctcccgagtagctgggagcccgccaccatgtccagctaattttttgtatttttagtagaaacggggtttcactgtgttggccaggctggtcttgaactcctgacctcgtggtccgcccaccttggcctcccaaagtgctgggattacaggtgtgagccaccgtgcacagctttgtattttgttgttgttgttgtgttgttgttgtttttctgcttcttcactcttggatttccacttgtgcagttaatttttgaacttgattcaggattttgttttgattcctgttaaattgtggaaaggtgcagctacagttgctgatgtggagatggagaaattgaaggtgttcttctgcccttgattttcctctctccctctctcctacttgtctaatactgatctaattcagacatagacagtccatgaagatggctattgaccaaagaggagatttctaaatgctaattcctactagtatttttgggactttattttgaggatagcatggatgaaaagggatagctatgcagccatctgcataccctcaagttgaataatcagactgaggaagttaacaaaaagaactttgtgggtggaaatgaactccttaattccagaagattaaaaagacttctttagtagaaggaaataaagtttaacaaaaagggtgcccttcaaaaatgtcagttatcttggaaggaaagatgagtaatggaaatcccggttgatcacaaagatgaataagatgcgtcctttaaaactggcatttatggaggacaagggttcttcaccagcactctgcatcctttcctagcagccgctgacatagtaagagaagcctctggaattatcttattgcatagaattagttattaattattcctacaattaagatacttatgatacaacaaagaagctcaggatcttaaagtgtacatgatgtgcgttgtatgtgtgtgtgcatgtacctagacctatttacatttatgttctgaaattgtatacatcttatatttaccaagtatttatatattttctgtatgcgtgtatttccaggggaataacaatgtactatcctagaaaatcttttcaacctccagtgctcaacataggattttagttatttttagcacttaatcttatctgagaacttaaaatgaaacccagtgtgtgtttttttaatgtcctgcaactttattagaagacactgttgctttttaaaatttatcatgtttttatatcaagcctgtgccagatgttcctaagtgttttgaacaatagctggttttgaaaccatcaggcgctctccacgtagctctgctgtgagcatcgatactccctgctctctgagcatagtgtagggcgggcggcgggccgtctgggatatgggaaagcctggggcctgggcgctgcaaagactgttctgcctggggtctgacgttggccgtgccgggagctcattgtctttccgtctcccccagttcttatcctactgatctctatatgctgttggctttgagacaataggaactccagaaatgaacagacagggaattggctcatggaggggaaaggaggcaggagtgggtggacaaggccggaaccacatttgcaccctgaggagctgggagattccgctcacctctctctctctctgtaagaatgctacatcccactcagggggtttccaattgtccttactctagttggcaggaacttaaaacataactgaagcatgaacaactgggtattttgatgaatgattgacaacatcccattgtcttcagagcccagcacaccgggccggtcattccactgttgaggtggttccttgagagagggggcagaggaccctgtgcgggggtgggatcaagcacaaagagaaaactttcccaaaacccttcaacagacttttttgtttaagaaaataataatgtttccgtctctgaacaccaagtcaggtgacccgtttttccttcatgtgatttgtgagctatttcagaacctcgtaagtctctctgacaggtcaggaatggggaaatgagaagtgtcatcctgtagagtttctcttctctggaatttgtcttgtgttattttttaataaaaataatcagtgttatgctattgtttcaaatctggagacattttactctttgtgtatcattgcctttcttttttaatgtgtgttatttctggaaggcaggcaagcttttttcttgtttgtaaagatctcttctcctgttgccaagagagataacctgaaaagacagaaaattgccaacttaaactgtagatatcattccattgatttatttacagagctttaaatcttattttgtggccactacagtgaagcaaatattattttaaaagcttcatatgaaataatcattagtagcttgttccattttaaaaattgcaggtgtttcctatgcctttgggcaggttttgttgtttgtcttttgtttgtgtgtctaaatttcccattgtctgggatgtgcacactgcatgtcatggaaggtcattgttctggttcacatgattttatttccaaactgtggtataggttctaatgtatgttggctgctgtgtagctgtgtacccatttcttactagccatgtggtttagtgactaaacagtttatttctttatacataatatttctctgagttgggatgtctgttacctgttttcacagtttaaaaggaagcataatgatttagttgtaagttttttctgccagcactatgaatcatttggggtgtctgatccacttgaatagcacatgtgggctgcagaatattcatattgatggaacaacccaaactttaggatttccattctacctgccacccaaccagtaccaactgtgttgtgaacgcattttttaggtagggaaatgatttacaaatgttagccttctttaccttcacagagttgatatttaattggaccattagtagcaagtacaaatcttaagaacgttttaaatcttgccttcagagggcatctatggtagagggctttgggtagtgaaatatttgactacttttcttaaaaaagcaaaaatcagaacaacttatagaacagtcctcctgatgtgatcagctaaaaagaaatttgaagcagccattagacttaggtaaaacttaggatttaagcaaaaagctgctctctcctgtcctcatgtgtggcttattcacactcaggggtgtctcctgtgttgaataaagtggcctccagctacagccactgcttacacatgcttggttgtgcacatgagagataaatacccaagccgcagggtgtgaggacgtagaaatccagggcatccctaaaattatatcaaactctgccaaactgcctgagaatctatgacatcctaatgcctccgtcctccagcatctgtggagttggctcctttccgcctctgtgttttccttatcccttgttgagtgtaagttaatcgggcacatgccaaggggcagcatccgttttctttttacccccttttggatgctaaggctcttcaaggatataatgcagccctgtgcagccgtggccagtttttgcacggccgcagtagagacttggcaccctggaatatctccagcaattatccagcttgagagttttcaactgaactgaagttttattaatgttcatcataatcgtgtcacgtccaattttagtacttggtatgaattagaggaaaaaggagaaaacgatggcccgttgggtcagcatgcattgtcatgatacccagcattgattgacagcttacggtggtcccggggcgatgggagcactttacatccattcacacttcctccttagggcagctccgtgatgtaacccacttttacaaggaggaaattaattgaagaacaatgatgtgagctgcccaaaatcacatcattagagagttaaggaaccaaactctgacccgagatctggagccaacacttaactttccctgaggggcatcctttaaaatctgggtatgatgttgcaccttgaaactcagttgttcaaaattattctttctttctcaacctttaacttccacatcaactctttctctccctaaacaaaatcactaaaccaaagaagcaaaagtctataaggccacagttttgtgaattaaatatccatccttttccccatctgtttgcgtttatcctactctctttcctcttttggaagcagctctgttccaggaactggcaaatcgatttggctctttttgctttcctctttgctcacagggaatctcctctttgaaaaccagaaaggttctccaaatatagcaaatgctttcctcatctccatccatcctagttacccctctcctcctctcctcccactctcctgctctgtcccactgctccacccctgactctgctaacctcatgccgattatacttctgtagtttcattaagtggatagttttcccctcttcagaagcattcctgagtcaagaacaccctgaatgcactggaagttgttcaagtcttaccctctaagtcaaggtgagatactgtgtagatctgccaattaatctccttagaggattatttaatcctaaaagaaattcttatagctcctggttttaagccctttctttactggggcccttttactttagtccttatctactccaataaggcacatagaagacattcctcactataagatgtgtggggttagagctgttgcccaattggactctgagatgcgatacttctcgccattcaggtgtgaggatggctcaccgggtaagcatcttgactttggcatcacattccagcccttacacctctgtcccagcccctgggtgagccatgttcccctttgccgtcgaattctgcctctgaaaatggaatcatagttactgcctccagcagctccaatgtggcgatggtattgagagatcagcgcagtgcctgtcacagtgcagaggctcaacagatggtggatactaccacgttttctctttctgtggaacttccgcaacagtcatccgcaaaatgacagaaaatgccagtcagttgggcattgcagggactgttgggtttgtgggcgagcatccctgcaaatagggctcccattaaagtctcataaaggaggtattttggaccttgagtctttttaaatttttgacagagccggtgcagtgtctcatacctgtaatcccggcactttgggagaccaaggtgggcagatcacttgtggtcaggagttcgagaccagcctagccaacatggcgaaacctcttctcgactgaaaatacaaaaattagcttagtgttgtgacgcacacctgtaatcccaactatttgggagctgaaggcaggagaatcacttgaacccgggagtcggaggctgcagtgagccaagatcacgccgctgcactccagcctggatgacagagtgagactctgtctcaaaaaaaaaaaaattgacagagaaaatcatcgtgattatgctacatctttatacaggagtggtccgtacaagtttttattcatttaatttttcttctgtgctgcagaagcatttcctgggcttttgacattccctgagtaaattaaggctttgtcagcctctgttctgatttgggtgatttatacatcattatgcagagtaagcaccagtagaatcacagtgtctatttcagctgaacaaaatttttgctaaggaaagaactatctgacattcactggcttagggatatttggggagacacgatagcttgcagtgcagagtggcctcctgcttgttcatgacagtacgaaatgcattcctaaatctcttatgtatcacttctgatctgactgagaagaactaggtaaggtataagtaaggaaatagtctcttatctccacccgcttcactgttcctggcagagcaacagtctggaactgtgagcgtcagaaggtcggagcctgtttttattgcagtgactcttctggttgctgcttgatatcacatgagcctctgacctgcttaactacattttaatcatcctgccttgatttgtattcttggtagatgaattgtgattcattattccataatcattagcccccccacccaaaaaaaaatcactatttttctgatagttttgatggttttagcaaatttttatattagttttggaaactttacttttttataaaaatcatcgtttttacattacatatttgtttcatgttgcaaattatcggaaggaatgcctctcacgctgtaatgtgcctgcaagcagcctgggccccttggtaaagcacagatgctagttctgcaggcccaggagggcctgaagttctgcagttgcctcaagctccccagtgacatggtagctgctggcccaggggccctacttgtaattcaaggcccccgaggaccttcctgaaacccccttggagagtcgaggccaggccgagtgcagcctcaggtgttctcctgagactgacgcatcctgcttgccttggtgaggccaggttattaagcagatagataattcattgtgtgcctagaagacatatcctaaaagttatctttcttgctgagatatggaactagacctgtcttcactcagtgatcgttgatctttagaatggccagtgtggttcatcttattaaggggaaaactttaattttacttattacgttgaatgtcactatgttcagttattgattatcccaccagcttagacttgggtggtgagtgtcttatacacctgaaagctagggtgggggtggggagacttgcttataccaccatgccagctgtagcattctgctcatggtcaccagagtgcattgtcagatgtttcttggttaggacatctgcattctacatgcaacaggtgccatctctgcccttgcttggggtcagagtgctttaatccagatgcagtattggttgcatctgtcattatcggctcatctgcagctgtccttcctgtgtggtgagcctacccctcactcctgcctggtcactctcctgaccctccagtttactttctggctctggaggtgcactgagcaagggcacacactctccctgtatccatctccatcccaggaccccgcacatccctgcagctgctcctgggtgtgcccaccccacccccactgggatttgagctcccctcaactaatgggctttccatggggaatcaggagggtgggaattgtgattccgttaaaatcatttgactcaggaaaagcttttcgaaataatccccaaggaccaactctttacagaaactcctcccccgccttcatatttttggctttgactatggggaaattcattatgttgagctaaccttggtgaaacaatactaaaaatagagataatagaaaaacatgttaaagaaggtaaaatcatctgaatacgtactttataaaattcagcctaatacttaatggctttattcagacctaatttgaacatatcacaagtatatttcaacagaactttcttcttcacagaacttttctggaaaaaaaagtatactgtcaaaatgtttctcttattagcaatcaaaacccagtttggaaaagtgagtggtttgctctgaaaaacaacaaacagggcttgtgggaattcaacagaagaataacccacggcttgtaagaatattaaaaccacggtcacattttacacagttttggcaaaaggaatagcccaggcgtctcgaatcgagatgtaatgtgaaatgaagaatttcaacagggctcattaggcttttgttctatctgagcagagttttctgctttcttggctaaaataagatgcatgcagctttaattgtatctccctttattcaaggtcttcactggcaaccttaagtatcaaggatttgctgctcaaatcatttgtaaataaaactcagatgtaaggaaatacagacaagggaggacaaaagttttgtccaaaaaaatagatatggaacaaattcagagaattgtagatataggaaggacctgatacactagcaagtctcctttcccagttgaggaaactgaggccctccatggtccagaggtgcgcctgcggcctcatgagacagaaccaggccctttcctccgggtccctcgcctcaggagattctctgagatggagaaagattctggaattacagccaaatcaggaggccttttaagattgatttaggaagagctaagagaaaatactaaatggagttgtttccaagaaacagaaataatcagtgaaatttcttttacaaggaaataattgaagcaaatgccctctgcatgaaaagtcgcattaaaacccaccccagtgggcacttcctgaatgcagtattccctgcagacagcatttgaacgatacttaggaagcaaacccttcgaaccactgggaagaatgttcccagtctgacctagacagtccttagacaaggaattcggtcccgcggtgtatttccttctccacaatgtgatcatggtggagagctccacattggtgtcggtggacacagtcatgaatggaagctgcttcatatgaggcagagcctccgtgtcccacctcacgcactctccggctcctgtaaaggggagatcatggagccgggggcatttgggccccgtttgtagtcttgcctggccctgacccatcagcacctgcctagttccgcaggcacggagaagactgcaccttctgctcttaggtggctgcaccagggcttcttgaaaaggggcagcttcctctcagggacatcagacaaaatctgaaggcacttttggttgtcatactgtggagagggtgtttctggcatctggtggggcacagggacgctgctacacatcctatatgcacaggacagccccgtgaagaagaattatctggtgcagattatctgaagtgctgaaggtgggagaccctgggctagagcagtgctcagcaccctaagctaagaggcgagtacgcgtgcaggtgcacccgagggaaagccttgccctcagaaagcccctgcaaaattccttggcatgaccttccatcttgcagctcatttctttcatgtactcagcaaatacctgagttcctactgtgtgtcaggctctgtgtatacctcaaattgaggagccaggggcgccgggcagcagtggggctcacagacttttggctgcagcagaagctgcaaggctcctcccttctcatgcacccccaaatccaactctggaggtgccgtgtcaggcgggtgcacagaccatggagctggggtgctggggtcggagtactccccatggacccccattcggaagtgcgggctgctgggcacattagttaatctcttggcaccaccgtgttttatctctaaaatggcagtgttgatgagccccccactccctaggtggctatgcctgtgcacccctaacacatgagagccacgttaggatggtgtctgggtcccttgtcattatttgggaggtgcagctgagcttcctggtagaaggacttacttagcaacccgctccgccttggaaagctgaccctcctccacctgcctcctctcctccaccttctccagcccctctgtgtcaccaggcagctctctcccgtgtcccagtgagccctccgcaggccagccttcccttgcaatggcctgtgttgccagctagtcctgttctgagaggatctgctccactcaaaccgtccccacaccttccatgtttgagcaaagcatctgtggattgcagatgaaaagaaacttcaccaaagagcacattagtcatggcctcaacccagctgggagtgatttgcatttgataacagctttttaacccccaggagcctcttaagaggtgggtcttgaaggaagtcttctgagaggcttttcttctgaggggagggtcgaacagagaattttatttagacttttctcccaccagcatggacatgagttatcagtattgtttatgattttatagaggagattttcacaagaggaacttttcctgtgcctttgcctaatgcatagtaactataagtcacttgtttatacagctttaatgtgttaactgttaaaatttaaatattaatattttaaataagtctctatttgtatacgtgctgactcatcggattctcacactcacttagagataagatggttttctatgcacacactcacattagaagaatgtagggattttttccatcaatattcgggcaagagggcactaggaggctcatcgaacacccacagggctctacgtcacacccacaagctctatctcacacccacgggctctatttcacacccatgagctctatgtcacacccacaagctctatctcacacccacgtgctctatctcatacccacgtgctctgtctcacacccatgggctctgtgtcacacccacgggctctatgtcacacccatgggctctaactcacacccacgtgctctatctcacaaccacagagctctatctcacacccacgggctctgtctcacacccacgagctctatgtcacacccacatgctctatctcacaaccacaggctctatctcacacccatgggctctatctcacacccacgggctctatgtcacacccacaggctctatgtcacaaccacaggctctatctcacacccacgggctctgtctcacacctacgggctctgtctcacacccacgggctctatctcacacccatgggtctctatctcacacccacgggctctatgtcacaaccagaggctctatctcacacccatgggctctatctcacatccacgggctctatctcacatcctcggtctctatctcatacccacaggttctatctcacacccatggactctgtctcacacccatgggctctatctcacacccacggactctatctcacgcccaccggctctatgtcacacccaccggctctatctcacacccacggggctctcacgcccagcactctggcgtcccctttccttgacatccgcctgctcctctaccgtagccagatttctttaggaaaaaaatgattctttaaaaatctaaaatactgtaaatcctattgggaaataacagttattaaacctcttcatcaggagccaccagatatcaacttaggctgtgcatctttctgccaggtgggtccttatgaccctattagtgactgtctcgcacaactggagataccagtgaacacgtgattgaactctcagcctcaaggacaggtcagaaaaggagcctcaggtcaacaatgtgttctcgacctgcttgaatttgcatctgggaatcctcctgttagtagaaaggttgaccctggacgcagtctgggattgaatctgcctcactcctttttcactccctttcagaaacaaatgaaaggaagtgtgtaaaccacacagccaagcacccaacgcatcatcatcttcatatcatcgttattattagtctaaaatggtggtggtgatgataaccccactccctaggtctcagtacccatactgagattttatgctctccctttttctgctggatttcattttttctctagaagcttgatgctatgccttgattattacttatttcaatgggacaaatttgcactagaactacagtatttgttatcactgaatttttcacggttgccatatatatatccagcatcatttgtgtcctactgctgttgaacaactactttaagatcagaaaatagaagtagtttagccagtctaaaaggatttccattcatcgaatcataaatagagaaaaaaacaatcccttctatccattactaaacctctccattccaaatgtcttcaaacaaagcaattatggtggacaagtatttgaggacagttttttctcataaacagctgcatagtgctatagcatccttgttgattagccaattagaataaattctttccacagcacattttaaaagacttaggggaaaaaacaagacttgcaagacttgaagttttcatagaacaatgtgcacccgtcttccgcccacttccccagagagaaatatatgaatcacatagcagtaaatgagtaaagtatcaaaacaggtgctggagactagggagcatgaatcatcttcttccttagatactttgtaaataaaacaggatgtatttatggtaactctgtgcgtaaacttctatttacaatgaattatataaaataaatacaatgtcacacaaagtaaataaaattgaagaatctattaaatatcactttaacaattatattaaattgtttccttaaattgatccaattttgaaagaggaatttgaataggagagatcaacaacaacaaaaattcctcctgtattcaaactttaaggaacgctagctatctattttaatgagtgaataacttatttcccaaaccacattttaagaaagtcaaaaatagttgcatcacatttttcctattgaaaatatacactttgaataacagaaaaataatccgcagataattttttaaagatttttactcagcttagtggtaatagatttctgtttatattaaccttaagaaagagtgttcagaatggagtttggccatttcattatgagttatggatattattgtataaaacatgtacacaaaattccactgatgattttatctaatttcaaccataagattctgacagagaatcaactcaactagctcttttaagcatcacttttaatgtaccacattttttaagtgactcttgtttatttttttaatgtttgctcaaacttatggggatagtgccatgttctgcgtatccacgctaggatgtggcctttttgagccatggaagatgctgtcagaacagggtccggaaaaaacaaataggacactcgttattttcttgttgatttgattagccatatgtaccatttacaatactcttgggggacaaaaggaagagagggaaaaaacaattgtatctgaatattgcaagctaatcttttataaattttaccctttaagggttgatggattcagaaattaatcaactgtatttttatctgataaatgctaatactgtactgcagtgcagttgtggttttgagagttacattcataggtttatgtcagatcaagaatagattttgttggggggtgatttttagattgtaggaggttttatacacataataaaccaagatgctaacaggaggatgcaatcagtggttattttgtgtcagcccttttctttttttttttttttttttttttttttctgagacagtctcgctctgtcacccaggtttgagtgcagtggcacgatctcagctcactgcaacctctacctcccgggttcaagcgattctcgtgcctcagcctcctgagtagctgggattacaggcgcatgccaccacaccaaactaattatatttttagtagagatgagtttcagcctgttggctaggctggtctcgaacgcctggtctcaagctatctgaccacctcggcctcccgaagtgttgacattacaggcatgagccactgcgcctggctgtgtcagcccttttcaagctgcagcaacactcacactgatgcacttggccactgagaggtgagccattggcagatgatgtacagaggatggaagaaggactgctgtgcaggcggtaaatggcatctgccagactgcacagatgaaggttcctaccctgttcactgccgcatacaggaaatatgatcaaaagagtggtagtgtgtttagacttgtggctcactctgtgtgagaaggaaaattaaataccaaagccatctataaagtagcaaaattgccctaaaagctgcaaattaggtcgtaatcatacatcaatgacagagaagtacatggaagacctggaaggatattctagaaatagctaccatcttgatggttcatctcttcttaattacttaagggaatttcgacaccttattaaaacagaggaagtccaaggtgaactctaaaaccctccttaagtatccaattctatgattcggtgtgaagcattatcacacttgtcccaagggaacttaaccagtaatttcaacgcttcagtggggagtcacacgtcagatggactcttgcgggccatgctctcaggtagtggcttgagtccccctgctcctccaacaaggccaccgtccagctattaatattactcccaattccctggacttgctatgtcctctggcgtgtggagtgcctggctgccgccttcattctctatctgactgtctcctgctcatgctcaaagcccacacccaatgtcaccttctgggggacgctggtcccaaacacctgccttcccaagccaagtcacagctgagccctgtgtccttagcaccctccaaagccactgtcttccctctccatcccccagtggactgcgagcttctggaggatgctccttccctggcatagagcagacatgtagcagcacttagtgaggaaggctgaggcaagctctgtggtccagtttccctgcaaataggggtttagaaggagctgagaaaagaggagatgagggtacactgtagggaagaagtgatattcacaactgacagcaaggaacaaaaaagttaaacagaggccgggcgcggtggctcacgcctgtaatcctagcactttgggaggctgaggcaggcggatcacgaggtcaggagatcgagaccgtcttggctaacacggtaaaacactgtctactaaaaatagaaaaaattagccaggcgcagtggcgggtgcctgtagtcccagccacttgggaggctgaggcagaagaatggcgtgaatccgggaggtggagcttgcagtgagccaagatcacaccactgcactccagcctgggcaacagagtgagactccgtctgaaaaaaaaaaaaagttaaacacaaaaaccacagtatgaactaaaagggcttagaaatctgaggctgttcccatgaagaaaatcctcatcctggacttctgtgtctgctaagggaggcacagtgattatgatagttggaggttacagtgtgtggatagactgtggttacagtgcctggatagaccgtggctgcagtgtgtggataggccgtggttacagtgtgtggataggccgtggttacagtgtgtggataggccgtggttacagtgcgtggataggccgtggttgcagtgtgtggatagaccgtggctgcagtgtgtggataggccgtggttacagtgtgtggataggccgtggctacagtgtgtggataggccgtggctacagtgtgtggatagaccgtggctgcagtgtgtggataggccgtggttacagtgtgtggataggccgtggttacagtgtgtggataggccgtggttgcagtgcgtggataggccgtggttgcagtgcgtggataggccgtggttgcagtgtgtggataggccgtggttacagtgtgtggataggccgtggttacagtgtgtggataggccgtggttgcagcgtgtggatgggccgtggttacagcgtgtggataggccgtggttacagcgtgtggatgggccgtggttacagcgtgtggatgggccgtggtcacagcgtgtggatgggccgtggtcacagcgtgtggatgggccgtggtcacagcgtgtggatgggccgtggttacagtgtgtggatagaccgtggttacgttttgtggataaagcatggttacagtgtttagataaaccatggttacagcatgtggataggccatggctacagcatatggatagactgtggttgcagttatgggtagaccgtggttacattgtgtgactagattgtcgttgcagttgcggatacactggttaaagtgtgtagagtgttgagaaacgctaagtagctttcagcctccctgactgcaccgagcaacctttggtgtaaaaaatcctccaaggttttcggacacatgctcaagttacagaacaaaacaactgcaggattcactttgtaagaagagagactcaggtgtgtttcttgtgtaagccacagtgctggaaaagtaggatggctcctggggatcaccaaccccactccaatctcagccatcatttctagccatgcaattgggtgtatcccttagtatctttgatccctccttgtctgtaaaaaatggaaatgaaaatactcataggttttatgtggagtttataaggcaactagtgcaccatatggagtggagaagtgctattgctattataattgtgtaatagtatgtaatacattgatatgtaatatattaatatgcaattataataataatagcattgttattatttctccactttggcccacaaacctgaattcagccacttctatgtagagagtactcagataaaaaagaaaagtgagatgcttacgctctagaagaccatgatgtgggacagagacggaagcatgggatcttctactgattgtgaaaggacgtgcgaaacccaggctgctggccatccccatgaagggctgctagaagggtctactgaaaatggcccacagttgggtgctaaatgaggaaacattatccagaaaactcacttaaatggagcgactgaggccgggcacggtggctcatacctgtaatcccattactttgggaggccgaggcgggtgaattacgaggtcaggagttcaagaccagcctggccaacatggtgaaaccccgtctctactaaaaatacaaaaagttagctggccgtggtggcgggcgcctgttatcccagctactcaggaggctaaggcaagagaatcatttgaacccgggaggtggaggttgcagtgagccgaaatcgcaccactgcactccagcccaggagacagagttagactccatctcaaataagtaataataataaaaaaaaggagcgactgatacccacatataccaggtgcattagcacaatcactatttccaaaggctggaaggaaatagccttgccgagggccagaccctgagctgctggaggccttgagaatggcatctcacgtccccacggagagaattgtgatgcccggacatcacgggcgcttccatgtgggtgtttccgtggccagagggattctgaaatgtgtagggacaaggacccattccagggaagccaagtgtcggccgcattcaccacccgtcccctgcagtctcacacctgcccgaggaggcagcccagcagtcgggggccccgagctggggaggaacgcaggcggctgcagccccgagggagccctgcgcttgtttctaagaataggtggcttccgggatctggagttcggtttttctaaatacacctcagcccggagactcggaggcaggcaatggggccaagtaggcagccttgggagtgacatcacggtttcctcttttaaggcgattctgaggcttccttctccccaggcccctcccgcccagctgctgcagctgctcagagccacctcggcctccacctctgcggagctctgacctgccctggcttggctgtgcctgggtttgggacagttcggtgtgtgttaaagaagcagagctttaactgcgttgagggtgtgttttccctcctgcctgctcttcttacctgcagtccaaacacgtgtgcctcggttgtttctaaagcttccccgtggactgcatgactgaaaatggactaaatgatgattatgttaagaagacttgacagtgccacctttagagggaaacgccaaaagtggcccagaaggctgagggacaggggcctatgtaagcttcacgggaacagaattcctaagctgtaaggtaacatttctatgcaatatgaaacctgagaacaaggcttaataacagcccctccaggacggcggcaagcgagccctcaagcgcagtctgcatttccccagccgcagccaggcagctgccggcaccttgggaggcactgggagcacgctggtgacttctcttggccagtaggtgtgggcgtggctcggtgctccagacactacttgaaaagggaaggtttctgggactcctggcaccgcggcctctcctctgcccaaatttcaagatttatttttactcgttgaacgaaaaagagaatgagccctgtactctgtcatgctccaaactgctgccccatttttagaccacagagcaagatgaatgctgttggaaggaatgtgtttatgagagagacagtttttaatccatcagagagcaatacttgcgactttaaatatggcatatggtgaaaaagtgtccctgtgatgagtcagcaaaaaaaattatttcacccctcacatatacgagggtttgattagctcactgattgcagttttactagtgtgcagcacagactcaaatttaaatatagcttgagggaaaactctgacatcagaatttgtgcatgataaactgtgttgctcaaacttcaaaggtctggtctccactgcttccgggacctccccctgcctcccaggggacagattcctcgtgtgatcccacaggccagctgcttcaaagctgtgtctttccttgggccccttctgacccattggctcccctgtctccactcctcacggtctgccctcaccctctgtgatcatggctgtggccctgcgatctccatcctgtctccttgtgacagattttccacctcaccctttctttaagcagctgacactcagacccatccttcctttgtgtctgatgtctttggttgggtttataaaggcaagacacttctcccaacccatgcaggacgtcctcacagatcagcttcttcaaggagacctagcccagcccgtgaatgagtggtggcagcgctggcagcatgagaacaggagttgaaacctgctctcaccccggccaaagatcacatcgcttccctttcctataaagtagtgcatcatgtggaggacatttcgtgtctgtaaagtaccatcacccttttctataaagtagtgcatcatgtggaggacatttcgtatctgtaaagcaccatcacccttctccctaatctgtgcatgtgtgtatctgtagaagtgtgcgtgtgcgagaatccacccttcatgatttaattgaaatcacagagcagtgatcagcagcagcgaagatgaccctcacagctggggagcccatgcttgatgtggtcagcattgcctccctgcaggagggcccggctcagggagtccttctcagacccctctgtcttccctatggtctattaatctccccatgcaagggaagatgatggacatcaaatcgactgtaggctgtgctcctctgtgcactctcacgagcactaacacctcccagcatgattctccaggactgcggctccaagaggaaagctggccccagaagcaggctgctgttcagggcctccttgcctggtccagtccttgcttaggtgaactccagctgaccaagataagcattcactgcatttggtttaagcagcctttcgtgtttattgtgttagtgggtgcttttctttctaaagcaaaaaaaaaaaaagtttaaaaatttttaaaactaccctacttcttttatgacttttactcccttctcaaaaatatcagtgtttcctaagttcgataatagcatttgaccaagtatagtacacacttgatgaaattaactcagttttattaaatgcctattttattggcatgggatgatttaagatgaagactctcagtgttaacggcctcaattcatttattcaaaaagcatgtattgagcctgctctgggtgccagctactatgctaggtgcaaggatgtaaatattcgtaagacacaatcaccccactcaggattttttgctgtctacttttattgtcctgtgaagaggaaagtttggagagacccactcccctccaaagtgggtttctaggtcatgtcccatcacaggaggaccagggctcttgagctcgttgggaattccaggaagacttccatggaaggtggctggagtctctgtctccacagattcccaaaggtcacgcagtgaccctgcacagggagccttgaaacctttgcagttggagccagagggactccacacaccttctagcccagcgctgggagtctgtgggtgggaccccgagtggtgatgtgttgcactcaacgccatgccatgggtgaggagcagaacctggtccacactcactctggtaaactgacaccccattaaaccatgttttaaaacttgtgtattgggaacttcactgaactcagcagtagttattccatagggcagctggaaaccattctttagggactggaaagtccattctcatgccctttgacttccttgatgttaattctaaatgacacattctcaggatgttttccccagaggaatcctatatggcagggctgtgtacaggcctgagaagcgacagggcagcctgcggttacacttgactgagtaatccgcttgtttagggctgtggccgatgagtccctgttcccatggtatcctaaacgtttgcagttattaccaaatctgaattcaaccctcatcttttatattgaaattccttttttaaaaagacatatgtcaagtggaagctatttcatttgtatctgacactatcttttcaaactgtttatccaatcatttgggtcccaagtgaattacgaattcatcaacttaaggaagaaacttggaggttaagacttctttttacgatactccctcattcatgaaaaaatgcgtttatttttagtagtgctttggattctgtgttttgtttgttctttggttttgtttctagaagagtcttgttggaagctctgtttccagaatgctggattggctgtggtggggtccataacccactgcctgtatcaaactcatacttcaagaaaatattaaatagttgcagtatctacagggcctctacagagccccttctgctattagcagggatgtgactttaggtcacaaaagaactagaagcaaaatggtgactatcagaaaaccttacccaataggagtagccagacttggtcatttgtgaggagtccggcagccggggttccagcatctctgttgcttccctgctgttgccagtgtaaatgttttatcatagtcaggatctgttgagttaaaagaatatccagagatataacaatgcattctttgtctgagtcattaagaatgtttatgaagaagaaattgagtagtgaaaagcacagattcagagcccggcagatcttcctctgaaaattggctctaccgcttactagcgcgatgcccttgagtaattctctaatctctgtaagcctcagtgtttagttctgcaaaacagaagagcaacacctttctttcagggtcgtcattgggattcgaggtagacaaagtaatctttagtatctagtcacatgatcattggtccccaggtgctcgctaaaaggcagcctccacccgtcctgagagtgaaccactgcattcttcagtgttcccggctggcaggtgtggactgctggttctcttcagtttgctctgaaaatctcactttgctttgcccttgctggatatttacccaggtttcttgggctctttctgcccccacgtgtcttgcacatcccagcaggtgtctcctctggggccttctctcctcttggccccacacattctgtttgctcccagggtggatttggaggggagtggtaacaaagacccaagttttcaacaacaaatggcaggaggtgaagaacttcaaatttgagattctaggaaaaaagaggagtttgaaagaaatactgaaatactgaaagtcacggttgaatatggtgagaacttaagagtaaaataaagaatcatcaagaaaacaagtcagtcagtcaacaacttgactgatttaaaagaaccaatatgaagagtctaaagaactgatttattcttgcattcacgttccaaagcaatttaagtaaactcaaagaatgatgctatagttgaaacgtaaatggaggaggactgggtatttatctccaagatgcagggagaaaggtgggttttgaagaggaggaagccaggacagaatacccgaagtctgcaggaaccaggagctgggaccctcgagggcagtgggaggagagacggtcacagcagtgctgtgagtccgcggggctcttccggcccctctgcctgtgtgtccactcagtatgtgaaaaatgcctgtgaattgttcacccaaaaatgtattgtgcagcagcagatgtcccctaccccatgcagaaaaaaagaccatattagtacaacgcctgtctcattcctgtttcctcaggggatgcctgagaatcccttgctttaaaatcctctcccgacccttatctaactgtggtcaagaataattgttggccatttcctgctctggaaaccatctggtctgctgtggtgccctctatcctccctcctctttaactataaattaagtcctaaaagaaagaagtagaagaactgagacaatttaggaccaagaaagtaaagttaagaaataattgtattaagtctgtaagtttagaaagggctgatagccatggggcaggtggttgattttcatcctcaccatgtagagaataagaagggaaaaacttacatggaggattctgactagcctggagcgagaactcacagtgattcagcaaatatccacacgaacagctgcgaagtattgttgatctccccctggtgtcgcccacctgggaggattggcccacggtggtgctgaaggcaacagtatggaggttggcttcaaatcccttctggcagtgtaaattcatgagaaatgctgaatacagttcatctcatgtgcttttcttttgtaaggtaaaattgagctctttcttttctctaacaagctcattttaaaggctatttaagggaaacataaaattaaaatataaaactgaacctttcgctggctcaatttcttaatgctaaattgctctcccatccaagaataatttcaaaagtttggaatttataaatggcaatacttggatgtggaaattatgttaggactcctatttttatgaatacaatccagtataatgtaaggctatataaaatgaaatatttctgttgaaatgtatttcaattctttgtctgagtagtgaggattttattattggattttagttactcaagtttcagctatatttagtgctgaaattctaggccattttaagagaatcccactataaagagggaaaaaaaaaaaaggccaggcccggtggctcacacctgtaatcccaccatttttggaggccaaggtggatggatcacttgaggtcaggagttcgagaccaacctggccaacatggtgaaaccccaactctactaaaaatataaaaaatagacgggcgtggtggcacacacctataatcccggctactcaggaggcggaagcaagagaatcacttgaatctgggaggcagaggttacagggagccgagatcgcaccactgcactccagcctgggcaagggagtgagatgctgtcaaaaaaaaaattcttttttacatgactcagatacaatgagggtcaaagtatctttgcccaaaacattactgtaggactcatagtaaaaaccttccagcagaatgaggtgttggccataccccctgccactatatgatgactttctccaccatatctgtgtgctgaagagtcagatgggacagtagaagcatgagagaaaatccatgctggaaccacctgtgcttgactttgtaaaaaatttttctcacaggtctttaggttaaggatcttttaactcccttgataatttggcaaataggtattttataatcgtaaaacaagagaaaacattgatgtagtgcttactttctgccagacactgttttgctctgtgtgtgcgtgtgtgtgtctgtgtgtaattaactcacttattactattttccccctttaacatgaggagcagagaggctcagtagtttgccacttgtccactgtttctaacctggttaggctggtcagcatttgaacatggaggataggacagtcacatgacattcgcacaagtagagagaggaacgttgacttctgagtcacaggtcttctcctggtagcgccatcataccttggggatgtttcacagccacaaatccaaacatgcgtcccagactgcatgacccgtaccccagttgtgttgacctatgttcatttcctaactcgtgcaattacacaaggatggtcttggtgcacacgacctctcggtccattttctggccaatattcagttccttgttctcgccttgccatttgccacgcttcagtcagtcttgtttcccacactgctgctggagaggtgggctcctccgcgggtgggccgatgaattacttgcctttgcctttgctagagtgagatgcattccatcatgtaatacatcaaaacatacaccagagttctggcccatctggtgctctttgctcagatcccctggccactccctaattttctccactcccacaacttgctgacatagatttgattttcaattcagaacaaattcaaaacaagtaaaaaagatctgatggaattagcagacacatgtcaaattatccacagcttcttgctggagacacatggaaagatagggtgcagcacgtctccggggacccagagctggagaactcctagcagcctccattttctacaaagccacgggtcctccacagggttggccctagtgcccagaggtcaacagtggagacctgtctcctcctgggaggactggatctcatatcaatgcgtaagatgataattaggtattgccagcattccccttacaaatccttcaggcagggcaactttggagcacagtggttgtgtcttaggaggtccagcaaagccagttcccttcaacattagaacaagtcactcttccttctacggagcactgcctgggaagtgactgccactgccatgttgtgtgacagaggacagtctttaaaggggtttcattcattgtggacagatactatatgaaggcacataagggatttcctgatggggaggatggcaggggaggtgtcccacgatctcagtgcttgttcatcctgtctgtgtctctctctccactccctgccccactcctcatgttgcaaagttaaatgagaacgtgacacatttttcctgtgattttcattttacatttttagatgtggtcattatattcaactggatataacattttgtttctaattgaaaactttttccccaaaagtttttgtgcttttgaagcaaatgcgaaagtccatttctggcagggcgcagtggctcatgcctgtaatcccaacactttaggaggccgaggagggcgggtaacttgaggtcaggagttcgagaccagcctggccaatatgacgaaactccgtctctgctaaaaatataaaaattagccaggtttggtggcgcatgcctgtaatcccagctactcggaagtttgaggcacaagaattgcttgaactcaggaggcggaggttgcagtgagccaagatcgcgccacagcactttagtctgggcaacggagcaagattctgtctcaaaataaaagtccatttctaattccatttgagggatatggaataaagtacataaaaagtaacgagtcaaaagaaagaaaaggttttagtgaaaatgaatgtactcttctcccccttctattgtttgtaatagacttaatctttaaagcagttctggatttacaaaaacaaaaaaattattcagagtgtacccatatcccctcccgctacctctcacccctagttcctccgattattaacatcttgtattagcgtgctgcatttgttacaactgataccagtgttggccttccattattcttttaaatgtgaatctgactctggggatttgtgtgactgaatctcgcagattgagaacgatttttaacaaccagccatgcttgtaaaaacatgtggaagtttctctgactctgaaataagagggacaagatggttcccatgcaggcttgcgttggaaatgggggagcgtgcacagtctaactccatgccccgtgtttttcttgagtagccctctgggttgaatcaccctggacttcagctgaggcagggggattgttttatgctcaagaaagctccaggagtggtagaatctggccatcaagatgttctgtgaaatggggctcttgtcttttctggagaacatgccttcttggccctttgatcatgagacatctcaccacgccctcctttaacattgctaatgatggggactgaccaccccgtcattaaaccccatggcagtctaagattaagccattcagaatcttactagaaatgactaagcggaccgttttttcttgtgaggagagaattaaaggcgtttccaatccctaatgataaaaccagcatcaaattgtagagaattgcaatttctttcttacaaacagcaaatttttgtctcctttcattttttaaactgttgaacgtgtcagatggtatgcatagagagatttcagaggtctagtcaatgtgcaaatgttttgtggttttattttgagtttgaagtcagagcactgaattccacaaggcttgagcctcactctccctcctgagcacccaggcttcacggacatgactaataggagtttattcacagcctgctaccatccttggtcataacgttgctcaaggcccgagcaggcctgccaagaccacagtgtagccctgttaatatcacatgaccgtcggagagtttttggaaaacctcctctggccgactgtttatccgcccccattgatatttgtctgaagataagttatacagtctgtttacttacaaatgcgtcagaacagtcttggacttctgcacggaggttctgccaaatacaagtctaacagggaagtggtttgggcagccccggaaccgaagaacccctcagagcatcacaagccatcactctgggtccctgtcatttaaatagggattcaggcttcaggttgtcagtatttataggcttgattggagggaagtaagccgtatgagcactttttaaatgaatttttatttctcatttccacttagtgatggatgcacatttttccactaataaacatttgaacttttttcagtttttaagaacatcgtaggtggcatatttcacaatcttggcaaggcagacgtttttggagtaaatcgaaactggaggccagaagtactggctctgaactgaactaccacttgcaaatcgatgtagcagaaggaataatggatcatgtggaccacgcagaaagcgatctgagacgggcgtgtcagccgcatgtggatgaatagtcctttgtgggcaggaaggagagggagtgggtgggtatgagggcaggagaaagaatcagctctgtgtttgggggctgtgagaggacactcagaagaaggcttttacaccatattttatattcacaagtttatttatgttattttgagtccaacagaaagagtcacaaacgttaaactttagcaaccccctaatgattggaaaagatgggcaaatccttgctttaagagcagctgtatcgtatggagaagaagtcatctctgctgggaaaactcgcgaacagatgcaggctaaagcgaaagatcaactctccacaccattacattttgaagggctttgaagttatttttagaaaaactcaaaaatctaaatcaaaaatcagattttttctttttttttttcctactgcttccttttcctttttcttcttctcttgtcccttctcctttttggttgtttctattgctatttttacatgttcctttaggtggggggaagataaggtgtgaaatgtattcaagtgcaactttttcaaaataataaaatacatgtttattatgaggaaaactcaactgcctatagaaatgacaacggtaaatgtaaataagcaaaagatcagagatataagtgtatagccatcacttcctttagcaatcaaataatgagctgggcgcagtggctcacacttgtaattccaacactttgggaggccaaggtgggtggatcagttgaggtcgggagttcaagaccagcccggtcaacatggtgaaaccccgactctactaaaaacacaaatggtgtttttagtgttttgtttttagtttagtggttttagattttagtggtggcaaatgcctataatcacagctacttgggaggctgaagcaggagaatcgcttgaacccaggaggtggaggttgcagtgagccgagaccgtgtcactgccctccagtctaggtgacagagtgagactctgtcaaaaaagaaagaaagaaaaagaaagaaagaaagggaaagaaaggaagaaagaatcaaataacaaaaagcacagtcagcattataagatatcagacatacccagcccagaggcagggtggagttggagatcatctagtccatcaaccaaatcaatttaggttgatttttttttaacaatttttttttttagccaagtcaaaaaaagtatttttagccttacttatatataactgtatcttttttggctcacttagaccattttatcaaaggagatcaaccacaaattcctgccggtttttagttgtaagaagctttttttattggcaggaaaactgggagaatgtgtaagttgttaagcagccaggccactctgtgcccagtattctggtaactattgtgaaggatgtttaagaagcaggtcaaaggaatgaaagggcattggggagaaaggtgaagaaaatttattgaacacctatcacatttttccctcactagctacttaactcacacatccgcacaggagcccaaggttaaaccacttgtctagatcaccaaggagagcaaagataaaatcttgttcctcccgtaagccctcagagcctgtgatgtcagacaccttgttgagagataacattcacaaaacaaccagagaaccttgatggccatcatatattagtgacatattcatgctggcatgtggggcataagtgagctcccgtattgacttggtctgagaatgaagaagtctagctttacccataatgggctttaaagcagctctttgagtttggttggccccagacctaaagtcttgcatctctgaaccactttacctattttctttcccacagaggacaaaaataaatgtgtggaactgagcctaggtcctgtgaaaccttttattctccagatgcatagcattcccttggtgacacaatccagttttgtgaaatatatgaaaatattggaacttttcaaaaattgtctaaatttggggggatgtgccatgagaatgtttaaaatgcaaattcccacacagttcatctaattgattttaatctgattatgcctgccctgcaggatcttcctggcaggaatatgataggccacctgcttcttttaggggaaaacattctgttttgagggtaagagaagatttgagtgaggtttgctttggtcatggcttctgaagcttgataattgcagaagttccatctgtaagatgctcgattaaaattctagatgaattgagtaatctccacaaggccaagagaatctaatgttcttgaatttgttccatattcacgatagatctagtaaccatgtgtagtaatcagacaaattctccaaaacatacagccagctggattcctgaactttaacaaagtttttatgctgactgcttctgcaacctcactaactagccagcctagataggaaactcccttcttaattcattcataaagtaccttttgatatatagacccaatctctaataaaccttttggagatcaatttgcatatgtgataaaagtgaaaaagttggtcttcagatacctactacagaaaaaaaagtgaaaaagttcttaagcagatgagaaatttaaataagattttaagtattttctgaacattaattcacctcttgacttttgaaactttggtcagacggaaatgttcattccttctccctgaaagagttgatggttagatttcataacacagaagctagtaaagcaaatgcagtaagaaaagtagcctcccataggtattcaaacacgtattcaaaattaagacagcagaaagtctaaatgtttaaaatatgcttcattaacttctgattccttgaatctatccccatttattaatgtttatatagagaaccaaaaaaacagaaaaattactatgatgactattaattacatcattttccaaaagggggaaaaatattgtaatcaatgaaacctgaatatacttttataattgataagattaaaaaagttgtaattccacttcagtaactaaaagagttattcagaagataaagcatttataatgatggacctagatttctgcttcctatagagatttcctgcccacgtacacatattctggttacacaggaaggctcatgagttgactactttggccagccttctattttgtaagtattggcagagagatacttaagaaaaaaaatgatttcataagtaaacttataattaagagaatgaagaagaagatgtagctcttggggcttccattgcctcctaacagaaaacatctgctggacttccggaattttcctaagaccttgagaacacacccacgcatttccaacttttttcctaaccagtgagttggcttcagcagttttcagttttatagctgactgtcccatccaaacagttgttcagctttgccctttatcataaattcattcccatttgtttattgcatagtattggttaccttctgttaattgggaggtggggaggaggaccagagaacaagctcataggtacaaaccttgtcaaaactaaaacctgttttgtagatgaggattggttccttgtattgttagcattgcctttgctcaagagaatcaatccaactcattttagtaccatctgtatctttcaaaatgaagaagagtagttaaaacaatatgaagtatggcatgtgtcaaactccacaaaggtgttttccatataaacttgagaaaacctaattaagtgggttttgaagagacaatggagctctgtttatatgtttgcctacccaggggaactaaaacaaacaaaacttacttttaaaaagcttcttcaaagttctcattttgttttagaagaactttcagcttcattgctttctaagtagcttgatatcattagaaactgataatgctcagcacagtcagcgcaagataagttaaccagcttacatccacctatatgtttaggggttctcttggtctaaaacgtcttgaaaaccaaatttctgtgaatcagttactgtcttagtccacttgggctattataacaaaaataccttaggctggataatttataaatgacagaaatttatttctcactgttctagaggctggtaagtccaagatcaaagtactagtagatttggtgtctgatgagatccaggattcatagatggtgccctgctgctgtgtcctcacgcagcagaaaggacagatgctccctcctttataagggcactaatcccactcatgaggacatcactctaatgacctaatcacttcccaaaggcaccacctctcaataccagcagattggggattagatttcagcttatgaattttggagggacacattcagtccgtaacatttcacccctaacctcccaaaatttatatccttctcacatgcaaaatacattcattccattctaatagcccccaaaagtcttaactctttccaaaatcaacctaaaaagtctaaagtccacagtctcatctaaatatcatctaaatcaagtgagagtccaggtatgattgatcctgaggcacatttctctcccagtatgagcctatgaaatcaaataaattgtgtgcttccaaaatacaatggtgggacaggcataagacagacatttctattctaaaagggagaaacaggaaagactaaaggagtaagtgatgccaggtgagtccaaaacccaacagggcaaagaacattcgattttaagtcttgagagtcatctctgactccatatccgccttctggacacactggggtggggattggttccttgagtctcggggcagccccgcctcccatggcttcactgggcacagccttcattgcagctctccaggctgggcaaactggtcactccactgttctgggtgctgggggcagccccactcccacacctccccacctagaagaaacctacactgccatgaacagaatattattcatggtgttctgacagactgaggctttttctgcaactctcttcttcttatgagccctcaccttacggagtgaggagcccctctcccacaacactgcccttgtggggcctctgttgttggccctgctcctgtgtcaggtctgtgcctggtcacagaagttctccagggcatcccttggaagctgggtggaggtggccacattctcacagctcttgcactctgtgtgcctgcagagttggcaccacgtggaggtcacgaaggcttcctgcttgtgtcctccagagagaccatctgagctacacctggacccactggagccacagctggggcagccgaggagcactgcatccgattgcagggagcagagacttgaaattgttctggccccagggtcctggcattctgggcctaagatgggtggggcagccccaaagattgcctccggaggtccttcctcagttgtcttgattagcagcatctggcttccctctaccatactcatctctttatcaaatgtttgcttggctacaatctcgatgttctctgctgaacatgttttctactcttctactacctggacagtctaagaattttctaaatctttcagttctgctctctgtttcttgataaattccatctttaatttgtttctctctgtttacactttactataggcagtcaagaaaagtcatgccacaccttcactttgcttagatatttcttctgccaaatatcctattttatggctcagaagtctaccttccacaaaacacaagtagatgagcatgattcagccaaattctttgctgctttgtgacaaggatggccttccctttagtttcaataacatgcttctcatttctgtctgagacctcatcagaatggcctttcctgtacacatttctaccaacattctgatcatgaccacttagggaatctctaagatggttgaggctttctctacagcccccctcttcttatgagccctcgtcagaatcacccttaaggttctgttcatggccatgtaggtttttttctagcatgcacctccagattctttcagaccctacccattacccagttctaaagctaattttacatttttaagtatttgttaccccagcatcccacttttaataccagtttctgtctcagtccattcgtagtccatgctataacaaaaataccttaagagtaggtgatttatgtacaacagaatgttattgctcatagttctgcaggctgggaagttgaagagcaagtgaccagcagatgtggtgtctggtaagagctctctgcttcatagacagtgccttgctgctatgtcttcacatgacggaagggacaacaggctcccctgggcctctttgagagatgcactaattccactcaccagggctgtacccccaggacctactcaccttccagagtccccacctcttaatgccaacacactggggatcagatttctactcatgaattttggagggacacagacattcagaccataacagttactgctcaaaacaaagaagtaaaagctagcaaataatataagtatgatgtatttagatttattttagtattgctcattgcctttttaaggtaaactttctgggtcaattgagctgtttagatgccgactcatatttgaaggttctgctactcctctacaataccagacttataaaaatcaatatattgcaatcattcatatactcagcgaacatgctgacacctactgcgtgaagggttctgtgatatgggcagggggtgcagacttgtatcaggcagctactctctcagaattcactgcctggcagggggaggccaggaggctgtccccagctaagacacaaggcatggcttgtgctaggccaacagggaggtgccgggagtgtaatacaacaaggaggagccgccaaggctcacaggagggtccccatatggacccaccattgctgagtgtgtgtaagaagaagagcaggaccagggaggtgggtctgagaaacagtactgattaagaaggagtccaggaaggaatccctgaaaagaaaatgaagaccaagtggatagagagacaggaaaggagccacagacagttctcccagagaaagaggaggttaggaggagggagtggtccacaggacctagcgcctctgggagacaagggtagaaaccacaccatttctaaaatgagttggggctgggcacggtggctcatgcctgtaatgccagcactttgggaggctgaagcaggtggatcacttgagctcaggagctcaagaccagcctaagtaagcaacataatccaaaaaaattagccaggcatgatggtgcatgcctgtagtctcagctactcagaaagttgagaagtgaggattgctttagcctaggaggttgaggctgcagtgagttgtgatcatgccactgcgttccagcctgggtgacagagtcagacactgtctcaaaattaaacaaagaaataaataaaatttaaaaacgttaggaagagaggaagaagagggtggtacctggagggagatctgggctacagagaaacgttttagaaaatccatgtaaaatccaaatgcagcagattatttcagaggtcaccagggtgaattatggctgggaaatggactaacacaaaaaagatgctggtgtatattgtggaggttcgggaagggtgggactcatgatgtgttcaacaaggctgtatggaagcctgggttgagtctgtgtcccaggaaaggcccactagtgggtcccggtgtgggacccacccccggcccccaccccttcctgccccttctggctttctgctccactcccagacccgtcttctccatcacccgacgttttcctagaagggcataaaacttacaccatgaggggacctccacgttagacagggggagaagctggaggacatgaatggccccgcagtcagggcccagtcacctgatctcagctctgtggaggtgaatgtgtttgagttgccctttttgtgaagacgtggtagctgcaggcatggacaacttacacattgagcaatttatatactatttgaagccacctcactttttcccttggtttttggtttctggggttttctaagaggggagagtgactcatgtctttcccactagtaggtggccttggttttaatgctgctcaatggattctaagagagcatcccaggaacctgctggtatcagcccagcacatttttggggtctctgggaatgagcttgggaaggtgagtgaagaacaactgaaaacaatgaagcgcatttgtggctggaggtcatgttctgatgaatcccgatcgggggaagccatggctgctcttgcagtgatcaagtgtctgccgcctggattctttcctggcatgtcagatttgcagcttccgagaaagtgctactgtcttgcatgacaaagtaatatttggctcaaagaaaacactgccaaactgagcagccagtaaattctatgacagcattcaccataattcccaaatgtaaaccagatagtaaagtgtcgttcataaccagcggactgtcagaaatcagagaaatgtgggagtggcctgcagaagctgatctgctgcccctacggacactgatggcttccttcatcgatgcagactggggagaagtgggcgaggtgtaggccccaagcagtcccaggctgagagcccggcacaggactggaaatactcatcagggttcacaggctgtctggtcttaaggaagtgacagcataagcaggagcatgtcagtaaattcacagcaagaccctgcatgcaattctatttgcaaatggaccctctcactcttgcatgactggctccaatagaagcaaaactcaggtccatcctagagcacatcccaggagaagtttctctatgggggatgagcttcaaaagtaattgtaatttaattagaaatttagatgtgagtacctggtttttttagtgggactcttttttttttcttggtaatttatacattagccgagacgcttttcctactacactgccagaagttaacttctaatagagttcatacattttgttctctctcatgttttttctccgtcacctattcttcacaccttttaaatttaagaagcatgtatgtatacatctgtgcgtgtgtgtatatgtatccttggcagcagtcctcattcctttggtgattactaaacatttgaggactggtaaactgtgaggaattgaaccttgctggctgaaaggtagaggaccagagtctgccttgttccccttatgccttcaggggcccggcagggtctcctgctcctggggctcatcctgcaagaggcggctggtatccaagcagcccaccccgatcgcctcctcagggaagagggcagggcagttaggaggcaatgcttctccatggtgctgggaatctctgtgatataaacccggtgggatggaggagattatttcaaataattgatatttacttgcattgaccatgaaaccaacccttcacgagcaccctctctggcccagggcagcactgcgcccctcgggtgggaaagccggtgtgggagagtccaaccctgcaggaaacggcttggagaagctcccgcctgggacactgaagaagtgagcgaggaggaatgatgcgtcagttcagttcaccaggagaaacgtggaaaggccagtgtagcgaggagagcgtcacacagttgtggagatgtcagcagacacagtgagggaccatggatgcggggctccagccaccagagtgcagggtagagaggagctgcacctagaaagccgtggcacacgcagcaccaggaggcctgggcatcacatccaccgacccgagtttcactctgcagggagcagaggggccttcacgtttttacattagaaaggagtcggagaacacgttggatttcagaatttgaatgaaggcagctaagagaggagatgcatgagggtgcagtgggatggggtgcacagaggcagttccagagttaatgcaagcaagcaaggaggaagtccgatccaggaaggaggtgctgggaatgcagaggaaacggcagactccggagatgcttggcggaaagcccagtggaatcagtgccctcccagtgcagtgtgaggacgggggacagcagtgtctcccccatttcaggttctgaagcctggcttgtgggccttgcaattcaccgagttaaggagcagagaaggaaaggggggttgtttctgttttttggagttttgctgggagcaaggttggaggaaatgaggtaagaagttcaacttgaagcctgctgagtttaaagtatctctagaccctctagacagaggcgtccaggagggaggtaggagccatccacctctgagcgttcactgaagccgtttggtgtgaatgaagtatcccacctcatgagtttggaggggaagagagcagcaaaactccaatgttgagcagaacaggaatcaggaaggggccagaggagtgaggggaaacgcaggcgggtccgtggccaccagaagagcccattccaggagggagggggcagctgtgctggggccacaagggtccccagggcggggaggggccctcacagctggggatagtggcattgcaggcccttgaagaagagtgtcaggccagaaaccagctcaccatggttcaaggtgtgaatgggggacaggaagtggctttggaatgtgtccaggttctttttgaatagagaaaaatttcctccatgaccatgcttcctgaaaagagaatgaacccacactctgggatgtgaggccaggagagttggcttcaccgtcggctggccgtccccaagtcctgccccttctcccgctcctgtctgatgtgagaggtgttgccactgcagtgtatccaaagttccagacatgcagagccgccctctggccatcgtcggggtcatggatcctttaggagtgaggaagcgggatgcgctggtgtggaaggcctttcatatggtcgggcgtggacacagagagaaagcgccaaacatccttgcggcattgctcctgcctggtggaacagcacattcacagtgagacaaacacaggtcataatgagagcagaagaccacaacagccacatgacacgcgtacacacacacgcacacatatatatacacacacacatgcacacacacatacacgcacacatatacacacatacacgcacatatacacatggacacgcgcacacgtttacacacatgcagatatacacatgcacacacacgtacacacgcacacatatatacacggacacatacacataacgcacatatacacacacatgcacacacgcacacatacacacacacatacacatggacacgcgcacacgtttacacacatgcagatatacacatgcacacacacgtacacacatgcacatatatacacacggacacatacacataacacacatatacacatgcacatgcacacacgcacacatgtacacacatgcacatatacacatgtacacacatacacgcacatatacacatgcacacatatacacacattcttgcacaaaaatctcacaagaacatcacgggtgaagctttctaggaataatcttactaatattacgaagctgaccacccaggctgtgacgggtaaatcgcaatatggatattccaaccgcaaagaaagcaagaatgtaccgtgatcagcgcagacccaccccgggtctctagtttccctctcccagtaatgctccttgttcctaatgaaccgcgtgcatctttggtgtctgcgctgctgccgctacacctttgtgaacaccaaatgcgcaggaagcgtatcgggagcagcacggctgcactcagttgttgccttctatttcgtggatgaaaactgctattgatttctcttttaacaagtgctgttgggaagaaccagtgttctggaggctgttttcgcccatgtcatgagaacagggcgccagctgagtcacttctctggaatggactttaatgtcacttggtttcctctcacccaggacccgggcttcatgtctggacaaatgagccatgcattatctttccaccagactaaagaaagatcagtttcttgtggtttgttgttctttttttaattgcggatgtgtgttcagcattcgcccaaataatcattccaaaccggggagtcttgggggagtgcaggatgtccagatagcaccagccctttgttaactggagagacgacagacaataaccccggcgtggtgaaacccggcccacacgtcccgcccgccccagagccaatgctagggccatcaggtggccctggtagccagtggttccaggaccagcatcagacactcggtgttactgtggacagtagctttgtacaagttcctagcgaggtgatttccaaaatattagatacctttaaagacagagatgaggaagactgaattgggatctggcttttactgtccgccatttaaccttcctcacaccaagcttcaaggcaacagggagcgtgagacatccgtgagcaagaagccaggctgctcagccactcgtgggccacgtcccctgtcccctcgcagggcttgcagttatcacactcaaagttagcccaggttgttctctaggcgttgttgccaagctcataattccacatgttcacggtcaaatgtatgtttagataccttaagttgctgctaacatcctgagggtagcttctggctgtaaacaaacataattctgatcactgtgagactcattctgttcttggacagccccttggggttcagtgacatggactccaagttcaccatctgatgtatgggcttctgccactggtgctgtcatctggcaccttcctaaaaccttcccattcgtacatgacccccagcacctgttctttttctcccgtagctttccttttcttcttggcgtcaaattcgaagccactttcatacccttttgttttcttcacgacaaaatatgttactgatgttactgttatatcagcttggtttgttcagaaatcaaaacagtgacatctttcttccatctggtggaaagatcatcagaacccagctaggtggtatcagtgaatatttccatttcccaaataaagaaactgaggctcagggaagggcagtgacttgcctgtggtcatagaactggcagagctgggattcaaccccggtagcacttcaaatctggtactcttccttcttgactgcacggggctccaaatcacgtgaatctgtgtttaactgatcagtgttaaatcacttcggtttgttcacaaaccaaatggccaccattctgcccttttctcctctcagctgccttcttctcgatgctcttaagccctcactcacggcctgtggggttactgcagggacttctaccaccgtctcccacgtcccatctcagctcctatctgtggtcagcacccaggcctccctacaggtcttctcagccacgacagccttctcccaaggaacctgggcctctgcgaagcggcctcctgattccccacaactcccctggaacacaaagctcgtcttctccaaggtccagctaaaccctgcttcagaatatgcttaaacagccaacctttttagcatgcagaactccacagctgtttagaaaatcttcctaatgcagcctgttttcaacaacgaatctgttcagagaaggtagagaaagcataggttatgtctaaatatttccctggagtgtgttactacttcagagtattagcctgcagctccaggggcctcctctgcataccttttgaccagcattgctaaaaagtaacagaaatggcttgtttgggtttcaccttctttttctacccatcactctttagcagggagggggattaatgagccgtgaaatggctacatttgagcagggtagggttaaagcagagaagccatgttcttaaatcacctctgcaggactgtggctggcttggttttgtacggatttccatgaaccccaggcatacattgtttatttttgtagacaatttgtccatctgcttttggcttaattatcgcttcaggaagatcagtggaaaagatgtattcagagtccaaggtcatgtctgttcctcaagggaagtctgtgtggatgacaatgccctatggaactcttttgaaaagccccatatgactcttctctttcatataccagccaaatggcccaaacctctctgtgcctcagtttcctcaccataaaatgggtacaatgacagtacctacctcgtagaggtttgtgaggactacataggctgactgttggaaagtgctccgaacagtgaacagtctagagtaaaaatgtcagctgctgttctagcttagtcccaaccaggggtcaaagctaataacctgaaacactctcttgtggaccctctgcaatgggctgggcctaacaggtccgccaatacacaaatttggaacactttcctttaagcaagtcaaagggaagggaattgtccaaccaatcagtgattgagtttgttccaccaccctgtagaaaggaaaatggaattcgatgtgctctttcgacatctttggaactctgcagtcaggactttccccatgggaggtgagctccccgtgacaaatgagggagctgccctctctcccactgagatgagtcattgtaacccaaaacaatctcaaaatctttgacatcactgccgcttgcaaatctgtgcctccagccaagggccggtggatgctactgcctgccacctcgtgttcaccaccagaactgcacgtcactccgaatctgctgacctcataccctggcatagaaacagtaaaaagaccaaacaaaaacgtgtcttttttggacccaaggttgaaatctgattttaaaacagagacattcagtaagcattaaacatcttccttttatagctttctcacagacctacattgacaaactcaccccttccctccataacctttacgcccctgagtcacagtagttgccctgaattgcttacgcaggtctggcttatcaccgacagttgtcctcaaaacacttggttcaaatgttaccagaactaaatttggaggagggagtcctggcattccagagcccttgcctcattttctagcgcgatcccagcagatggtctgatgtatctcatcagatgctgagcgcgggcctcactggcccagccctcctttccacaagtctggtggtctccttttttatgactccacttgagaggcctgggaaacattctccctgataatgcaggtgataaaaccagatcatctggtggaacgaacaatcagaaattccactgggcgggcacagggcttggagaagagttgagattgcggatgatgttttccggtagatgaaggtgactgaaggaattgaatggagggtggaggggactaaaggagagggtgaagtcctccacagcatgacccactgctgctcggcatcagaaattgggaagtcattataatggtcagaaacgtggtctaaaaatagaagattccatgtgggaagaacatgaatttcggagccaggcagagggggtaaatagcagtgccataacgcatgtgtttaacagacagcacatggagtgtgttctgtgtgtcaaatcctgcaagagatgccggggacagagtgtgaatgaggcatggtccctacctccaagggcctcgcggtctcacgtgaaatgtgggtacagagatgtagtatggcagtgccctgcagtgtgccatggggaagaagccccggccgcctcctccagttgtgaggaggggaagatgcccccagagagcccatgcttgagtcacatcctctagtgaccctgagagcctcaggcagcgagggctgcgtgtgccatggccctgaggttccagagaaactggcccaaccgctaggcactcagttagactggagagtgcagtgcactgtgccagcgtgggaaggggtgtgccagggcagtgggggacaaaaaaacgcaaaggctatggcggggtggctcgcagagcctgcagagctgacacagtggcttgggggcaaggcagacaggtctctcagaggcccccttacctttgcttcacaaatgagacatgagccagcagtgcttggcggtggtgagcagccgggactgtgatgtgggaccctcagcatgtgggaccctcagggcttggggaacggtattgctgcatgcagagcaccactgggtccaggtgctgtgggtgagaggctcatctctctgggctgccccctcacctgtctacgtgagaattagacacactccatggctcccaaacctgcctgtgaatcttaagtgcttgggggccttgctgaaaacatcaactcctgactgggcagtggctcatgcctgtaaccccagcactttgggaggctgaggcaggaggatgacttgagcccgggagtttgaggctgcagtgagctatgactgtgccactgcagtccagccgggcaacagcaaaaccctgactcaaaagatatgtattccatatatataaattccctgtccttttgtgggtcatcagcatgatgctggggcgttcacactcgtgtgagacatgcctctctcaaaccttgttaagatgtcagcacatgacccatctcacatgaaaaaattaaaaagaaaaaaacaaggaaaaagaaaaatacatatataaattcttcccaggctccttcccttgactcccaaactgctagaccagaaaattcacaaggtctgagactccccgttgttggtactttggcggccagcccaggccagtcctgggacagggaccacttcagaacgatcacccggaaccctgttaaaatccaggacaggagagggcccaagtgccctgcctgattgctaatgagcccccaggtgactctcacgctgccgacccccccgatctctctcagatgccccagatgctctctgaggtcccttccaagtccaacatcttatgaagcctttgggaaaataatcagttaccaatggcaaaaagcagagatgtaaatgtgaaaagtgatattatattggtctaatttcaaatggctatcactgtctataatctgtaagactcttgctagggaatgaggcttgtgtttgcgtattaagcaagacaaaggttgtttttgtatcataatgtatgagaaggaaatattcttttatccaaaataaaatgaatccatactctaggtaagaactttggagccgtgtttctctttagtttctgtatggtagaattttttttgttaattatctttttcccctgtctttctgtagcagcagcactctgggggaatctcagatgcattgtgctaagtgaaaggagccaggctcaagactccacactgcgtggttctatttctgtgagtgtctagaaaaggcaaactacatggagggagaaacatgagggttggaccgaggtttggagaagggagcatttgataacaaaggggcaacacccagaatgttgggtgatatggagctttgctgtctcttgctgatagtggtggttacacaactctgttatttgttgtgtctgttaatgacacaccaaataacacaccaaaaaaagtgaattttattgtatgtaaattaaaagataaaatttttttaaaggagtaagaaaatgaagtcaaaataaaattaacagttaactaggcagtagccaaaggaggagaaggacaatggtggttatcaagcattttgtaacaacagaaaaggtggagttctatttaaagcatgtcctattcaggaacatttcaaataaagataagaggggaaaaaagctgtgcatcacagccagttcaaaccccctccccatgcccactgccccacttttggctcgtaaccttttttcttacttggccaatgtggtgtgtgtttgtattatcgtagcggaaccaactcaatataatgctaacttaaagaatttttttttctctcatatatatagaccgcttttcagtctaaatgcaaaatagatataactcttggtcctgtccctgggctgtgccacagatcctgagcagtcaccctggaagacaggcggcctgcttgctcaactcaccgggagcccgcctttggaaggccacccacacgcctttcctctctgcttccacctggggcagactctgcagggctgttagctgcttactacctgcagaggccccatggggtaatgacagtcacatggcacaatgggaacacaccatctcagccatgagtcatgccatgctcttgggtgtgaagatgacctaagaataccaggaaaatattggcacgtgccattggcacatgaaaattagtaacctgcgcctgtgagtgaggtcgtaagtatagacaattagctcttttaattgccaatcatcgtgtgatcctggtagctcagtagttgccgcctatgctaattgtcactctctaaccgtgtaagtggaggccaccagcacagcatccgtaacctcttcatgacatccaggctgcatgagggtgatgctctgagcattgacacattgcatgtcagcagtgctaaattagaaagagcgtttcatacccattcgcggcctgacagccaaagctctctgcatgctgcctgcagctccagaatctgcttcctcctggccctttcctcaggtgcagtctgggctctcagggccctgaactcatccacaatcagactccaagtcttcttagaggacaagcaggcttaggaaatcacatcagtctattacacaatgattcacatttagacaaatgaaatgcatttattgctaaaagcacagaggtaataaaaggctttcccagaaaatcaacttttccaacacatgccaggcaaaatcatatccagaatataaaaagtttgggctaaaagccattgagcacaaccacccatgtgctgcctatttttagaataaggagcaggggttttcagacactgatactatgggtggggaagaggagatcatccactttttctctgctttaaaatgtacatctaccccagtcaaatcatttcagataaaactatataatagcatcttagaattataggtggtaccttctgggatttgaaaatttgtctatagagataaagcatgacagaaaccagtggcttcccagacttcgccttcactcctgaatctaattcggtcctgacccactttcagttctgctgccctgtgggctgtgtcccagacagttttcgaaatttctgtcagtatcaccatcagacagaccagattccatacaaggaaagctaggtcttggtttcttcagattatttccctggcagacttttcttttttttttttttgagacagagtctcactctgttgccaggctggagtgcagtggcacgatcttggctcactgcaagctccgcctcctgggttcacgccattcttctgcctcaacctcccgagtagctggggctacaggagcccaccaccacgcctggctcatttttgtatttttagtagaggcaaggtttcaccatgttggccagtgatccgcctgcctcagcctcccaaagtgctgggattacaggcatgagccatcccgcccagcccctggcagacatttttaaaaagcattcggctaagtgtttttttccaaatgtcactttaaaggtgtagactctccttccttttcgaactgttctctatcacataagctcatttgcaggaaaacctggaagggacataatctcggtcgccgggcaacatgcctgtgatgtcacagcttgtcttcttcatctttgcctttactcagctcctcttttgtttgtttgtttttaggtcaaggttattgaggcataattgacatgcaagtcattgaatattgacaaatgtatacagcgatagaaccaccagaatcatgctatggagaaggtccattaccccagaaactttccttgtgccctctcagttagtccctcccctccacctccagtcctggcagccactcatctgttttctgtctttagtttcgccttttctagaatgtcataaaaatagcatcagacagtaagtagcattttgtgtctggcttccttcacatagcagaatgcctttgagattcagcctcaactgctgcacacatcgggcattttgttcatttttattgccaaatagcaatcccaggagtgagctaatttaataaaaccaggatgaacattctcatacaggtctcggtgtggatataggccttcgtttctcttaggtatatacctaggagtgggattgttgggtcctgtgaactttagaagaaattgccaaactgtcttccaaagaggctgcacccttttgcgttcctgccggcagcccatggaattcgaggtgccatccttcccagctcttggcgtggccacctttttctgtgtatgttcaccatttgagtccatcacagttatatctctctgtggatttaatttgcttttccctaatgaccactgaagtttagcatcttttcatgtgtacaacttatttggtgcagtgtctgctcaaatcttttgccaaattttgcagttggattgttcatatctttagtattgagttttgagagttctttatatgttccggaagaagttgtttatcagatatgtgttttgcaaatatgtctcccagtctgtcccctgcctttttatttttaactgtatcttttgacaatcaaactttttaaatctagctaactttttcttttataggttgtaatctttgtgtcttatctaagaaagctttgcctaatccaaagtcacaaagattttcccctgtgttttcttctagaagcgatacagctttagctcttacatttaggtccatttggagtaaatgtctgtatatcaagtgacataaaggtgaaggtgtgtttctttacatgtggatgttacttactttgtattgacattagtgctacagtctgcatcacataattttggagggcagaaattccaagggtccatatagttctacctcatataactgaaattcttaataaagaatagtacccaggggtgggacaaatgttttatatactaaataaggagacagagatagaaagtgtccaacttaacctcagctctgtgttgcatggaataggctgctgatagttatctgtgtaatatactgtacaaatactagcctttacattattgttaccttggaacatgctactaatttcatcttgccagggtagtctaaaaattgctcagaaatgctaactgaccatcctcaaaatcaacgaatatttctaaattttggccggtggaattatttttctagagcctaaaaagtagtcctttccaccttttgggacattttacgtatttgaaatgtgtggcaaagagctcacagaaattaactaggtcttaggttggaatccccggaggatcaccaggaattgcagccttggacaggccttgaaggtctggaacacactgcggaagggagggagggtccgccctggggaatggagaggatatgggcgtctgctgggcgccagtgcccataaaaggtgagacaggaagagtccgcttaggaaggagaagggatttcctactattcagatttcggctggtaagtcatgaaaagctcattcttattctaccagtaaaatactgtactgtagattaaaaatcctgatgtgtagtgaagccagttttatcctgggcaacactgtttttatccttctctgataaatgaaactctttctactcccttacccagggaatattttaaggttaatgaacaatgaatggaaaccacagggttgtgtgatgtggggccctgatgcgtcatccatctgtccacctttgtttaagtctgaagctgtagggctacactgcgtgtgcccgtatctgatcatcttttgcctcttttctcagaagtgaaattccccaattgatgaatgcgggagtgtcgggaccctgagcgcattctctccacggtcgtggtatttgagtaatgtgggttcaagtctggatttgttgccttttcagactgcagcttccaaaaccagcccggatggcccatgtgcgcaccagccatgacttcagagagggaaaacaatgggcagcccccgcgccccgtcctcacgatagtcaaaatggagtctgtcttgtagatatcactgaagtataaggccaagactgattgaattagagataatatttaacccacataaatactcttatgttcctctgcatgacccagtaagccagacctttctactgagccccaactccatgcttaagaggtttttcttattgaaagtcacctatctcttccctcaggaatgccaggatgggggttatggtggtctcgtgcattggttctcaaactgttatgtaccaaggagtatcctggggatcagttcaaatgcagattcaggagttctggggccaggcctgagactctgcatttatagcaagcccccaggtgacgccgacacagacctcccttggagcagtaagggcctggtggagtcagccagctccccagatctgagtgcaccccggccagccctgacactggtcccatctgagcccctgtcctctctcctctccactggagttcgtgtcactacatgcagttgccgtggggacaaaatgagagaaaccatatttaaaacttgtaacaacgcatcatctcaaaagatagaagcagttcaacgatactgttcattatcctgtttcttaggaaatagtacctctacatggtctggtggtgggagcagggcggggggcaggggacatgacattaccactcctgtccacagcgtctcctggcttctgagtactttgtggaaatatttttctcaaggatgttggaggaatattaggagctttagaaatttaggagcttttgagatttatgcaaagacatttaaactagactcttttcactttctgggagtaatttttatttttaatgtcacttatcacaaaaggaaagaaagagatgaaaataacttttcctgtcgggactttttgactgaggatggaagttgataaggacgatgattagcacagaggaaaacccttggcatgtacctggtcctcccagctgctctttatagatgcaccacacttccttagtgggcaggaaatcctggggagaagctccatcctgatgaccaaagcgtggcctcctcgggccatgctgtaaatgtccatttaatcccagcaaggcaggctttacattgtgcacagcggagagggatccatctgggaggactaaggtctaactcacattctgcccaggctcttcctggccctctctcagcggggaagctggatggaattctgtgaaatgttccatctcatcagaagctcaggatggactgtttagaagtgatgccatcttgacacttactagaatggctatagcccaaaaaatggaaaatcacaggtattggtgaggatacagaggaattggaacctttgtgcattgctggtgggaatgtaaaagggtgcagtcagtgtggaaaaagaaatttagcaatacctcaaatatgtgatactcgtgcacacatatttacagcagcactatttagcaattccactcctaggaacacacccaaaagaattcagaacagagactcaagtagtcactcacacacacatattcacagcagcgctatccacagtagccaaaaggtagagacaccccagatgtccacgaacaaatgaatgaacccattgtggtctatccgtacagtggaatattattcagccatcagtgaatgaggtaatgaaccccaaaaacatgatcactaaaagaagccagacacaaaaagtcacacatcgtatgactgattctatttattggtaaatccgtagagacagaaagcagagtgatggttgccaggggctgggaggaaagggaatggggagtgattgattaatgggtttggggcttccttttggggtgaggaaaatgtttgggaactagatagaggtggtggtcacacaacatggtgaatgcactgaaaggcaccgagttgtatcctttaaaatggttagctttatgctatgtgaatttcacttcagtaaaaagaaaagtttacagcatactccaggaaaggaaagactagagtttttcattccaaagtcagactccctaaccaagaaataaagatgagaaaggggtttactgacagtgaaaggaaaatgagttcatgatgtggttagccactttcccccatcaaagggaattgaggaagggttgacgaatgcagataagaatgtggttttcatcaataagacgtgcatatttccattttggttagtagcagatgttccctttgagttgactgtatgaaataatccccctggtcactgctgcttgtttggttggctaaaaaataataataatcccactggatagatatgtagtttatgggcaataaagcgacagtcctgataagaaacattttatcccccagaagacagccggcagacactaacaaaccgcaggcctcaacatagtgaggggagcgtagagcttcgtggcatggtatgtaatcttaagaaggttatagtctagcatagccacaaactaaacaaaattgagcaccactgggaaggatccacaaaagtcggaatcaaaacatagtttgttcccaaacttaacaacaaatgtcgtgtaggaaaccactaagcattggagatagaatgagtctgggatatcgtgcgtccagggccagggccacccatcttccatgagtctcctcgcctaggtagaaacacagtggcaatagcttctattgtagaatgttctccaaagacactaaagtgcacaagcttcaccacgacttaggaggcctgaaattaggctgcccgaggtgagtactgatgtggcattgacaggacccctctgggacacgtggagggcagaggagaacccactgtctctaaaactctgacttcggtccagaccaggttaccctgagggagatttcccagctccccttggtttgaggggacaggggtcccaagattcgggatacatcatcttccatccacagccttaatctgcatggatagcttccaccccaaaaaatcatcttaactacttcccgtgatgcctggggcctaacatctcaaggaattgccagttaggaacagtaatgaatttggaggtgagatcttcccacacccctccatgctactgcctcaatgacattaacactgtaccctgggctgcgtttttaaattcccatttcacttcaactgtgtggattgctgagaatggcattatgaacattctgtgaagacagacacgtctcagctgaacagtttacctaggaagttacctagaggcaacagaagaaaagcctagaaaaatggctcaagttcccccctcaatctcagggcaagacaggaatttgacatttcacagcaaatggggcttggcaagtaaaggtgccgtgtgatgaatcaacagcagactcattcgtctcaagaggaaattaggacatacgtttttttaagtttgggctagcctgtgaaatgttaaaatataactataatacaatagttagttccagccataggagagatagaacttcccctcccctcctttctcatttttaaaacatttttattgtggtaaatttatttttaatttttttaatgtaacattttaaaatttttcttgtattagaaatatgcatatgtcctcgcttatgagtgggagctgaacaatgtgaacacatggacacagggagggaaacaacacacccggggcctgtgggtgggtcggggggagggagagcatcaggacaaatagcaaatacgtgctgggcttaacacctaggtgatgggttgatactttattgtattaagttccagggtactaataaaataaaataaatgcataacatcgaaattaccttttgagtcatattggcgtgtctgattcagtggcattaagttctttcacgttgttgtgcaaccttcaccaccaatccatctccagaactttctcatcttcccaaaccgaagctctgtccccatgaaaacactgcctccccctgtccctctctgcccggcccctggcagccctcattctactgtctgtctccatggatttgagcgtgctagggactgcatataaggggcctctatacaggagttgtcgttttgtgactggctcatttcactcagcacagagtcctcaaggttcttccgtgtcacagcctaggtgactgcttccttcctctttaaaggctgagtcctattccattgtgtgggtgtctacccattgttggacacttgagtggtttccaccttttggctgttgtgaatcacgctgctgtgcgtgtaagtgtaccaaagctagcccctgctttctgtatgcccagaagtggaatcgtgggatcccgtagtgattctctttttttaatgtgttaaggagccgccagagtgttttccaaagcacctgcaccatttcacatgcccaccagcagcgcacggagattctgatttctccacatcctcaccaatacttataactttttttaataacagccatcctatttagtgtggacaaacatttttatatgtttcagaagctcttttttttccctctatgtgaacaaaaggagagattaaccacttaaacatctgagggtctttttgatatttgaatgcaatacacatttccacagttactggatgcattatattgaggaaaatagagataaaattgtagaaattcatttggaaaattttttatactgaaatgaccttaaaaagaacccaaataagttaattctttcatcccaacccagtattatcatttcacaatgacatgactttagtaatttaggataatttttttctcacattccatattttctcttcttaaactctatgacttcttttgttagctatcatggcagtagatgatagtttacatataatgttccctgtagattatagctctttaaaaacaaaaaaaaaaatgtagttttgaaagtaaccgtaactgatcatgagtatgtattgtgattaatcgtggaaattgaacctttgttgttcccacagggtcagcctgggccagtgggcccccaggggtacaatgggccaccaggattacaaggattcccgggactgcagggacgtaaaggagacaagggtgaaaggggagcccccggagtaacgggacccaagggcgacgtggtacgcaccgctggtgtattcccctggcctcatgagggtggcgggtatctcagccttggttaattgcatttgctttcttcatagggagcaagaggcgtttctggattccctggtgccgatggaattcctgtaagttttatggaagactggaattttaaaacattgcgtgcatcctaggcaatacattttgtgacttaaagaaacattttgaatgagacctccttttttgtttatgacataaaacacgtggggactatacgtgcgtattctccccgcggaattcagtcagacagtgaacaaattgtttgctttgtaaacgtccttatagacttggcttcagaattgagacgattttgctaaactgcacattgtttggtaataaaaagctagagtgctgtccagatactcgccctaaagagccagtcttgtgatctcgttcgaactatagagcaacctgcatataaagtcgttcagccaagagcatgggcagaatgaagccctgctgagcatttgtgcagcttctcaagttctttacagcaacctcacataaaacgaaaaacaaaaggcatggtttgttcatgagaaaaatctcaaaatgcaataaaatgtgtttttataacctagtttactttacttctcgtggcataaaaaaataaacaaaacagcctgactcacagccttcttcacagggacccacgagcagatttcccagggttggcttcctggccagacctgacctcagggatcaatgtgtttatcgcacgttctgacccacctcccatccggctactgctgtggttctgagacatctgcttcacaaacctcacacatatacacagatgtgtgtgcccgtgtcctgcagaggcaggttctgtatcaccacacacgcacacgcacagggagagagactccattcccaggctgcacgagtagggccatgccttgcagaagagaaggagggaatgagtgagtggagggcagtgccagagaactcatgcgtttccatgagatctttagtcccaccgtcgaggagacatccgcagagcagaaggagacagtcagggcaaaataaaggaagtcacatttgccaagacaagagctgcaagccagtgatctcggggctacctgaatggtaggctcaaacaggcacttgggtttaccacatggccctgaacaaataaggaaataatgttcacatcagtcagaatcttgagaaatggacagaaatgaagaatctgcacaacccaaagattaaacaaattaggaaagtattttcatactaatggcctgaatctaaatcacccatttttaaactactcttttgaactctttggagtgtctttcagttttgtctccagctgaaatctgagttaaaatggaatgacattatggaaagcaattgcaactcatctgtaccaagtttccttcatgtttccactttacactcacttaatatcagaggcagatgtctcacaaactagggaagaagtaatcataatttggaggaatgattgtggtgagcaggtgaagaccattttctactgaacctgctgctcaaaggatccagtctcttaaccgcagaactctgatactacaaattaagttaacataaatatcacctgccataagtaatcagttaacaaatgtagagtttgaaggacctggatcattttagctgattagaagttatatataagaagcgatatgcagtaaaatcttagaggagtggtctcatatagcagtgaatctaatttgatgctgagcagagacagacatttagctcaatataactgaaatttttctttgaagcacaatttcagactcagattagattgacatgcaatttcaaatagatcagttctaagcaagtaagaaagaccaacggcagacaaataatagagaaaaatttaaacattacagttcattttaagcaaaagcatcacagaatactaaaaatctggagcagaacatgtggagagctgttttctcaagctgaagtgcaagggccccttatgtctttatttgaaaggccactagagtgccagctctgcaaacagatcgagaagctgccaacaaacagggattcctctggctcaccagagagtttgactgagcctgttggatctctcatctgacggcaccagttcaaccaatggctgtggacatctgaagcaaagaaatgtgcaaataaaagttctacttttttattttatttcttaatatcattcaggttacggagaactatatgtaggatttgttgtgtgggggttttgaggtttgtttgttttgtgttgttttgttttgagacagagtcttgttcgcccaggctggagtgcagtggtgcgatcttagctcactgcaacctctgccacctgtgctcaagcaattctcatggcttatcctcccgagtagctgggattacaggtgcctgccaccatgtctggctaatttttgtatttttagtagagacagggtttcaccatgttggccaggctggtctcgaactcctggcctcaagtgatccacctgcctcagcctcccaaagtgctgggattacaggtatgagccactgcgcccagccaagtttgtttctttatcttgaaattttccaaatttctcaaagtaactgtaaaagacatcccaatgctctcaaaaatcactctggaatatatgtttggtttattatcaagaaaactaaagtttaaaagtaactacacaataacaaagcatatagctaaatatctattgtttaaagaaacagcaaaacaggctgtggccaggtactgcataaattatagattattaacccagcccctgtgtgtctcctggaaccagcttaatgcagtgaagatgcccacaaatttagcctgagtccctctagtcattgcagacacttggctgtgttgcctttccccacccccagacatttcagaaaacctgacttgctttatattcatgtttaaaatctaaaaggtcatgtttcctaagaaagcaaacaagaggcaatcagctcttctaaacatgacaaggccattgataaaatcacgttgcgggtgtgtcttctctgtttaggatgtggatctgtgaaactcactatctaaaatgcagttgggtacaactgataaggacctccctgttttccctgagaaggaggtagctgcttctaaaatctttcctagaatttttaaaatgtacctttacttgttttctacagggataaggaccttcctgttatccctgagaaggaggtagctgcttctaaaatctttcctagaatttttgaaatgtaattttacttgtccctgctgatagacagtcactcaactagtaagacagaagaaaccccgacagtgtacttcttacccaagcccaggtgaagcagaactttgcttcgaaatcttttccctgcttagaacgataccttatgccttcacttatttaatctttcattcattcatttgttcacttttgaggtgtcttttccttggattcatgccgggaacatggcttatgagaatataagactgttttatctcacagttacatgacaactagaagcctgctggttggctgattctctcactgctctctttcccagggacacccggggcaaggtgggcccaggggaaggccgggctacgatggctgcaacggaacccagggagactcaggtccacaggggccccccggctctgaggggttcaccgggcctcccgtgagtatccccacagcgcctgtgctccagggacgggcagacccctgctaagccctgcctttataacctgggggagcctcccgctcactgtggccagaacggaagcataactgtatgttgacgcccaagacatgacgtttctggattcaagtaacttcatttttcgtattctttaaatgttagatagaaaatcattgttgtggttgatgttgttcactctcagtctcccaagtgtcacttcattttctcccaaattctcatgcgtaatagtggaatcgtaaacgcaaattaaaaagctgaaaccttgacaaaattctgtccatcaccatctttatcagattatgaaatactttgtgacgtgggagtgcagttattctccagcagatacgatgcaggagtttgttttttaatggaggaacttttatataatcatctgttttgtggcctcatttattttttaaggtcttggtaaaacatcctgaaatgtgtcttcagtagtacgttgctaccttatttccaaggaaatcttgcaaattcaggtttagactaaaattttgtttggtgagactttttatttaaaaacaaaaactttaaagtggggagggaagaacagtcattaatcaccttcatcacgttttcacctgaagcaaatggagttctcctactcagttccacctccacctgctagttcacctttcctcggctgtttctgttttatgtggttcaatttttcaataaactacgtcatcttctactctatatatcatcaatttcattatcaagaaacatatctattactttaagtgattcttatagtagatgttgaaagatatttacacatgcacatatgtattatgtatatgcctactgtttatatttgacacaattccaattttaaagaatgacccagtatctattctgcaaatgggtgcttgtgttaatatgttcagtacactaatgccaaagaaagcacgtaatagtattatcagaaataaaaataacattggcatactagagggttggttgacagagcattcatttgggttttgaaaataatttaaatcctaaagtatttctgttttaactctaggaaagatatgattgggtcaataggaaattaaaggtcttacccttgttgctgaatatagggttggtgttcagaataacccccatcagccataagaacaattagaccttgcccacaaaagtcaatgttcagtcatccacattaccatagctgcaccgaatgttaatggactctttttgttgttttttctttttacaatatatctgctaattaggggccccaaggaccaaaagggcagaaaggtgagccttatgcactgcctaaagaggagcgcgacagatatcgggtacgtttgcaagagatgggaggggtaatgaagggacccagtgtaaattctcaactaacaaagttaattgccaagtgaactttgcatgtaagaatgaatgtactgaaggcatgcctagaatggcggcataatctaaaagtcatcttacttccgatcaggatgttttcaatcttatttttaattgtgtgtttatctctttcccatattcacaatactccaagccaaattagtacttgtagttaatattagtaaatattaatattactaaaatatattctgactaaataacaatattagtaaaaattaatattagtaaattaacattactaggtcctgatagggctgatctgtttgatatgcttatttccaactctgcaataaaaggtaagtaaatctaaagatggttaaaagctatcactcttaaaattatttcttctccattagggtgaacctggagagcctggattggtcggtttccaggtaagtttatttttattggacgatattccaaacaaaagtttaagagcttcagaactccaagtaccagtttacctctcttaaaaacattctcccgctgcctatccatagggacctcccggccgccctgggcatgtgggacagatgggtccagttggagctccagggagaccagtaagtacctggacacaggtgcccactctgggaccatcgtccggtcatcccttccagatgccacttcttcaatggttgactccagatgagagctttaagaacaactatgatgcttataggcgtagcagagaacatcaagacaaaacggaccattccttgcacactttgctgctgttaaggttgaagaataagggcttaaaattatggtcaccagctctctgccagttatgtcaaattttgacttggttccggcagggtgcccttccatccccaccccatacctacccagtgacagacagcccatcatccctgggcaaggcaaaccaaagtcccacaggttcataaggaggaaatggaggtctgcctgtgccacacccatgctagcaggcatatcacacctgggctcattacagcaggtgagatactggccactgtttaacacaatggccctagagggctcattgcaagtagggaagagcagaaaaaggcacttgctgaggcttgtgtagctctctggccactcccaccactgcacaatgagctggaaggtggattggccactgcgagagctcctgactcgctcattccccacatatgttagtaatcagataaataggccttaacttacacaaggagcgatttgggctgcaggtgagagagatcttctcacaggaagccattgctcaagactgagacaagctatcaagggacactaacaccagttccttgacagatactgagaaaaaaatgaagtcatatatgtctggggagactcagtcaaactaacagttggggggtactcataattctcttcagattataataaatgacaataataataatagattttgtttctacaaagcaaatttccccggtgctgtgaaagtcattcttgcaagtagccccgtctgtgaaagacctggtcaaggtggctgaaatcagggtcatacgaggcgctgttgctgtttcactccatagggttattggcttagtcacggcacacatgccacatggttggatttcatactttaaatgcaccactcggagaagtccggcacaacagattgtacttgctaggtcctcagctgctctgacagcttttggttcttcacatgagccatgcaatcatccacaaccccctccctatccactcctttgtatccacttatttgtacttaaacactcttcccctgcatctgaaatgctttaatcctaagcacagtgttgacactgaatgctctgcagaaagacacaccatgatactgcagatggactttccgctctgcagtgccagcttgtagattcattctgtccatgaaagttggccaagctaccaggaagaagtcctgcatggagtctcgtggggactcccagaggaagtcagggaagctgtcgctgcagtcacagggcctgggaccttgcaaagggatcagaacaaacacagagaggacatgggtgaagtcaaaagcccaaacacacaaaagcaaagcagaaacagctgtccgtagacagccggcagattctgagaactggagctgacccgagtccctctcccccagcatgtcatctctgccaagccaaatgcatcagaaacctccatgcatcctacactgtgtcctaaatatacagtcaatggctttcccagagctttccaccagatgttatctgggtcctggggtaaagaaaaccatttacacatttctttgtatttgtacagggaccacctggaccccctggaccaaaaggacagcaagtaagttggttttggggggtgaggatgagggaagggggtacttaggtgtttgtgggtttgtttgttttttaccataaaacttcttggttggcaactatttattgtttatattatgatgaaaacagttttggaggtttttaagacttaatgttaaactccaaggatagatccatggtgcctctggacattaaaaaagtaaacaggtggaatgatttgttgtttgcaaattaattaccacatgcctgttggtatatgaaaaccacactgaggaacatttgattgaaacgaagattagaacaatttagggacagttcacatttattcacatgcattgatttacgagaatggacaaaatgtaactctatctgttgtagggaggccaatgtcattcttcttatctggctagaattaggttctacaggagtctaatgtcagcctctagggatatattcagtgataatcaagttaggctagagcccaaagctgtatactgttttcatcccagaaaggttattaagttgattggaacacagcaaagtaggtggtttgttagaaactcggaggacagaactagggttccttattatctgagaaagctggataaatgtccaagacaaacgaatgcagttgacaagggaagtatttgatcaaaatgcaacataattcagaaatgctgggctgccagcgggaagcatctaggaacgtttcctttgccctgtgtcccgatggaggacgtgccaagcccacacgttgccatgcctgcccattgctgtgacccctggtgactacagctgccaccgcccatgcccccaggctcctgtcccctctgacacagcttccggttggctggagggcttgcgctggacgccccaccgcctggcagcctggagcaggatgagatgggccccaggccaagagcagcagaaataggaccaggcggccgggctgaggaggcagcagccaagccctgagcccaggcgtgagcctcagatctccccttgctgcggcaaacatcaacagccctcctcacccctgaccaagtcacttcctggtgactttgacgaccagctcaggaggcagagagggactgtgggggactcacacaaattgcattctaatccagcctggccgcgtttctgtgctttgatttcagctccccaccaggtggggaagaagcaaaaggcaaaaattcattgaaggctttgtttttattttcagaaaatatctggacattggagggggcggacggtagactgcagagaaagagagatcagatagggcttatgtgaccccgctgtcactgtgggaacacacagaaaccctgggaaagaagcaaagctgttgggagtagaagaggacagtgcccgtgatgtgcacaaatttgtcatcttgctttttctatgcacgaatcttagaggtcagcgttgtcagtcctcccacacgtggctactacgttcgtgaaattattaaatccttactatgatactgggcctagctttgcttcttaggtaaaaaaggaagacaaaaagtttggataaagcccagagaatcacgtaaaatcattacattctgattgattttaaatttccaaagattattaaaaagataggtaaagtttatatgaaatgaggattattttgccaaaatgagagaagactgagccagaagaaaagacgaatcatgatcttcaaatgcagagtccagggagtgaaatggggctgcttcttccatctgcaggggccagaacccagggacatgctcttagactacagtctgcagagaccatatactcacgatcgagggccagcaccacctggggtccaatctcagctcccactcattcactctgaggccttggtcaactgacatgacaaactgtcaattagtttctacaatgcaaagcaagaatattatgcaaatatagttgctcagtaaagttgccgataaataggccttgggtttctttttctaagaaaaataattttatttctctctgattattggctttttaaaacttacagaaattatttatcttttcagggcaacagaggacttggtttctacggagttaagggtgaaaaggtaaaggaagcctggtcaattccagcagaggcatgcagcatttctcagccaggaaataaatcattttaattactaagttctgtgctgtaaaacttttaccttgagttgatctgcagacagaccatttgcatagggaaataatcattgcaaagtgctaggttgtcacctacataccagtgataattctgcatcaacaagacggtaaacatagaccatctaggctagccgagactctgacacagagacataagctcagctcatcttcagaaggtggaggtgaggacatgtcactgagtgcatcttctcctgtgtggagcccagaggtgatggaggggactgagactacagccagaggctgacatggagccatctcagggaccaggggatctcagggaccagccctggtagggcacaaaggcagccgtaaggaccatgtggcttttctccttccttagagtgctaagatccaaagacctcatggcctttgagaggaacgtgtgagatcacgtgcatgacaggcttaacgcagcgccacaccccgcaagcaaaacctcaccaacacagtcccattgcgttcaccacaaaagccatgagcccactgtaaagtagacctgacccttggcctcatgattggaacatttctattttgttttcccttctgctttttgatggaacagcacagtaagttgaatcaagtcctgctcatgtgtgaagaagaaactcttccttctttacattaatgccatagaagaagtcaaaaaaggacaattagcaagcagtgggcttctgggaaaaaaaagaaagaaaaacattgaagatccaaacacataaaaatttatagccccatacaatgaaatataacaaaataataaaaacaagaaaaatctgggaagaaatcattggtgggagaagagaatagtcccgttagatataatggagatgaagttagagtctacagtctacaaaggacttatgcaaataatgaataaaaaacatcaggggcccaacaggtacaagggaggagaacaaacagtttgggtattttaagatattctattagtggacactcagcgtacactatggagtatcactttctgcagctgacccatcatctccatttactgctgtccgtgttatgtgatatctgggctcagacttgtatgatacagtttaatgtggaaagaaaggaaaagacaatgatgttcttttgtgtcaatcagtttctgggaggtaaacccagaatattatgcaaggataacggtccagtaatgttctagatagatcggtttcaccatctgtgcaccacatcaaaaagtgttttctgctaatgataaaaatgcaaattaaagcaatcttgggatattatagttacttaagattttttttattatataaaaacatctttagctggggaagtagtctttcatttcttcagcatttcgtttatctcggtgcccatcttggcaaccagtagagtaatacctgtcaaaaaccataaagacattcagccctcatacctaataattcccatatatagaaattcattgtaaggaaacaaccccacagaaacaaatgcagtccagaattgtaaacaacctacatggcttttatgcataaattctaaatgattgctaatgaaaggaggatataaaaaacttacattaggattactctattttgtggttattatactgtaaataggtatacatatggtaagtaatatgcaaacattaaaactgcagtattttggccaggttgtatttgtattcgagttttgtagtttcctttcgatttaaagacaactgcttttgcttaacaatatgcagggtgacgtagggcagccgggacccaacgggattccatcagacaccctccaccccatcatcgcgcccacaggagtcaccttccacccagatcagtacaaggtaaagagcaaaattgactcttttcatagttgaaataaaaaaaggagagtaaaagtacatttcttcaattgtattcaaccacattccaagtagaaaaagcctcaccaccaacttggcacattacccatgaaaacataaccgggtcctcccagaatgttttcaactcttccagacggttactagattcacagtgcgatcccgtcgtcagtccatcatctcaattctgatgaatctgaagcaacaagagaattcatttaaaaaaaaacttatatctatccttacattcagtgtaggtggaggctaatggtcataccgtaattcaaagccagaatcatggaactgtctagcaaaatgtgttcagcaaaataaaacctacttctttgctgacatgaagcacctttttggaggttcaaagtcagtttttgacagtttctgaatcattcaattaacattttgcttaattgaaatcatgctcttagtctgaaataggaattgccgcgtccactctctctacgtttggaggctgctgtgccacccacccactcggaggtcccacagcctttctagggcttcctgttccccctgtcaaatggggatggcgacactgacctcctggagctgacgaggaggttgcaggcgactgtgaaacactcagtaccatgtcgggcacgcagaatatctgggaactaaaatagaaaccccaaacggggagatcttaactttccaaatagaatctggttcccaactcttgagcagggtggggcttgggtcctgtgtcctgggtcctgcatcctggggcggatttggcaggcaggaccactgccttgtgggggaaatcaacccaggtggctgaggctcgagttatgagtgaccgttgacaaaaatgtcctgggagacggcagggagggcctctgtccagcttctggactggagcccagagcaggtttgatccacgtggaggtgctcaatcttccgagtcaagtttcccaccttttctacaacccaggccagggtgggatccggggctgggaatggccaacccgcaggggcagttgtgtcctgcaggaatccaaggtaccctcagaaatgacggggacaaaggacccgccaattgctgtttctttcaccattttagacgaagagaaatgggaaaaacgtagatcatgtttttgatctatgatattgacatggctttcaacagccacttttgcttcaagtttcaatatgttccatgtgtatctttttctcagagggcctcctagtaatgttttcttccgaagagtattttcattaaggcttttccttgggcacgttctcccaccatacggatgtaaacatctgcctggaacggtgtgggggataaaggaaaacagagagaaggaaagacagactttcacttgtaccaagaggaatacaggaattaatttatcttgtgaaaatctagaagaaatgacacctcttttctcttgaattttgaagctgcaaaatttaagagtcatgtgttgtaatcaatttatgatgattgtgtgaggattgattcagtactttcagctcatgtcatgaaccctgattgatttttacccattaccatcctcaaattaataagcgtttcttatttttcatattcttcacagggtgaaaaaggcagtgagggggaaccaggaataagagtaagtcgagtaatgagcatgccccctcccctgtggctcctgggctgtcggcgctctgccaggcatgacggggtgcaccatgcgctcggggcccgcacaccgccagtctctcatccccttgtccatagcagaacagtattagcatgcatttttacactgtattttaagaagtcagttctagaatttcttcctcttggcatcataaacactggctaatcatcttctgaggtttgggaagggagcatggagatggcggaggggcgtggcttccactcaggcgccaccgggttctgccctccgtcccctctgtcactgcctgtcctcagagctccagctctccctcgcggtcgcttaccacgtgacatgacacatgcagtcctggatgggtgacagcccgggaaggctggcgggtctcctaggaccgtgccctgcactgcgcctgagttgagcatcgccaggcggtctggacaccatcggggctgagaacacagagtcctggagcagaggatgacacgtgggccctgttggctggaggggccgcccctgggttgctccttacgccccctctgctctctcctagggcatttccttgaagggagaagaaggaatcatgggctttcctggactgagggtaaaccacgccttttataactgcagttgtcggtttggtttggtttttttcagtaggctttcctttttagagctgtttcagattcacagcaaaatttagcagaaagtatagagatttcccgttattactccccacccccccccacacacacacacagcagccccccagcacgaacatctagcactgggggctgcgctggctacaatccgtgaaccatcttgacacaccgtcttcacccagcagcaggtgtgcagacgcggccctccccgtggaggaggcgcgagtaccgcacaaaacctttctggttgtgtgtgttcagctcagttagtctgtagtaaccagaaatgtagaatatctcaaacacacattgatttccgactgtcccaagagcccaacaaaaatgtccctagtcgtaagggtcgggaaggggtcaccgtccacggtgattcagccacctgggagacagacctcaccttcagagccccagcctggactgaccccactcactccacgaccacacctagctgagggctgggacgggtggtcagagccctgggcccaggaagagaaagcagaattttggtggctatctggcagttgctaccactcaaaagaccgtattttacattctccaaaaataagaatagagagacacagtagaacattagagtacaagcctttttacatttttagtttttcattgtactatctttgtgagtttctctgtatttctttacgtggtagaaatgatgcacgttatgaaagtattgctaaaatgatgtgtctccctcaggaaatgagagtcttggggtggctctgacgtcttccacagggaagcagctttgagattaggatggattctgctttcttcgagcctttttatcatagtcattatttcccatccccacctccccacaactttgtaaaggggaaagaattgtattaatagttggtattgaatttggcaatttgttgctattcttcaaaatctggacctgagacttgttcaatctgtccatcggcattttgctgtgatcacagccaggtgccgtagtcaagccctctggaaatgtctactgcatattctgagctgtttgcttctgttttttgttcattccagggttaccctggcttgagtggtgaaaaaggatcaccaggacagaaggtaagttggatgcatgaactgcagtctgctctgggcccacgacatcccacagaggttaaataaataggccttggcatctcaggaaagaaaattgtctccagaaaaaaacattgaaaatggttcttgtatttgcagtcacaaagataatcctgcctcacaatacttgaaccgggtcattaccttggctctcatttttgcaaactatcttttgcttcctccctttcaaagtgtccgtcactcgaccccaccagccatggtttctatatcgtccaacctcacacccctcctccatgtccttgtcactcataggaagctcctggacttggtgacccagggtccacctaaatttttttatagattgacccatactgtgacacttcatttatgtttaatgacaacccaattatttttatcatgagttctgtggacagatttttggcttttttttaggagaaaaatgttatgtaagaaatgtattatgggccaggtgcagtggctcatgcctgtaatcccaggactttgggaggcctgaggagggtggatcacctgaggtcaggagtatgaggccagcctgaccaacatggtgaaaccctgtctctactaaaaatacaaaatttgccaggcatggtgtgggtacctgtaatcccagctactcaggaggctgaggcaggagaatcacttgaacctgggaggcagaggctacagtgagccgagatcgcgccattgcactccagcctgggcaacaagagtgaaactccatcataaaataataataataatgataaaatttttaaaaagaaatgtattatgaatctaggtcagatttagaaccgtctgaactctaggtcatacacaatgttatagttcagtggttgatgccttttcactgttcactgtgcctgcgggtcccaccccacagcacacagcacacgcctcctacggcaggcccggcaggctccccagacaccaccactgacagccccttgggtctcacatcacactcatgccaacatacacacaaagacgtgtagcttcacatgcatgtaacggagcaacaaaagaaatgtgtctgtgctgctctgcccagtgccccttagagaatgttccaagtcggcaggtacacatctgcctcgttctttaaagctgcagagaatggcagtcaataggtgcgccatatttccttacgccctcgaggtggttttcatatttccagcaaacatgcagtcacctcggtggtacacagggcttggctgcctgcccatgggctagtatgtccatcactcagtcctagtaggtgcacagagatagagttttatcaaaatcactagcctcagaatcacaactccgttgaatcctgctcagggctgcacagagagtagtgtggcgtctggaggcccatgggcttcagttagctggtacagaagctcggcaggcctggtgggggttccgccatgcttgttccaggaccacagatggacctgcctcccagactcgctttctgacctccactggctctagacacgggccgtcttgacccagcattctgcttttgaccattcaaacttaacaccaatcttgatgacttcctgcaacctccaatgatcatactgttcccatttctgttattttatgctaaactcagcccagggagccaatgccaggctttgccgtaatcacacccagcctttcataacatcagttactgatcggagtactcccaaaggcggcacacctagaacaagagctatccaaatgcaccccacccagaggccacattctagttcatggcttaggaaaagcaaatattgtaaagggacagaggctaaagcagacattatcgttcaaaagtaacccgtttccacctaccccatgtgattaaagtgctgctgttaatttcctaccatgtgctggtaaaattataattatctttagttttccatcttcaacacaagggacttgtagtatttaaaagtgcatttccaggtgcctgtaatcccagcagtttgggaggccaaggtgagtggatcatagaggtcaggagttcaagaccaacctggccaacatggtgaaaccctgtctctactaaaaatacaaaaaaaaaaaaaattacctgggtgtggttcatgcctataattccagctactcaggaggctgaggcacgagaattgcttgaacctgggaggcagaggttgcagtgagccaagatcgcaccactgcactccagcctgggagagacagtgagactctctgtctcaaaaaaaaaaaaaaaaaaaaaaaaaaaagggcagttccacagagctgctccctggaactccaaagttaatgaaagacaagatgctgtgtaaacagtggccacctggcagctccagggctggggcccagatgtgaggatggtgaggcgtcaggctttcatttcccagcttactttctgcagttgcaacaacttgcgaagatgcagatatttccagttaagtgggttacagggaggcagtttactcaactatagaaatgggaaataggcagacatacacaaatgacgcagccgccgtgcttgtgagcaccgatctgcaccacagctatgtccgccctctgccatcccactggccaggtggccatcactccatgactttcatttgttccccacccaacacctccccctagacaccaaaagcccctccaaggagcaactgctcggtgacataaacagtgcatcaaaatgggaggaaccagaaaagaaaagatatcctgggtaggaacttgccctcctctacataaacacagaattggttgcctgtcatccccactgagattgtcagaacttctattagttccagccttttctaaaaaggaatggagacgtagcatttatgaatttggttatattcaattttctgataaattagagatggtttcgtctcctctttctaggggaaacatatctttagtaactgagcaaatgctgtccacagtgttattttataattttgaaataactccacagagttattttataattttgaaataactccacagagttattttaaaaagtgttcgttgagacctagtctcctttgaggaatacatgccacaccaacacgcgtcgtgttgtgggaagtcccccctcaataggaccattgtcctctatgaggactgtccaggacttcagggatgttgcatttgcacaggctgcagtgtcgatgacttggactcaccagatgcagcctcagtgttccctgtggctgtgtgtaggtttcctctgcaaagcttgaagtggcagacatgacctcagattgagttcttttatggaactctcactgtctttagtcttttatactaaatcgcatctcatttgcaggctggcagggtttctttgcagaggcgcctctttcaagaggcacatgcgttctatttagcctaacaggtgctccctcggccactgcaatgaaaagggtacaacaggcaaatgaagaacagaaagataacaggccagttcacaccacgagagacagcagactgcttttaagctttagaaacatgcatctccctaaaaaagcctagccatacattcttttcatctgtttgtgtcagctagtccctgaggacttctgcccaaggactttccttactccagttatttccacccttgaaaaacataaaatcaaccttgtacttctaaaattgcataatcagaacttcctatgaatcatatatatgacctcactgaattcaaatgagtgataagttattagatttgggggagggccggggagaaaggaggttgcagtttcaaagcccttcacagttatccattctaaaatagtgatctgcatgtcagtctcctgacctcagctttccctaagggtgggctctgtggtgagcttgctagcaggagtacagaccttgcctggaagcggggtctcagggagcccggcggagcctccactgggtccttcccggggtggttgccagcctgactctgggagcgcctgggtgattcctccttggccatccctgcgcctccccgaccctgttgtgtttgccactgagaaacagagaggaaaaagttttgatcgtcattttgacttagggttcccgcctatctgggtttcactgccagtggtctcagatgaaccctgagggtgcattttctccttaagtcgtgcataaccctcagcctcccccgagtcagttgacctgttgacctgccgctgggaactcccctggaaagttttagctcattgctttggctcttggggttccagctgcctcagaggaatcctgagtgcttcttaagttgtcccccttccccaatgggttttctataatgcccagtgcatttcagatggttcaaagtgcccatgctgtcttggacccttcagcagagatggcaacacgtggtgtctggggtgcttgttttgtttgctgaggatgccacagcataggtgtgtgatgctcgtggcccagagtgaagctcagatttgacaaattccagggcaccctctgagctggccagtctgtggctgtgctcacagctcccactgagtgtccagctgccagctcctgtcatgccaggtacttgaggattcctagcttagcttatgacgtggcctctaaacaggacctcatttttaaaatcacagaagtttgtctttacttttgagtcttcagctccacctagcgtgagagaaagtccgggtccaaaccacaggaccacaacaacacacacaaagtgaagcccgtctcaattcagtctaaacaacatgactttcagcacacctgctcctgggtgtcaagataacctcgaaagtaatcagagaatggacctttcttatacctgtggcatctggcattctgaattttgagagctgaaccatgcatgttctttaaaagagggaatacattgctagatttttagagagctttactcttctgtccagatacctcatgatatgactcaatgataaactttttctttcaaaaaatgttcaagggaatgagaaaacaaaacttagtgttatagttgttttctatttttgaaacagggtcttgctgtgttgcccaggctggagtatggtggtaccatcacagctcactgcaacctcaaactcctgggttcaagcgatcctcccacctcagcctcccaagtagctgggactgcaggtgcctgccaccatgcccggttacattatgtattttttgtagaggcagggtttcactatgtttcccaagctggtctcagacttctgggctcaagtgatcctcccaccttggcttcccgaagtgctgggattacaggcatgagccaccatacccagcagagattttttttaatgaagagaaaaaactctaacttaagaaaccttaatgcgtctattttggtactaaatgaagattttcaaaacctaccctgggagagagtttcaacagttggttcaggttgtcaacacctgaccccacgatcaatcataaaagcaacccgacactcatatcttctgtaggagaagaggtgcccagcatcctccgcaaatgatccctgctgaaaaggggaacctgcacctagggcagcctccagccctaatgactcacgtggaggaaacgtggggttagaagaacagattgtacaacaccacgggggtgagactgactgcagcccaccacaaagaacatctgcagcacagatgacccagtgtcttcaacaaccacaaaatgatactaaaaacatagaaaggaagaagggactattgtgaattaagtgagaattcagaggcatagcatccaagtgttatatttggacttttttggctcctggttctagcaaagcaaccttaaaaagacatttttgagacccaagtcagggaaaattgagcacagactgggttaatacatgactttaataaactgttgttcattttgtgagatataataatgccattgcagtccctttttggagttatacatcagagacaaaaattaaaagcaaatatctttcttgcagggaagccgaggcctggatggctatcaagggcctgatggaccccggggacccaaggtgagcccgtttctcatgtctttgccacttatggtgtctcgcccaccctggctggccttactcccctcttgatggtgtcctgtggaggcatcccctgccctaaaaagtacaagatccccaaatacacggcctctgacactggacagacgaggtggatggtgacctacgagccacgtgtgctccctgccagggagaagggtgccacctgccactcagggccacgtaggggtgcgctcaggcacagaggaagccagcagccctggggaaggcaggccttgtagtaacaagagggtgcggtgcccctggtttccaagggaggatgtggcttgtgtgagtaattcctgggcttgcagggaggggagaccattaggtggaagaccaggtgggtgctgctggtctagctgagaggggaacgcacccgtggggaacctgggtgggggcacatctggagaggacttctgagccgggtgaggctcaaagaggtgaaggtggtgcgcgggatgctgccttatgacaaatgctgccttacgacacagatggcgctccacgggggtcctgcggccgcatcatctcccagcccaccctcgccaggcggctcggctatcactacccaaaatgtaatagtctgaactacagaaagcacagtctcctggcattcgacaaggatttcaaaatgagatgagcccctgcctgtcttgttctctttgggcacctgtggctggtggctgggatgccaggctctgccaccctagcatggggatgctgccccaggcactgtctgtggttccactggttgaaatagctgctctgccagcctgacggtccacgctcgggtttcttctttggaaatatgtgtactgtcaaaaactccaaaaggctattctcacatcctgtttttctcttttctttctctagggagaagccggagacccagggccccctggactacctgcctactcccctcacccttccctagcaaaaggtgtgtgaacaatttcacctgcatagttcagcatcgcatacacattctctcctgttagggacacagagctatgaactttcaagacagatattctaagcaaccctaaaacttaaagtataataataataaaaaaaataaaaaataaaccacgaaatttagaacataacttcatgtacaatttccctcatgcttaaatgtgtcacagggagaccttcatgttgcctgtgcctgagacagtcctcaccacctacacgtgagaaatcccctccgttggggaattctttcacttctgcttaacttgtagagttctagttctgccgtctggactatcgctgaagatatccagggcagcagccccagccgccttcggattttttctccaaatgcaccaaggttcttaagccctctgcttgccagcccgacacctggaattgatcataactcataaccagtgaacagtcacatgctttcaggcttcaaggcaactaaattcccagatatttacacataacaaccactccccactgtcacagttgaccttggagtgtaaacgaaggactttgcgcatgtcgtcactaatgctcatcttgttattaaggctcggcttccaaattggcgagatcatatggaaatctgatcctagtcctgcaactagagcacttggctctgaaccttgtagaatgcgcatccttctaggttaaaaaaaaaatgtttcgagaacctcctcctgataatcgtgcgtatatatctttgcggatcattggcccatgttatagtcagctctgtgaggacagacatttcagcccatcttgttcactgctgtattcccaatgcctggaacaggacaggcacagagttggagctcagcaaacgcctgactgagtgacgacgtgcagaaacatatcagacaggcattgtgaagggtagggttttttaaatacagacgctctggtgtttacctcttgaactcagcaggtcacctggtctccctgtcctctaagcctaggtgtcaagaattcacctccctgcttcgaagcgagccctctgtcagtttaataatggctttgcatgtcttcatccaatgctgatcaaaacgcaggacagaacagggccatgggcagtgcctccaggagcccctgagatgtctgtctggggaggcgtggagccgtgaatggggatattttgaaatccatgctcagcttccatgatgcccgtaactacgaagctggcatttcctgcctcatccatggcgcacacctggctaccaaacctgagacccactaaaaagagccatgagcccactttgacttgactcattattaataattttggtaaaaaggaaatatgctgtttgagattttaagaacataatttttaagttaatgctggcgatgtttcttttgcattttttaaaaatgttgctgactgagaacccaactctcaccaacccctcccttctcaccgtactatattcctggaattcacactgcaaaggcgggtgctttcaaaattcactttttcccacaagcggattcagaaatgcggaggttgcctgccgccttttctaccggacaacattcccgagttattggtgagctggaatgtgactgacttgcattccagggtttcttaaagtcaaaggttgactaaccagcagattccctcagggaaaagaggcagtaaatgtatctttttcaaggtaacattgcatgaacttgtcaaaagacaaaaaggatagaggggtttgtattaaaagaaatgattccaaggtacctagaaataaaagtaatcttgctattcttccaaacaagtgagaaggtctgtggctttcaattttgtgtctttttatggaatcaacaatggctaacaggagtgtaggtcacactgtgtgccaggcgatgctccaagttgtcctagttgtacttttcagtgtgtttacccctctgggtgaccctgtgaggtggagatggacttggctgcttttactgagggagagatggaagcgcagggcgttgagttccttgcccagggttgcctttaagtggaggagccaggttcaggcccagggcctctggctgcggagcgcagccccctgcacactcggcacgaagctgcccgagcaggagacgccatacacggaagtcaggccttctgtcccttgcacgtgggacttcagtgtgacgcccagcaaagccctctccttattttaaggaacttcgtaagacgacatgcagagtgaaagctttcctagaaattcctaatgcctacatgataaaaagtcctattttcttctcattcttctcatctttcccaattatagtctagaaaaaagtgtgttctacagtaaagcgttgctatttacacagcaaaggaacatagccatgccactttgtctttgtttgttcaggggtgaaagtttttaaaagccaaattttgttatgcatccagcagacagggatgagaagagcctaatagggttaaagctggggctgaggggcagagtggggtgcagggaagtgaggcctcctcgctcccaggccaccagcagaattggcaaccacattagttccttctttattcgagctttggactcacctacttcctcacccggttttcactaatcctgttcccctgctggagaatgagccccttaaaaagagagaccaccccatgtattaatcatcttaactcctcatcaggccgcatacagcatatggagcatttggtaaatatgtagtcaatgaaaaagtgaacgccagctgcgatccgtagaccacggtcttgttcttactgtgggacttgtttcccttccaggtgccagaggtgacccgggattcccaggggcccaaggggagccaggaagccagggtgagccaggagacccgggcctcccaggtccccctggcctctccatcggagatggaggtaatgtggcttcataatatcaacaccggagacccaaagcacctgcactcaggtcctagcacacacaagggagacttcgttgacgacgtagctatgtcgttgttacttttccccactgactagtcttagcagctctaaggagccccgcacacatgctttggacaccttcacagaaccctcgcacatatgacagtaactccccaactaggttagatggtgccacgatgggtaactggcatgcttccacctgtgggttgggaagagaacggagaatcatcaggtgttgttgcccagtgttgatcacaactatcaagccattatttgaggggcaaggagaggggtgtttttaatgttgaaaaaggataatgaactataccaatggcttctacccatcggagttattgacggggccatgaagcccgctagtgccccagtgggcccctctggacacgaacacaaaggcagcggtgtggtatgggagactcacgctgcaggtgaatgctgtttggtttcagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggtgagtggagggaaacaaaagggagggtgtagcctaatgttcagatgaagcccggtcccagccggatgttatttgggattctctgctaaatgactctgggaacgaatccagtaggccagtgattagggtgcagtggatccaggtagattagggtgtagtgggtgctctctggggtccacgcaggagctggggatggaagctgaagccctgtaagcctgtgagtatcacagccccgtggatgccacacagtgaggtttagttgctgcagcttcggtgaaatccatccttcagcgaaacatctgagctgcgcagtctggaaacagatgtgagctgacattgctgcctctgtgtcggggtgatacattccacaaacctaatccagggtgagggctcacccttgactggcagcctctctcctgtgttactccatcacgtttaagccaccttgataatctgccttctcagcccgtgcacagccaaagctacaactgaacaggtgagagtagctggtgacaaaaagagatggctgcattatctgcaaaaataagtgacagccgtcccccaaggcccagacaaatgcccatgaaagtcaataaagccggcaggcacaggagtgtggacccacctgccacccagtagtgcatccctgagtcagcaaagatgctctttcaggttataacgttaggtgactcaacttgagttgagaatgacctgtctcaggcagcagggaaacatgcagtcccgcctggagcttgctgtcagaaaaggctgttctttcagcttcagcattcagagagttatgctttaaagaccaagcttgtccaacccacgggccacatgcggcccaggacggcttcaaatacagcccaacaaaattcataagctttttaaaaacatttttacaattttttgtagctaatcagctgtattagttcgttctcacgctgctataagaacatacccaagactgggtaacttattaaaggaaagaggtttaattgactcacagttctgcagggcttgggaggcctcgggaaatttacaatcatggcagaaggggaagcaaacatgtccttcttcgtggcatcaggaaggagaagtaaggagtgaagaggggaaaagccccttataaaactatcagatctcatgagaaactcactcactatcgtgagaacagcatggtggaaactgcctccatgattccattacctcctgtgaaccaggtccccaccatgacatctggggattatgggaactacaactcaagatgagatttcagtggggacacaaaacctaaccgtatcaccagctaacattagtgttagtgtattttatgtgtggcccaagacaattcttcttccaatgtggcccagagaaggcaaaaaattggacactcctgctttcgatgttgtgaaatgcctaataggaatatttcattctctcacaagagtgaatataggagacattgggagaaaataagaggtcatagtctctttctgtgtgacgttgaccaaaagttaacagcctcttctttccaaagtagtttactttaaattccctgacattgcccctaataatctcttacagcctcctaccttcggggaggaaaaacaccatgtttgctagtggacagtgtttggtttcagtaacaggtcaaagtctctgttttgtttgtttgtttgtttgtttgtttgttttgagacggagtctcgcctgtcacccaggctggagtgcagtggcatgacctcggctcactgcacgctccgcctcccgggttcgttccattctcctgcctcagcctcccgagtagctgggacccaggcgcccgccaccgcgcagctgggaccacaggcgcccgccctcacgcccggctaattttttgtatttttaatagagacggggtttcaccatgttatccaggatggtctcgatctcctgacctcatgatccgcccgcctcggtctcccaaagtgctgggattacaggcatgagccaacgcgcccggcccaaagtctctgttttaattgtttgtttttggaagattacttctctttgacatatctagaaggaaaatcattagagttattagaggcaatgtcttctatttaaaaggtagtagtcacttctctgtgtctgttttatattataaagtaaaattttaacttaatatgctttctactttctcaatttttcttcaattagaaaacccacatattctcacattattctgaaaatttttaggtgcagatatttccctggatcatgaacctgccaaagagtctgagcagtgtgaactttatttttttattttattttattttattttgagacagggtctcgctctgtatcccaggctggagtgcagtggtatgatctctgctcactgcaacctccacctcgtgggatcaagcgatcttcccacctcagcctcttgagcagctgggattacaggcatgcaccaccaccatgcctggctaattttgtaattttggtagagacgggggtttcactatgttgcccaggctggtcttgaactcctgagctcaggtgatctgcccacctcggcctcccagagtgctgggattacaggtatgaatcaccacacctggcctttaatttttttcattatcctggactgctgtgataagagctaggtttctatgagcattatatttcctaagcaaatggtatcttttgagttttctttttctggagcagaacatgacatgttaaaaacaaaagcatacaaatattccactttaacggccaggcatggtggctcacacctgtaatcccagcgctttgggaaagccgaggggggccgatcacctgaggtcgggagttcgagaccagcctgaccaacatggtgaaaccccatctctaccaaaaatacaaaattagccaagtgcggtggtgcatgcctgtaatcccagttactcgggaggctgaggcaggagaatcacttgaatccgggaggcggaggttgcagtgagccaagaccgcacctttgcactccagcctggggaacaagagcaaaactccatctcaatttaaaaaaaggaaaaaaaaatccactttaaagaacggtgatcaaaggctaacgttgccattattcctgtaactaaattccattttgataaagtcacagcatatgccatcttgcttttcaagtcttgcttagtaaatccgtggtttactagcataagtcaactgcgaacaatttaatttctgatctgtagtgtgggctgatgaggaaagtaataaaatgaatggcatcagatcaatgttagcagctaaaaatgttaaaagcatacaacttaagtcctctaattatatatattacccctgtgagacacatggtttccaaatcaacatttttaaagcaagttcttatgcaaaaagtagtccaccataatggcctttagaaaatgtgtgtgtggttgtagtttagtaggaatgaccttgattcccatggagttctctgacttttcccctggaatgaaattgttagattcctctcttgttaactacatttcatcctgttttataggttgctactgatgaaaaccagagtttttagtcttttgcagctccagtaaaatcaaaccacgaagacagttttctttctgggtgaaatattttgcttccccctgttctagttcagttagctgaattgagttctgggaagttctgttccacgtagaaaaagtcaaaataggcctggcttgtttggccaggggctctttgtggaaatcatgttgcaaacatctaagaggcacactgctattctataggacttatttaaaatgactaatatattagagaaaaggagagcagcagggggcagaggaaggctgtcaccctcagagagccactgtgtgcctttaggactaaatttgcaaagcatccagtgcttccattgtaaggagcgcccacaatctctttgtcctgaatgaatgacgtgtctcagattgacaatggtgacatctctgaagtgtgtgtggttaaatttctctctacctgcgacactgcacgtctcatcacacagagggagagcttggagacagagaacaaagctcacaaaagtccacaactgaccggacacgcagctgacctggtcaccggtcaccctttgtccccagcagtgcggggtgcggccgcctctcctcctgagacgctgtcttctcccctccactcccgggaaatcccactggcccccgacatctctcccctgaagtccctgcccctccctgcactccccgccggatgaactcgtcctccacatgaaagtacatgcagtgtgtgctggtcactcgctcgtttcctctctggccctgttctgtgtgctgagctactaacagaaaccgttaactcgacacagagtcaaccctatgcacgtgtctcacaaatgcctcaagctctccatgtccaaaatggagctctgggcctcctccgtccccaccccctgccaccccacagacctctcccttggtcctcaccctcctgcacaaacccgggagctccagcagagccctgggctactctgcctacctcacccattctgtactggctccctcacaatcctggcgggtcctccactccagtgctgtgtgtgcccttgctatccaccaccaccgcccgcgtagcctgctaggatggcacccgttgttccttccctctccagcctgtcgtccacacggcagactcacatggcagaccgcgtagcctccctccttgatgccctttaatggcttcctactgccctcggggtaaaagccaagtccggtttcttcccctccctttgtgcaaatctgcccttcactcaccactctgcgggcgctggccttctgcctatttcagggccttttagaaaccctgtcctcactctggagcattccctcccgctccccacttcaggggctcctttttattctttgggctttaattgaagcatcacttcctcagaaaggactcagctgactacccccaaaacatttcactgggcctctccctgctgcttttcccctgttccccagcacgggccataatttgaaaatccgcattagtgtgtttcctgcattgtgtgtttaatgtgtgtctccacgtctaagctgtaagctccatgagagtccatcggtttcatttccagttgtatacacacagcacctcgcacacagcctggcacagcataggcacgggataagtgtttgatgagcgaatgaatgaatgagctatggtaaacgtgcagtgagcaaactacatgggacggtatccatgtcctcattctcatagacatttatcctcacctggcagttctctgacttgcaaactcccgtgctcttttccaagcagatagctgggttctttaaagttggagttttctcaccttcctgtgtgtaacggcctcatcccctgctcctctcaggttccatgtagtgtgtatagcaacatgccttttaatttgctgggggagtgccatttgcccattggagctctggccctattatttaacagtgaggaggacagatagctgcagggcacacctgcagagcctgcccccagcagcagcttgtgtgtcttgcagacacacaccctcctcctgccacgagatggcactcttcttctccagtgcgatggcgcgctctttgctggtgtgaagagcaccgtgtttcttgcaccgtcatcatcagggatgcccccgccgggatcattgagccctgcaggagctagtggggagaggtttacaaggggaaggtggtgggcgaggtcatccaacatggctgaccatgctgaatccagattggccacaacatttaattagcataacagttatcctaactccgtgtgtgtgcatgtaaggcatgaaagaggaaacagtgttctggagggatgcacacgtgtgcccccattcccatatcagaaaaagatcaaaatgggaaactgagttcatcttttttttagttttttgggggggaaccagaagtgtgtagcagtcttggaatccaagttacatgatcaaaaaatcaaaacttttctttggactcaatgtttctcaaaaggaataattgttatccctatagtttaatggaaaaactaaatttgcagactcttatatttctttccaaccctgaaggctatcgccacaaaatagtctaagttttcttttgaaaaaatgtgcttttgtttatgaaattgggtttatggatcatttggggaggcttggctgaaagccaccctgggctgggtgggacaccaggcgtctctgtggtgcccatgccctgtgtctggggggaccctgggcatccttgatgctggtgcctcacaactgggtgggatgccgggcacccatggtgccgatgccctgcgtctgcgtggaaccccaggcgtccgtggggctgatgccctgcgtctgcgtgggaccccaggcgtccgtggggctgatgccgtgcgtctgcgtgggaccccaggcgtccgtggggctgatgccctgcgtctgcgtgggaccccaggcgtccgtggggctcatgccctgcgtctgcgtgggaccccaggcgtccgtggggctgatgccctgcgtctgcgtgggaccccaggcgtccgtggggctgatgccctgcgtctgcgtgggaccccaggcgtccgtggggctgatgccgtgcatctgcgtgggaccccaggcgtcgtggggctgatgccgtgcgtctgcgtgggaccccaggcgtccgtggggctgatgccctgcgtctgcgtgggaccccaggcgtccgtggggctgatgccctgcgtctgcgtgggaccccaggcgtccgtggggctgatgccctgcgtctgcgtgggaccccaggcgtccgtggggctcatgccctgcatctgtggttgtctctctaggcttcctgtttgggctgaaaggagcaaaaggaagagcaggcttccctgggcttcccggctcccctggagcccgcggaccaaaggggtggaaaggtaagaacatctgggagggacgggatgaggacagcctggcctttccaagtccctcaccttacagaaggtgaaatccatcccccactcacgtgtttggacatgaaaatgagcctgcatgtctctcccagcctcctgtccccttggcggtggcactgagagggaggcgcatggagccagtggtgctgtctgagcactcggcccccaggctcaccgtccctgctctccatctgccatcctcgtcactgaccttcctagcagcagtgagcctgatgctgagtcctgtgctgggttaaaagggaaaacagttatttcttaggctgcactcaggtagtgtctcaagggctcagctccaaggcattgtaacagaggtctgtagagagctctgtccatagcaaggtgctggtatagtcaccatccctggtcctactgagactcggtagagtgacgtggtttgcccgggtctcccttcccgttgatgaggaggcgaacttggaacaggtggtctttgcacctgaccctttccagtcacctcagggactctgcccctagctcgaggccgtcctctgtgaggctctgtgggccctggtgtggtgcaggctgtgctcctgctcacctctcccctcccagaacatggggagcacttcctgggacttaccacgtcttggccgttttggcgtatgtaggatgtgcagtgcattcagcaccccgctgtggatgggcatgacctgagagcaggcaccgcaggacctggaggaagtggggcctccccactgggcatcctctgtgccctgggggagccaacccctgccgccagcatggtgctgccttgctgcccaactccctgggttcagctgtggcaaaacagaggaagagaggtcaggcatgtcttccctgctcacctatgacctttcatgaccttggcctctgaggccagggctcttgccctccctgacggctccctggagccggctcctccccttggcccgcaggcccagtggtggcaatcttcagctctaagcactgaattccttaacctccttcacactccccgcaactcaacctatgcctctgaatgtggtcccagtttttaagtatctttagtaaacatcagagtcaaattctgaaccccatgagactatgagtgaacacttgagtcacttagtctgagcctcagttttcccatctaagaaatgggggtcatagtgcccatcagaacaggcagtgtccataaagcaccaagtgtgccacccagctctccccgctgcctgatacccctctccccgccacgctaagaggaatgcggaacaaggaggccctcctctccctcctctgcaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaaggtgaggagcaatttcatcatgaagctggcaagacactctgaggcctccccaggtgtcccgttcttgccttttatctcctaagtttacacagcttcagaccggcaacactcatggacccaaggcatggctaaaccattctaaaaacccacataccccaaggcggactttctacatgtccactggtgagactgagaaggggcgctgctgtgggaaccgcagccgacagctcttgaaagagttcaatagggggtcaccacgtgacccagaaatgccactcctggtgtatccccaagagacttgaaagcacgtgtccacacaaacacacatacaccaatgttcacagcagcattcttcaaaataggcagaaggtgaaactatccaaatgtgcgtcacctgatgaatggatcagctaaatctatacagcatctataccacagaatagccctgaccttcacgtgggagcaaggtgctgagccataccacactgtggatgaacctggaacatgttatgccatggggattgagacccacacagaaggacacatgctatcacatggtctctcattctattcttatgaaatgtccacacaggcaacctagaaacaggaagtcgattggtggctgccacaggtggaggtgggggtgggggtggggagtacctgcttaatgggaatggggtttctttttgatataatgaagatgttctgaaattagataagagtgatggttgcacaaccttgtgaaaatactaaaaatcactgaattttatgctttaaaacagtgaactttgtgctatatgaattatatctcaaaaaaacctatcatttttaatgtaaaggacattatttatttatcgaacattcgccttctgaagtttagcaagaactgattcagcattgttggaaggcttccttcacctgataaaaagcaagaccttttgatttttaaactgtgcacgtgcttgtgtggaggtgtggaccccacacacatcagctcatggcctttattctgtgccttatgcaaaggtcacctgcagcagacctttcttccgtggcagattttagctgaccaaagagttcaaagtgaatttcagatgtagacaaagaaagtatactttttgttgattttttaacttaaaaagagaactctgggaaatttataaagcaaaaagttcattatttaacatattcagcaatagaggaaaaacagttggtcaggacacttggccaaggaaacttaaaggatctgagcccacagcatggaaggaaccgcagccccgcagagctgtgttgctgacggccatgactcccaactgcttcatggcacggagctgtgcaggtgaaaatgagacccgggcacctcgctgatccatgccctaggttttctcagaaaacagataggaaaattcaacaaaaaatagcaggtgctcattttatcccagcttaaaaaggatgcgatctctgaatcatggctgtctagcagtaaaagtggctctagtattcagaaaaagtgcgtggggtgagaactgcacatataccaatggcaaagctagtaggatcctcagttgtttaaaacgtgaccgaatatttcccagaagccaaatggaccccattctgtgcccctgaaatgtctaaaaccttccaagcacacacgtccacagaacttttgttcacacgcctctggctgtgcctggtgtcctgcactgaattctatgattgtgtgtatggaaaccacactgaagtgggaatacctgagaccatttgggagttttttggttagtttttgtttgtttgtttttattgttgtttttggtttttaatatctgtactggtagagtggcagggcgcttgaagtgtgggagtgggtcaataagcccatccctccatccatatacccaacgtgtattgatcgattgggtctggtctgtgtgtgaggaactctcctagattctaaagtaatgttgcaaagcactaaataaatcaagaatctgtggaattttctagaagggaaactcccaattactttcaacattgcatttaattaaagcaactccacacattcccatattcttggaaatagcgtcaaccaagatatgtcaaaagctagcacagctcacgtttgaaaacacaacgctgatgggtaccctgctcatcgtggaaagagctagacgcgattttccaggctgcgatttgagagtccctgcaggcagcttctctctaaagtatctttttctctcaaccttaacctcagtgcaggaaacaaatttctattaaataccatttattgttctcaatattatcacaaaattttatcctccatacctggattaacctgcttggctcctaaacgactgtgttttagaggaagccaccttgacttttaattcagtgcttctcaaaaggcaccgagcccgtggatccctggggcctctgtggacacgaaggcaatgattcagctgccccgggctggggcctgcacatctgcaccattgggcagagcccagggacactgaagatgggcctaggacctgggtttccctgtccaaccacctgtggctacttccactgcattgtatttacttatttatttatttatttatttttggagacagagtctcactttgtcacttaggctggaatgcagtggcaagatctcggctcactgcaacctccacctccctgtttcaagtgactctcctgcctcagcctcccgagtagctgggattacaggcgtgcaccaccacactccactgccacactcggctaagtttttgcatttttagtagagacaaggtttcaccatgttggccaggctggtcttgaactcctgacctcaagtgatccgcccacctcagcctcccaaagtgctgcgattacagaagtgaatcaccgcgcccggccacattgtaattatttaaaattaaagaaaaggtaccatccagttcctcagtcccaccatccgcagttccagtgctccacagccactgtggccagtggccccacactggacagctggatgggggcgtatccagcatcgcagaaagtgctccttgggtggcgctcggtttggtgacgggtgactgcctgccagctgtgtgagatgaaaaagcttgccagccatcttctcagatgccctcacagtacaaagaaggaagatatttttttgtctgttttccacagggagtgcctggcaacattggtgctcccggacccaaaggagcaaaaggagattccagaacaatcacaaccaaaggtgagttcctctctggccacgcggcccctggggcactgagccttcctgtgggcacctgcctgggcagcttcacatgcaaatccctttctaggtgagcggggacagcccggcgtcccaggtgtgcccgggatgaaaggtgacgatggcagcccaggccgcgatgggctcgatggattccccggcctcccaggccctcccgtgagtagccacaaactgcggcagctccgtcctctcttcttcatccttcaggttctccaaacaccccagaagcaaacagtattgacatgagcactaaaccaacctgtgcataggacaggctgctcattctgctcattctatttctaatgagcagaaatcagactttttaggaaacggtgaattaagttagaagccaagctccaaatgaacatttaaaagtcaacaatcaaagaaatattcctcctggtgtaacagactaagaaccctcccccgccaaaaaaagtagactattctaaaatgggtggtggaaccctatttttccaaggtaaatcatgaaatatacaatttcatttttgcaacaaacacacactggtgttgaaggaggggctacctagtagcctgcagagaccccagcatcatttcctcaggggaggctggggtcagaggcgcgggaggcagccatggagggagacaagaccccttcctgtgcaccctccagcctctgagcctctcctgccaccacgcctttcccactgccagctctggagcattctcttctcagaaggaccttgcaaccttatttctcacgtctttttttctagattccattttcctccctctagtcaccaagcctgtacctccttaagctctttgtactggtttcctggggctgaggtcacaaactgccacagactgggcagcttagacatcagaaatgtatggtctcacagctctggaggctgaaagccgacatcaaggtgtctgcagggctggttccttctgagacagtgcgggaggatctgtccctgcctctctcccaggttcccggagctctggcattccttggcttatagacggctgtcttctctctgtcttctcatcatctgtcctctctgtgtgtctgtctctgggcccaaatttcccctttttatagggagagcggtcatattggaatgggcccatcctaaagacctcatctgaccttgagcaccctcaaagaccttatttccaaataaggtcacatgtctaggtcctgggggttaagacttcagcatcattggaggacgattgaagtcataatcctctttctcctcctcagagcctcacgcctgaattctattcgcagcttatttgcctcattccataacccatgtcttctctagttttaacgtgggtcatgtctgtaataacactcttgagtgcagtggtacaatcaaagctcactgcagcctcgaacttctggactcaagccatcctcctgcctcaacctcccgagtacctgggaccacaggtgcacaccagcacacccacctaatatttttaaaattttctgtagagatgagatctctctatgttgcccatgctggtctcaaactcctgggctcaagtgattctcctgccttggcttcccaaagcactggttttatagacatcagccaccacacccggcccacatttttacaatttaagtgcagttttttggggccagagaacacagataattctatgattgggtatcttaaaaatctcatctgggaggcaacagggttaaataagaggcaaagtcataattggtcactttagccagaagaggaggatgagtgatgattcctgtggttggaacagtctttggcctgttcagtgtcatgtggggtgggggtggtgagtgtatgtgtggtgtgtggtgtgctcatgtgtgtatgtgtgtggtccgtttgagtctggatttgttacggtagtggtggccttccctggagttggtgccttgtgaagttggtgaccaggaggtgcacctgtccagccatggggttcacccacccctgcggctcccaagcctggctgccagtcccagcccagctgggggcaggtggtcggagcagggttaggggtaggggtgagggttagggtcagggagaaccttgcagcctcagcttcccattctcggggtgtagggactttcccagtgcttgtgtgccttccttgtttggtggcatctctaaaccaagaatgtcaacttctgcctttagaaaactcgtgatcctgcctgtgccaccttccagtggcatcatccccactgctgtccactaagtttggggcatctgccctgtgatctctgcaacagccttgtgtccccctcccctgtgaaaaaaagctaaaacacaggggtacaccacttaatcaaggtctcataaatagagctggaccggtgtccctgccccgctccgtcatgcctttgacaaggaaggggctgtggtgtcagtggagagcagggtttgatttcttataagcagctgcctcattgtcatgagaacacccagcctcgtcccgtggctcagcagatgagcgggagcttatgcgcatggctgttccaccagcacgtggggacagcaccgagccgtgccgtggtgtgtgcgcagatcacaccagcatcactgctgccagcctccccaccccatccctgcacctcccaccagctcccccccgcaccctgcagctggtgctttcatccacagggcagcccctctccattcccaatcctgtaatctctcctgacttctgaggcgcacacggctctttccttgtccaaattagcttcctttcctttaacaacgtagcatctcttaaaataacagccattttaccgatgctaaattataacaacaaaatcatgtgtttctttctccacccacagtagaacacaaaagcctgtgccttcgctgttctggagatgaaggcccaggctgatgcaggggagctggcgggtgggaagagagaaatgctcaagcatgtacatgtgccttccagaaccggcttccgtggcattgcttagactgctacacagtctgtcactggctcctgtgacctggctgaccatggcactaggttcctgttcatctctgttgtctttctgttctggatccatagctcagaattccgggaaatgggaaaggaaacagggaagtcgaggcgatctttaacattagtatatattttaagaaataaactgaattttcacacagggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaataggtatgaaggaatcctcccttttacctttcacagtcctgagacattccacgctttcctttgtcagtgtagacgtttcccagtagagtcagatgaggatgctgttttgcctcatctgttctcgcacgtacaagggatgacccaactgtgaggtttctgagcccccaccagcctcccctcagcagctgaaacatgcagcctctcctgtaggactacagtgacagaggccttgcccggaagttcagagatggctttcccgttccctgcccatttcaaagccttcctgcccccaccagcaacatatacgacacaccttcacacacgtgcacgccccagacgagccagtaactcttatctgtttcaaaattgcctcactctgtccttatgtcttccccccagattgtgacacagatgtgaaaagggccgttggaggtgacagacaggaggccatccagccaggtactctgggaagtgcaggtggctttaggacactagagaactctcatttggtctgctggttaagctcttgcagtatgcgtgggataagaaatattaataatatgtgcaagccacgtttgatttccatggcacaacatagtggcctggtgagcactatacattgcatgaatgacaacctggtagagacggagagacatttaaccaaacccctcttgtcagaaatcctttttcactggaaagcaccagtgcattccaactcagctccacaggcacgtgtgctgccaggagggtccaggcagaggaggctgagcccagcccagacggtggcgaggatgtcaggccaagatgggagcctggtccagattcccaggcacacagacaaaagaaagctccaagagtgactgttcttgcaagagagcctcttagacaaagggctctcacaataccccagctggagtgtcactgctcccagccacaccaaccagaagtgcccacagccttgatttaattttgcaaggtggctgattgctgtggttcactctgaaagtaaacaaagtcacaaaggagaagtcaaataattcattttgaaatcgcaggctatctccattgctggcagatgcttccagacaaaagaaaagcatccacactgacttgcagggtagcagccagattaactcggtttgcacccaggctactgccctgcaggagggaatcaattgtttgccagcacagtgccagtttttatttgactagactggcttagtttgcattttatacgaatattttgatttcattacacaatgaaattaaacttttatttacatcagaaccaagatgaattaaatcattaagttactctgatcccagaatggtagccggtttgcacagctcgtgcttttgcccttggggatccccaaggccgtgggactcagtgtttaggattgcttgggctcatcttttctcctttctgtccccaggttgcataggagggcccaagggattgccaggcctgccaggacccccaggccccacaggtaatgcacggagggaacctggagtgcacccagccttcctcccacatcttcacactgctgtgtctcccccgcccatctttcctctggtcctgcatcccccaccccagacatggtcgtgtccagcatctcagcacaaactggtcttgcgcctacagggagcccactgtcatttgccactatagaaaaaggagtctggtagctgacacttagttggggccaggctagaagagaaaattcagccatggctgcaggggaacgcccccaggggcagagatggaagcctcgtgtttaggactggaaaggggttgcacttctatgtattttctttttatgcctttccatcccaggatctaggggaagaacctacaggagaggatgctttcatttgggttttgattaacaggaaacgggaataaacaaggctagagtgttttgtctctagcacctgggaggacctgggcttctatctgctggcccaggccatctctcagcccatgtgagaaagagtctgggtgcccttcacagagcccatgcctaaggccgcctgcgtgtccagtgttggcggtgcaggcctggctggccaccactgccgtcccgcctgcgctgcgattctgctgccctgcactccagggtctccgtgggcctgtgagcatcggggaacacagagccagggcttccactcaagcaggaggagggctggaccctgagaggtggctctatgcctgtgtccatcagcctgagaaaagcaagttctctgagcagtaggaattcccctttggatgtctcttccactcggcctgtgatggggccggggaagcatgtcacttgggtaactcagtgtcacaagcaccagacacagccagagctgttctcacttgtttcttctggaactaagtccccacctatgcaagatgaatagtgcagacaggtgttctagatgcttcctgctgcacaaatcatgccctcactgcttcccgtgataaactgtagagagcgacaccagtgtagtatgaacagcaatgagagttaggaaagtggacggacacattctatgtgccctgcaccttaagggggtcttcggagtgcaccgtgatcacagggcctggggagcacaggacaaatgcagaggtatcatttgcactgtgagcagaggtaaaggctccttgtgttgtcttctgagaactgagcttgtatcttccgcgttccattagacctgcccccggtctaattccatccatggatttcaacaccgtcactcatacagcaacccccaaaatggtgacaactctgcatgtctcaggtggtcagggagaaccagaggccagcacgctcagcacacacccagactacagccgtgtgccaaggccggtctccgggaaagctccagtgatgcgagtgtgggtttctgaggctccggggctcccccagccatacccagttatttccatttcatgcccaggcccccattactgggagccccttgctggcctcccatccgctcctccctctcactcctgctgtccgcactccactttctaagagtgagggtgggtttgatcacacacatccccttcccaagaggcgccaggaacggggataaaaaagtgtggcagatgggttttgtgacatggctgaggaacctcagcccttcaattatcagaaaacacttctggagcccacacactgggccaagcaggattcaagtgtttgaaaagagtcacctcatagtcctcgtggcgtcctcatgaggcaggcgatccttctccccactttacaggtgaggaaactgaggcacagaaagttgtccacggtcacacagatagaatggtagggccaaaatttatagccaagcatctgaccccacctccaaagccctcatttagagcactgtagaatctaaatattggatattatcattcttatggttccagtccgtaaacaggattttaaacactgaaaatcattctgtaagcctggaggtgctgtttcaggctgatattccccccagcctcatcatttcccggtttcatgagatccacattaagtcagatgccaagcatgaccatgcccatttatcctcgtggagcctgatgtggtttgtggtttatttggttatttaggtgccaaaggcctccgaggaatcccaggcttcgcaggagctgatggaggaccagggcccaggggcttgccaggagacgcaggtcgtgaagggttcccaggacccccaggtgagttgagatcagacccccattcagcccctgggttccagcgggaacctgtgtgtgattcataagcatccagctctattatcttccactttgtagaagctgttttaacaaatacttgacaacttttgcatttgtccttgggagattagaaattcttgatttttcataactgatattgtactgggtttttgcagaagctatctacagatcttgcaggaaaaaggagacaggtgtttcggaatggctgtcctccgcaacacctgtctcccaggtatgtcctcagtgttaataatgattaatattaaacattctaagggcaacacaaagttatcctctcctgaaagaacccttaaaggcataaatagccctctcacaatgtggctgcaagagcttaaggcattaatctgtatgtggaggaaaatgaggtttcccttaaccagctctggtgaggagtacccacttgcgtgtcagcatgctctggaatgcagccaggcgtctgcagacataggtgtcttgcagttgtgccacaggcgatgtgcatgagtgtgatggcactgccttgattgcaggggcatacacgtctttttttttttttttttttttttaatgaaatggaatctcgctctgtcacccaggctggagtgcagtggcacaatctcagctcactgcaacctccgccttctgggttcaagcgactctcctgcctcagcctcctgagtagctgggattacaggcatgtgccaccacacctggctgatttttgtattttcagtagagacggggatttcaccatgttggccaggctggtctcaaactcctgacattaggtgatctgcccgcctcagcctgccaaagtgctgggatgacaggcgtgagccactgtgccaggccgcacacatcttcaatagtgtttgtctaatgaaaccatggaagccattgtggacaactttccacccgagatgaaacatccttccacagggtcctgggcaggttcctgcagcctctgctggagtcccacttgtcacctagaacctgtggcacattggaaccctcttgttgctagaaagttcctccctggaatacagcctgcctcccagggagttctcaccgggctgttcctgagccacacagttgacttcctcataaccacacaccctgagagaggcggccacatctcccacagacgtctcatgaacaggcagaactgaccccgggaacacatactttcttttaatgacatcgttccatgcccttggaattctgagcaaccttctaggacccccacttatcaggattcttttccaactgggctctagaaactgaataaagcgctccccatgtctggaatatcacacagaacatcgggactgttgcgcccttaggttgaacatcttgcaaatgttcccagtgaagactaattgaaccctgcccctcccctgacctccactcagatagctgatttaagcctcaatgcagaagtgtctgtccgtccctgatagatggtatctttcggaattttgtgttgcagcccgtagggattgttccaaaccctgaccctgtttcctttcatatgatgcgtttctccatgttttgcaaaattgggaagcaggcttcctgtgtctgtatcaaggccctggtaaaaacaactctgcattcgaatgaagcaaaggaagtctccatgcctctgccccaggggttggtctctgtggttttgttgccctgctggaagtgtctaaatatttagaagtgtaacattgccactctcatgatttcatatatactaagtttaagcattcatgattttgagagaaggataataattcctgaacagcttcttgctgtgagtatgaaagttctctggtaattgtgattggagtgcccagccatgtgtgcgtgaacgccacacggggctcccctgtaggggggaatggatgggatgcacccattatcaggtgatttggacagttgcccacgtgagttgggagcctgttccaccatcaaatgtgagcccttacgtcatgaacagggaggctggggcaggctgggggtgggtggtgattgaggaactgatcagtttctgaaacgcatgtcactttttatggtgctgaaatatactgcccttctgtcgccacatgcagaagaggataaaatgcccaattcaaggattgcaaaaatcagagagtctattccagatctaagacccacacatgcaaacccaagtgcatggctccctgggtacagtttgtaacattgccagtgaaagtcatgtctcttcattgtgagtaaatcacaccgttaaaactctgagtacggtctagctgattaacgtcaggttaatccagatcctttattctgtattccagttactcccagctcccaggcagtgatggctttaccggcccaggaggtccccgggccctgctcattggatctttttggtgggatacaccccacagaacacagaaaacattcccttttccgtatccatacataggagtgccgagcctgccgtgtacttgatcttgtcccacagaatcacctgccagtctcatcgttgcaggcttctctcctgcatgcacagcgggggtggtggtgacctcagaagcctttccttctgagcactgcgtgactgtcagctgtgggagttcattctgaggccatgtcagggctgactgcaccgaaaaaggaagtgacctgatgagatcattttatccagtggcacccacaaaagacacaggacagctgccttccctccatccgcagatgggacttgatgattttcttttttctttttatttttttctcttttgagatggaatctcactctgtcgcccaggctggagtgcagtggtgcgatcttggctcactgcaagctccgcctcccgggttcacgccattctcccgcctcagcctcctgagtagctgggactacaggcatccgccaccacacctggctaattttttgtatttttagtagagacgaggtttcaccgtgttagccaggatggtctcgatctcctgacctcgtgattcacccgcctcggcctcccaaagtgctgggattgggacttgatgattttcatggtcaatacaacagaggggtgtcgttcctctttgaagcgtttcccaaccgacagtgacgggtttctaccagggagatgttacggcaggcagcgttttggctctgacggccctgttcgttcctgcctccctgggattttccatcccgaagtgctgttcctcactcagcacaacctagaaggtcccacaaaaagctattctttggggcttatttgcaaagcaggggaacccatgaattatgcaaatcgaggtccaaggaggcgttgttggcttgtccaccttcactcagttttagggctggggggccgaatggcggggcaagcagaagaaacataaccaacagaacgacatggcgaaggttgtaggttccaaaaagggcgacagggacaagggctcgagctgaggaatgccttctgaggaccccatagccaaatttttgctgtttccagcctctttttgactcttctcttagaacgtcaccatgctaacttgtggtttggggcccacccatgtttccttttagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggtgagtgccccatcggggagccgggggccccatcccagatgcacagtggcctccaagggcgaccccaatcccttccgggggatttggtaggaagcagcggtgccctatagtgctagccatgcgtaccttctcccatggccttccagcactcctttagaatgtgtctgtcacaacactgtgactacccacggtagccagtgcgatctggccatctgagaactttgacaggtgtggattcactgatgtaatctgttgtcaagttgcatatgcctggctgtgacaggggccgtgacaggctcactgtttgtcttggcagaatctgtacaggtggtatgaagaaaagatgggccctggccatgcttagtcagaggtgaagaaggaaaatagaaataatctggaatgcaattctattggtgtaaaaattaatacattttttaaaatgtcttaatgttgtttacagtgttatcaatgtatctctatcaaagtagacagagcatccctggtttcatgagtgacaaggcacccggtggctttaagggttcaactgatgccaaatcggctttgggaacccgagccccgagctttaatgaaagatgatgccatggacagcaaatgttcacactgggtgaaccccaggctggggattgctagatcattgcaacctgccattcagtgttccaaatcaaaaatgaggctgagcacagtggcttacacctgtaatcccaacactttgggaggccaaggtaagaggattgattgagccgaggggttcaaaaccatcctgggctacatagggagaccccatttctacaaaaaaaaaataataattaactgggcatggtgctgtgcacctgtaatcccaactacatgggaagctgaggtgggaggattgcttgagcccaggaattgtagattgcagtgagctatgatcattccactgcactccagcctgcgtgacagagtgagactctgtctcaaaaagaaaagaaaagaaaagaaaatgtgggttaaaactgtgactcggtgcattcactgtttatctgttgatggcattgtcgttagtccctgctgccaaccccagcccgaagaggcttctctgtggtgtgggaagcaggtgtcgctcccctgattctgccatcagcccacatcaggcatcctaagcgagatggaggctaggcctccactggcaggcgaacccatgaagctcaggagcatgaattggttttcggatgagcctgtgagattcctagcaaggcctggaagggttgggacccaggacaggggagttttgatgatgatgagactgatcagtgcccccagctgttgatactagggagcgcccatgggtgccacagttcactgagagagcaaggaagagcctaagatggccagagtgcatgcatgcacacacacacacacacattcacggtcacactcatgcacatgcatgctcacacatgatcacatacacacatgcagatacctacacacgtgcctatgcatgctcacacatgatcacactccttacacacgtacccacacacgtgcctgtgtacactcacatgatcacacacgcacgtacccacacacgtgccgtgcacactcacacatcacacacgcacgtacccacacacgtgcctgtgtacactcacacatgatcacacatgcacgtacccacacacgtgcctgtgcatgctcaaacatgatcacacactccatacacacacgtacccacacacgtgcctatgcacactcacgatcacacacatgcacatacccacacacgtgcctgtgcacacacgatcacacacacgtacatacccacacacgtgcctgtgcacactcacacatgatcgtacactcatacacacacgtacatacccactcgtgcctatgcacgctcacacatgatcacacactcacatacacacacgtgcctatgcatgctcacacatacacatccaaccctgaaccaagccagctagagcaggttgttgggtgaaattacgaggatggggaggcctcgtgctcggccatccagatctcccctttccagtcctactgactctccaggtcatttatggaagataagatgcaaatcagcgctgtctgcagaaactgaggactcggcgctgagaggtggggctctgtgtgtcagccttcctggaaggcacttaaatgagttcacagaaggcaaagtgaaggacatacgtaggtgactcgagtgtccaccatcgacctgttctgcaacccagctgtcaaaatcctgccccaagctctttgacataagggtacttctggtagaatttttttaaaacttaattacttcctgcaggcttcagaatgtttgagcatgaaaacaaatggaagcaggcttactttcgatgtcttattaaggtctttaccatgatcaatgttacctttatgacaagcttcatatgccttgttaggcagaatgttttggatggtaaaaatcctgactcccaaagcatcaacattccaagtaactacttcagtttcagttccgctcaccagtgctacaggagcagcgtgcagcgggtcctgcttccattcgactggctgtgcaggacggccacaaacacacgcaggtgcaccctgcgcttctgagcagaactctcggaatgaagtaatgcagacgtccacaaatgagatgtgatttcactgagggaggctgatttttagcagttgttccttttttaacagatagtctataagtggaaactgacctgaaacattcagctctaaagaaataatcacaaagcacctcggtgcctgatttttgcaaggcagtccttgccggaggatcgggcattcgtgcacattcacccggagaccgtgctgtccacttccagaaggggaggaagggcagcgctcagaagcacgcccagactgtctccagccctgctgccccctgctgaggccatctcgcctgctcagcccccaagttcccccacagtccatgtccctgggttatgaatgtcacctggtgtctgtcagatccccaccccattgttcttgtcaatgagcaggagtggggtggacctgccatcgctgcgaatcctttacagcctgcagtgctgcctgccaactcttcacaaccattagcacccactaacaatccatttcccctggagctcttcactctaaagatagaagaccaaaaaatagaagtgtcctcatttctcacagtactacaggaggaggtgagaaccgatgcatccgtgcatcttagagaatctcatttcagacctcggcttcgagtgcgcctcctgctcagtcagccctcttcctcgctgcaggttgacgtggtcagacagtgcgcagtcagcagcctgactctcggttctgggttggtccaagactgaccgggtcccttttgtcactgccccctcctgtgcacccccctggcttgtctgcctccctgtcctggaccagccctgcacacctgcagggtggctgtgaggctacgtgagtgtgtggactgtaaagtggtggcaggagtgtgcacctccggtgttaataatcggagagcagctgcgacaagcgtcaggctcacgaagagagggggaaatgcctgaatataaggaggtccagggagctagtgttaaaaactagaagaaaacagatgcccttagtgtctgaccactgggcaggacaggatattccaaacttaaaatgaagagaagaaatcacacatgtgcacacacacccacacacacaccatatgaagtttgaatacaaaggttagtatcctgcatgtggaaagcaaaattaaactttgagcagcagaataaactttacaatagatatgaaggaaaattcgtcagtgtatatgaggaatactaaaatctatcaggaaaatataaaactccccagaggaaaataggagcaaagaggccgggcacagtggctcatgcctgtaatcccagcactttgggaggccaaggcgggcagatcgcatgagctcaggagtttgaaaccagcctaggcaacatggcaaaaccctgtctccatttaaaaaagaaagaaagaaagaaaagatatgagcaaagaactaaaacttcaccaaaatcaataaccaggagaaagaaacgtagatcataatgaagaacaagcaagcggatcccccgacaccacgtttcactgcatcatgactgccagggttccattttgcttcagtgctaacgctcagtgctggggaaacactggtagaataaatgggtttagactttctgaatcagtgcgatgtatcttttaaacaacattaaattagtgtttgctttgatacacgatgtcagtttctcaggcagtttcctaaagaaattacctacgacatggacatggataaacatagcaaaaaaagaaaactccccaactattcctgacagtgctgtttgcaaaagtgaaaaaaatggggaggatgcgatggaatacattcaatgtgtccagatgatagagttttattcatgtagttattttaaatgtttgcaaagactatttttaaatgtggcaaaatgttcaaaatataatgtcaagtgaagaaaactaggttaaaactatacttatagtgccatgtcaactctgcaaatgtctagttatttataggaatagacaagggcaggaaggaaattcccagtggtagtcattaccgctgggtgatggtgtgccttacctgattttatcctttatacttctttgtgttttcctgattctctagagtccagaaaagcatgaattgctctttttacagaatgagtgtgtggagggagatgctgtctgtgatgaacagtccagagttggcccccacagctcttgtctctgattcctgcaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtaagaccccagccctcccataaacgagtggggtcctcactggtcctgccaagagaatgagcactgtcttcttgtggagctctcaaagtctgttccatggaaccccttaagaggtgcaggggttcccaaaccagaacatgtatttcacctaataaggagacacaaacagcctgagacatcggctcatcctctgtacctgttgtatatattaaggatctagggaaggtctcatcgggaaaaaagaaaaagaaagaaattccccctacaaaagttcagaatcactgctctgatgtggagaggagaaatggttttatgaaagtgcagggtgtgggttggaaaggcaggtggctccgtcagggaaacctggggtagatgggctggagcagaggagcggggaggggaggctcggctgcatgcccaccacacaggccaaggcaggtggcagaggtggcccagaaggcaggcagggcacagcatccatgggcattgcccaccactgcccaggccgctctcccacactcagtacagccagttcccagactcctacacttcacggtccagggaaactgtcagtgctggttggaggaatcaatgtactttcccccctttttgttttgtccagaaaaacagctttttaaggaagtgttgtatgtcaccaaaggacaccgtaactgtaaagtgggaaagacgcagttgcttaataaggagttgtctccatggaaactctcaatcttactatagttctctggtttgccacagtcaggcaacagctttgtccaggaccttagcagatcttggtagggaactgccactccacttgaagatacacactggcttcccccatgtggggcctcgcctgtgtccaagagctgggggctggactcaggtagggcccgctcccctattgccgcactagccactggcttcctggggtagcaaacctggaccggaggttcaggctcctatctcagtatcgacagggccgtgctggttctcaactactgagaatcagctgaacacagcgtcgtgtggtgcttacgagacccatgggaaagcctgtcctgaactaaagcctacactttaggtggggagagagacacacacattaaaaggctcccacttggcctgggcaagccagcagagtgacaaggccacgcggtccccggtgacccagaggaggcggggacaggcaggtcagagcaagcccaaggggagaagtacctggtgccagcggggagaaggctgggactggaatgtggggtgctctctaggaaagggggaccaccccagcagaggcagaattgcccagggaacactttggagcctgtgatccccaaaccggctggggaagagagcctgatttgagggggctgggggtttagataagaagattgagccaaaggttgggagcagtgaatgctggagctaaggagttggagccccgaggcagagggggcctttgggagtttttaacagagaaatgcattaagaagggattttagggacccagcaggcagcccttggacggcttggagtcgggggaggcgggaggacagctgtgggcgggagctgccaagctcacgacagtagcagtgatgagatgggagcacggagaccagagagggcagcagcagcaaatgggcagctggagggtcccccgggactaactccgggctggagccagtgatgttcgcgaggaacaggccagctcttgactaaccccagtgaccatgccccagccagagctggcaaggcccccactcacatcagcatccacacagctttgtcccttggcttctgaagactgcagtgggaaagccatgctggctggcaccccgccagcacagcctcaacctccagatacagacctctccagaaaggccagccccagggtcccgctccggccacactttggaaactcaccccaacatggtggttttccactttccttctaaggagcttttcttactgaacactcaatgccgtaaaagcagaagagaaatttcccctgtgtgtgtttgtccaccctgtttgatttgctcctcttcctgacaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggtaattgtgtgactgtgaccagggatcccttggcggggaggttgggtctaatcaactctgacctgagacagctctgctgggcgcctctgtgggccgtggggctggcctcacacttctgcagattggaggccttgggactctcctgacctaggagacagcagcctcaggacagctggttaatgctgcttagacgcgggtgggaccaatgtgcctcacaaagccagtttatgaatttaccaagacaaactgctcctgcctgggaaacatcgtcttattgtaaatatcaccatctgcacagggaaatttgtggagaggtccactcaggggcctagattcagatccagaggttatttggtgaatttgaaaccaaagcaaagcaaagtggttggttacagggataggtttatttcagcacaagcaggccaatctagaagcagagccctccagcccatgaacgttgctggagacacactgttcttccattgctggagacacacagttctgtccttccattgctggagacacactgttctgtccctccgttgctggagacacactgttctgtccctccgttgctggagacacacagttctgtccttccattgctggagacacactgttctgtccttccgttgctggagacacacagttctgtccctccattgctggagacacactgttctgtccctccgttgctggagacacactgttctgtccttccgttgctggagacacacagttctgtccctccattgctggagacacactgttctgtccctccgttgctggagacacactgttctgtccctccgttgctggagacacacagttctgtccttccgttgctggagacacactgttctgtccttccgttgctggagacacactgttctgtccttccgttgctggagacacactgttctgtccctccattgctggagacacactgttctgtccctccgttgctggagacacactgttctgtccctccgttgctggagacacactgttctgtccctccattgctggagacacactgttctgtccctccgttgctggagacacactgctgtgtccctccgttgctggagacacacagttctgtccttccattgctggagacacactgttctgtccctccgttgctggagacacactgctctgtccttccattgctggagacacactgttctgtccctccgttgctggagacacactgttctgtccctccgttgctggagacacactgttctgtccttccgttgctggagacacacagttctgtccttccattgctggagacacactgttctgtccttccattgctggagacacactgttctgtccctccgttgctggagacacacagttctgtccctccattgctggagacacactgctctgtccctccgttgctggagacacactgctctgtccctccgttgctggagacacactgctctgtccctccgtgctggagacacactgctctgtccctccgtgctggagacacactgctctgtccctccgtgctggagacacactgctctgtccctccgtgctggagacacactgttctgtccttccgttgctggagacacattggtcggtccttccattgctggagacacatgggttggtctttccattactagagacatatgagtctgtctttctgttgctggagacaccttgacctctccttccggtgctggcgacattggtctgactttctgcggtcctgtgtcgcatctccatgccaggtgcagtgttactgctgccttcctttccagcgtgctcctctgcctttgtcttgatgggcctgtgggccagtgaacctgcatcatcttcagatttccctcctagccttcctgcctgatctttgtgtgtttccttgttgccaatgtccggtctgaagacaggctgattctggaatgctgtctgttaacagcagaggtcaacagagagaagttgcttagaagatggtgtccccggaaatccctattttaggttcagaatcttctcacttgagttacattgccgaaatgttacggagacgtgagactgaaatgtcccatgcattttattcatgtctaacccagcacttttctcttttcctctgaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggtatgtccctctcttaacatcctccttacctggtcatggtggcatcctccttaccctttcttggtggcataacattgcccagaatgaatttttgaaaacccatgcatccaggaaccctaaagctagacaaaacaaacaaaatgagctaacaaaaactcaaaggctttatccctgcctcaacacactgaccatgtgataagggaataatcctaaccaaaggaaactcttgagaaccaaaatgatggcatcgctaagaaccaaatatgtcatgaaacatattccaccatgattataccgtggtaaacatgaagagggggcggtgaaaagcaggggacaggtgagttcccagagaagggagtaccaccaggcacaggaggacacagctttccaggtggaaggacataacacggtgccagagagaacgtggtccacacatgaggtgggttcaaaccctcacgcggacaggcatctcaagaccccccacgtaaggcccctcgttcattgagtttattactaacaagtcacattttcatgacttctgttcagatgcttttgttctgaaataatcacagtggtctctaaaaacgtaatgactaagagtgtgtgttggtgaggaggtggagaaatgggaaccttcacaggctgccagcaggagtgtaaaacgctgcggccagtgtgccaaacagtttggcagttcattaagaaactaagcatagagttacccagaagttctactcctagatgaagatcattgaaaacataggtacagacaaaaatgtggacacaaatctcatggcagcatcctttatagcagccataattggaaacagcctgaaaatgcatcgactgatgaatggatgagtaaaatatggcagagctgtgcaagggcacattcagtgctgaggaaggatggggctctcagacatggcgcgtgggcgagccttgagaacactatgccacgtgtcgtctgactgcatgtatatgagatgtccccagtaagcaagtttacagaaatgaaaagtggattcgcagtttcctacacttgatcttagccaaaaggccgagaagcgatggattcgcagtttcctaaagctgaagggttaggggagaattagggcatggctgccagcggctccagggtttcattttctgggataaagtgttctcaagttagacggtgctgcttgctcacagctctgtgagtacactaaagttatgtaattgttctgtttactggagcgagttgtagggtatataaattatacatcaataagctgttttggaaaaccttaattactcttcagacttacagcttttacaaattttcagcaaaataaaaattgcaatctagggtgctcattttttttaagatttttactcacacttgtgctttcaaatagtcttcctgttagcagagatttcaggctatttcaggcaaaaaaaaaaaatgacattttaagattaagtaattttcagctccatggtaattatttcctcgagcctccttagggtgaagttaaccatgggggtgtctgtccctccactggtgggcacgctctgtggggtcaggaccaatttatgattttgatcccatcagcctctagcctagtactgaatacacagtaaatgcttagagactgaagctcaattattttcactgagccagatttcacttactcctccagtgagcatggattccggggcatccccagcctgaactagcacagtttcccgcccggcccgcagctctgggcccctcccctcctgcaatttctcagctcctcagaaccccccggagacctcccttccatgcttctcctccctgtgaaggtgcctacaggagggcacggagctggcgcctgcctcacgggccttcctgcttgtgaccgaggtccatcatggtctcatcagagcacacacaacaaaatgaccttctcacaaagcatcctatgggagtcacactggctttgaccgctccctctgcatctgctggcaggcacgtccccctactgtggtgctgtgtgctcagtgacaccagccccaggcccaggaccctggagccacccccaactccaactactccgatggacacaggagaggcttctccggcgcccttggtctctctccaaggcttccctgcttgggggagacgtgcagccctatggctcagggaccaggccttcacctgtgttctcctgcgtggtctggagcccccagaaaatgacagcactctattcccttccaggcagccgaggggaccctgggcccccaggaccacctcctgtcatcctgccaggaatgaaagacattaaaggagagaaaggagatgaagggcctatggggctgaaaggatacctgggcgcaaaaggtgaggcttctgacctgcagccaggggcccctagtccctgccgccccagcccgcaccagctcgtgcccttctccgtccccagagacgcccgtgccctccacctggctttcttcgtgcttttcatctctgggcgccctgtgtgtccatagctggcgcagggttgttctctgatgcctgagtaacctcggtttcccatcttaagatttgcagcactggccgggcgcggtggctcacgcctgtaatcccagcactttgggaggccgaggcgggtggatcacaaggtgaggagatcaagaccatcctggctaacacggtgaaaccccgtctctactaaaaatacaaaaaaattagccggcatggtggtgggcgcctgtagtcccaactacttaggaggctgaggcaggagaatggcgtgaaccggggaggcagagcttgtagtgagccgagattgcgccactgcactccagcctgggcgacagagcgagactccgtctcaaaaaaaaaaaaaaaaaaaaaaaagattcacagcacgtaggacagcaaaatgcatccaggctgcaaaattgaaaactggagggcgggtgctgcgtcctcaccagagtgttacacaccagggtcttcctgcaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccgggtgagtgggcgtcttttactccccttgttctgtgagctcctctcccctttgcttgtgaatggacatgctttggtctggaatttgctagggtgagagtgtcagtggcaggttcagggcagcctcaggcttggtggggtccacacagccctggaaggagctgctgcacttggacaccatgcagatgtgatgtgagtccaaccggctgccgtggcccttctgtgggcttgtgctgggtgaagcatgttgtctgcatttttcatggtggccttgagagaacaaaacttgaattttcagggatcagagctctaaaattgagcacatcagtgacaccaggcctgagagcccatggccgaatcacagcgtagacctgggcccggcagcctggcttcccatccgggccaccgttcactcagcctttgttcagcggatgtctgttgagcacttgacatgggccagacacgctgttgtgatggtaacaatggtgagccctgaccctgggcagggctctcttctccacaccttctccctcagctgcagaatgaaggtagtagctaccttgcagttttcttgagtgctgtatagacagtgtgtataacatagcacagcgtggctccccatagattccgtttcctagaattccatttctagcctcgttcatatgaagatagtgtattctcacagtccctagcacacggctggccttcccagggggatgggcacatttggagcagatcagaaggtctgggccccttgatgtgtttcagtcgcgtccgtgtgaaaagaccaccaaacaggctttgtgtgagcaatcaagctgttaatttcacctgggtgcaggcaggctgagtctgaaaagagagtcagcgaagggagataggggtggggccgttttataggatttgggtaggtaaaggaaaaaggggggttgttctctggcgggcaggagtgggggtcacaaggtgctcagtaggggagcttttgagccaggctgagccaggagaaggaatttcacaagataatgtcatcagttaaggcaggaacaggccattttcacttcttttgtggtggaatgtcatcagttaaggcagaaaccggccatctggatgtgtacgtgcaggtcacaggggatatgattgcttagcttgggctcagaggcctgacagtgtgaacccttagtagcaggccagggcctgcctgtgtgtctgtctggcccaccttggtgtacagaattcttcaggggtcttcctcccctcactcccaaaatctgcagctgagagtatcttctagccagtctgtgtgtgctattcaggtcactttaaaaaagaaagatgccagccaggtgcagtggctcttgcctataatcccagcactttgggaggccaaggcaggcagatcacttgtggtcaggagatcgagactagcctggccaacagggtgaaaccccgtctctaccaaaaatataaaaaattaaccgggtttggtgctgcgcactcataatcccagctactggggaggccgaggcggaagaatcgctggaacccaggaggcggaggttgcagtgagccgagattgcgccgttgcactccagcttgggtgacaaagcaagactccatctcaaaaaaaagacaagaaaaaagaaagatgcctgtttctgccaaagacacctacaacatccaaaggacctttattcataacagctcgaaactaggaaacagcccaaatgtccatcaacagggaaaagaataaatgaacgtggtatattctaaccagacacagcattatctgtgcattttatctccatacacagcaataaatgagaattcttggtaaaatccaacaacctaacttcatttccaaactttatgttgaacaaaataaaccagaaacagaaaagtacacgattcagtttcatcgatgtgaagttcaagaactgacaaggctgttagatggggtatcgggagcacagctgctttaggtggggttgtcatagagtgctgacagtgttctgtgtctttcagtgacacacgagttcagatgcattgagctgtgcgtttaagatgagtggacattactgtatttaagttttgcttcagaaaagtaagctttgagaaagaaaaatagagcattacctaaacaaaggtgcagcctgtggataccctcccccttcctcccacaaaggagcttttgttttgttttgttttgttttttgagacagagtctcactctgtcacccaggctggagtgcaatggcatgatcttagctcactgcaaccactgcctcctggttcaagcgattcccctgccacagcctcccaagtagctgggattacaggcgcacgccaccacgcccagctaattttgtatttttagtagagacagggtttcaccatgttggccaggctggtcttgaactcctgacctcaggcagtccacccacctcggcctcccaaagtgctgggattctaggcctgagccaccacccccggcctagctatattaatactgcagcgactcatgttaggccatgcttgtacattgatgctgtagtactaaagtcccagtggcacccaggtagaccagaactctcatgctccctctggggaggaagccactctggaggggaaaactagggcttccaggaagccaccgagcaactcaggcatcttctcaatttccttaccagccacctgtgtctttctggagaagtctccctctgtgcacagatggaggcgcacagccccatatctgtgttataatctgcagagagcaagctctgcagtctggctgcccaaactgaaatcccggttctgccacttgctggctgagtgaccttaagcaaaacctttctgtgcttcagttcctttgcctgtcattgggaagtaacggtgcctgcctggcagggttttcatgaggcgtgaatacgctcttgagacggggtccaccatgtgcacgcgggaaagcatggtggagcgaggatgtagtcagagtcaccgccgccgctgacatcaccacactgtcgtgatggagacctgggccactgatgctcttcattatgatgcagttgccaagcttgtttcattgtatcacttcacagttccataagaacagcaaggccaggtgcagtggctcacgcctgtaatcccagcactttgggaagcagaggagagagaatcacttgaacccaggagttcaagaccagcctgggcaacagagcaagagcccatctctactaaaaatttaaaaactattagcagccaggcttagtggctcacacctgtaatcccagctgcacaggaggctgagacggaaggatgacttgagcccaggaaatcaaggcaacattgagctatgattgtgcttctgcactccagccagggtgacagactgcgatcctgtctcaaagaaataaataaataaataaacaaaaagaacagctaagcaaaccgcctatgatacacactaaaaaacacgagttttccacaaaatgacaagatcacaaaccttgagtattgtcgttagcatactggatagttaaataagtgagctaacttcagagttacaactgacttcgctaacagccttctaagatggttcatgtctgtctttagggtgacaaaggtgccccagggagagcaggcctgtatggcgagattggcgcgactggtgatttcggtgagtgttgcccgtccagtgaaaacagggagtccacaattcagagctctctgagcatgtgagccaatttcagacctgcaagtgctgttaggtattttaaaacaaattattcttgttaggaatataacaaaatagaagttgcaaaactcacaaagtcccagtggaaagtcctgttcttagccgtcttttttgcatgtaacaggtgacatcggggacactataaatttaccaggaagaccaggcctgaagggggagcggggcaccactggaataccaggtacgcaagttattttccttgtcttcatcttcaacaacagccctgagcctttgtctaggagcccgacttgccaaacagatcaaattcagtaacaaccagaaagcacttgatagtgaatgaggtcttcaagtccaatgtgcaagaaagaccgtcgtttttaattaagttaaatctgaagataaaatcaggaagtctttctctctctctgtctctctctttgatactgaaaaaagccagaatggaccctcggtggatgagaatcactgcagtccataaagtgtaactgatgaaaagccagctagcaccctgactcccggaacacctgagggcgtgcagcaggtggtcgctgacccgagcttctcagaaacagcgaagggtccaggaaagggggagtgggagtcaggccatcgcttgagagagatatggaggcagctgaccagcccgagcgagttgtgggggcctggggcggcacagtgcctcccttcccttctgcacatcactgaggttccactcctaaattcctgcctgcagtgacgtctcaaggggactgtgatagttttcttctttctggggattttcttttggggggaccccacactgctcaagttgctggagccccaggggcttgcagggctggccctggtgggagggaaggagtctgtccagggttggccagtggggagactgctgggccagttctttatctagaaattgctctggaatggaaagacgtgttcagttgagcacaggatcagagaaccgccgctgggaaataggcgcctctgtttaccagccctcccgggctcctttgttatctgtgacctgggctcccggtggcttcctcctgagtgacgggagctctgtactgctgagccatccggcgctgggctggctgtgtctgccaccctaggccattagtccggccatttggtttataaacacagaaacgtggaccatcattaccacgcgtctctaatgatgccttcacttgttcaactgaaaatgtgtcagggaagagacgctacccccacccaagaattatttttgctgttacctttgaacattttggtttttgttaaactctgggcccagaaaggctttggagtggagcctcccctgcatccatcaccagaagacggtatttcggagctgtggtcccacaatggaagggtggggccagctgtacccatcatccctgggggtgtcctgttttccctaagacagtgaggggtgcatgggtacatgggtgctgccttggaagctggctagtgcaggctcagagggaggaagtaggttaaaaatcagctaaggaaggagcacggttggatgcctctctccattcctgaaggagcagcagtgtggttctgcacatcctagagccggggttccagggaacccacaggggcgcggtgtctgtttgttccaagcagcatgtctgtggttgcaggtctgaagggattctttggagagaagggaacagaaggtgacatcggcttccctgggataacaggcgtgactggagtccaaggccctcctggacttaaaggacaaacaggtaaaatctcccgcagccacacagccttcctcaggcaggccctccggagaccccagaacaaaggcggtcaacattgtcaatttcctccaatcacacccaaccctggaagctcactcgtgcctgctgccagcttaggagctttcctcagtgctgatggcatggagagaaacaaccacctgggctggggggagacctgagaattggagagaagcatgggggtgaatgagaagtgcctcttcggttgagcctctgtctctcatatagaagccgacggtttgtaagggatccctttgcttgcattgaatatgcagaaacccctatgaacatcctaggttagagaaggagagcggacagtgggctggcttcccacgctgttgctgctgctgctttctgtgtttactcagcaccggggaatgccaagaggctcatctctccaggcactgcctcagggtcctctccagacgtctatttggataatagggcgacaattaaaactacacgctattttctctctggcaaggctgagcaaatcctattgaatttgtatgtggggtctaagaccacctgcatccccagcttgagggacagttctaatctctcctccaactggcactgcggcccttccggccctcggcccctcccagagcggctgcccctcctgccaggacctcaccacacagcgcccaaggtgtcctgtgtgctcagacttaatgctgtgttcacccccaggctttccagggctgactgggcctccagggtcgcagggagagctggggcggattggactgcctggtggcaaaggagatgatggctggccgggagctccgggcttaccaggtaaggtcacgtaaaacacgtggtcacccagacccagagtcgtgggctgtgcaggaggcaccgctgagcaggccagcctctctcagggcgacttctaaggcccatacgagagcaaaggcaggtctgctgtggcttacggtggtctgcaccaacatagcagcacagggtatactggcgccccaggcaactgggaatcaagccagatgcacaaatctgcccagggcttcacctcccagaaggatgaatgaaagcctcccagagaggcttcagggtccacttgtcatcgccacacagggacgcacagcaagatcagggtgcaggagcagcctcagtgtaccactgtgctgcacgggccacccccggggcctccttacagccccgagacgggccaccctgccatgctcactgcccatgtaacagaaggaattgccacctgtttgctgtgtcctgctttagaaatatttaccctcagaaatccagagggaatggaaatgacaccgggctatttgttccaagcagcttttacaaaccaaacatacagcagtggcgaggcgtcaagaagaggcatgggacatgtcactccccaggccccttctggcctagtgagtctgttaaaaagattctatgaagacagtgttccagttcaatggtgttcctaggtaacataagagtgcttagtttacatgtcgtgtaagttgagcgtgtggcttagctgcttcctatttgtggggctttagcaggattgtatgggtgacagtatcaggtgacagtttcagagccaacaaaacacatctgagttatcttgagggtttctcccacccagaaccccctgtgctgtcccacacatgaaataacaatgagtgacacccccacaggtgaaataacgatgagtgacacccccatgggtgaaataacgatgagtgacacccccatgggtgaaataacgatgagtgacacccccgcaggtgaaataaataacgatgagtgacacccccgcaggtgaaataaataacgatgagtgacacccccgcaggttttccgggactccgtgggatccgcggcttacacggcttgccaggcaccaagggctttccaggatccccaggtactctgtgccgtcccagccccgagtcccacgcagaggtgtcgagggtggggactctgtgctgagtctgccctccagacttcagggaatggagggtctcagagagcagggtgggcttcctgaagtgctatgcgatcggccgtgaggggcgggtccgggccctgtggtcctgtacgctgctaagatgtgatccctaagaatcggtttctcaaggcagttgctgggttgaatggactcatcaggcttttagacggagagagaaatagagtccttgctttttcagcagcaccgttgggagggtgggatgcacctgcgcccctcaggtgtctggagtgttcactctgcccattgcctgtctgtgatctttcattttgttggcctaaggaagccagcggtttccacctgcccctgggcagttctgatgctggagacagtgatagcgcttgggcacccacaggctgggagccaaaaacaaccaaaatgggtttcctcccagttctggaggctgggatcagcatgccagcgtggtcgggttctggggggggccgcgtcctggctgctcgctgtgtcctcacgagggagagcacccgctctcccctgtcacttcttataagggcagtaaccccatcttggggccccaccctcatgacctggcctaaccctaatcacctcccaaaggcccctgctccaaatgccatcacactggagttagggcttccacttaggaactttggggttggggagaatgacacaatcagtccatagcaaggtgaaccaagggcttcttaccacaggaaaaagaaactaacaactttcatagcactttctggcttattttataaactactgtagcacacatttttccctgaatggggatataaagactcattatttccaaaagccaatggcagaataaggtttccatcctgagcccttccagggtataataacagcaactggatgatcctcaaaaggatcatcagactttcccacagaaggcctccctttaaccctgtcctccccaagaagctgagatagcatagtgcaggaaggcttggcagcttcttggaacttctttattttaaattcagctattttcatcctaaattttaatgtccttgtcttttcatttaattttgaaatctattataggactaataaaataacatttgaaggacatcaggcactaagtggggaatcattttattattatgtctttttttcaaaagataaccttgttttcttttcaatttatacaaattatttatgttcagtggagaaaaaaaaattaacacatttaaacacatttaactcgggaggctgaggcagaagaatggcgtgaacccgggaggcggagcttgcagtgagccgagatcgcgccactgcactccagcctgggcaacagagcgagactccgtcttaaaaaaaaaaaaaattaacacatttaagaggaaaaaaagacccataatcctaaagctgcttttagaatgtgctgtttgtagacatttcatataaccaaatattgctctgtctacaggtgaatttgtatgtgtgtatattacacgtaaattcacgcactcctgcgtcattaacactccattacagttccagtgggcgagtggcgggaaatcctcgtcaagttgtcttgctgtttcctgccatgatggcgatgagcacctgataggagaagggggaagactttagatagtgtttactttgaaaacctaattaagcatagcctgaagagaagcccccaggagcctagaggcccgggaggggtcccagctccttgacccactgtttctgtgaatttgaaccctctgatgggcctcgatcctcttatccatagagccaagggcttccactgtgatctctgtaagatcccttccaaatctcagctcctgtgacctggaggccatatattgcaatgcaagctgaaatcaccatggctgcctctgtttctttgcttttgaggcaccccaagctgttctttcacttaggaaagtcaactgtatggttggaaacaccgacatcagctgctgttataactcttccacaggttctgacatccacggagacccaggcttcccaggccctcctggggaaagaggtgacccaggagaggccaacacccttccaggccctgtgggagtcccaggacagaaaggagaccaaggagctccaggtgaggccacacattccaagccaacattgccgtcccagtaaccagaacccacccagaggtggggccatggagtgtctatggggtgggagaggctgtgcagaagtgcaggaaagagctggtttttctggggaggactacctgttgcaggacctctcagctagtcttagtttgttaggcaatttattttatcccatcagtgttagtgaggcactgaccacccatcccgtggagtaactgataagctccctggcctagagaccccatcagatcctctgtgcgcctggggcactggcacaggccttgccataacaagcactctgggtagtgaatgtgcgaataaatgcattaaacctcctagcagagccacgctgacccatacttgggtaggaaatgcccagaaacttgtcttcccaccccatagcctccctgctcaccagccaaggtgggctcaagtctaaatggcagtgagaaacattcctagatagaaaccaggaccttcctgggagccagtctgccaagggtgttgcggtctcattgtgcatgagcccacagccccagagtctgctcctgagatccatgggcccctcccccaccccgcccacctcaccagcctgaccaggggcatctcctggctcaggtacgggagctgggcagcacacctggatggacagcctgggcaccctgggctccatgctggcaacagaaactctggcttccatccacaaaggcctgagtttttctagtgccaattccccatgaagctagaaccagacatccacaggagaggaagtcaggaccaaggaggccagcaaccctggcttttgctggggtgcagggatgtctcgaggcttgcagatcacatctcactctccaggatctgctgcctgccctctcccctcaccagcagctggaaactccagaatcccctagcctcagagctccacagcactgatctgaagataggagaaagaggaggggctctgccaacaggagccagactatcctgggaggctgcatggtgctgccagagccctagtcagggtgaggatccaggacagtccaccagcacagcctcagccagcggtgaggatctagggtcagtccaccagcacagcctcagtcagagttgaggatctagggtcagtccacgagcacagcctcagtcaaggatgaggatctagggtcagtccaccagcacagcctcagtcagagttgaggatctagggtcagtccaccagcacagcctcagccagcggtgaggatctaaggtcagtccaccagcacagcctcagtcaaggatgaggatctagggtcagtccatcagcacagcctcagccagggatgaggatctaaggtcagtccaccagcacagcctcagtcaggggtgaggatctagggtcagtccaccagcacagcctcagtcaggggtgaggatctagggtcagtccaccagcacagcctcagtcggggtgaagatctagggttagcataccagcacagcctcagttggggtgaggatctagggtcagtccaccagcacagcctcagtcaggggtgaggatctagggtcagcacaccagcacaagctccactgaggagtgagaatctaaggtcagtcccaccagcacagcctcagtcaggggtaaggatctaggacagtctaccagcataacctcagccagggatctagggtcagcgcaccagcagaagctccacccaggagtgaggatccaaggtgactccaccagcacaacgtcactcaggggtgaagatctaggtcaatccaccagcacagcctcactcaggggtgaggatctaggtcaatccaccagcacagcctcactcaggggtgaggatctaggtcagtacaccagcacagcttcagccaggattgagggtctagggtcagtccaccagcacaacctccactcaggactgaggatttaggtcaatccaccagcacaacctccactcaggactgaggatctaggtcagtccaccagcacaacctccactcaggactgaggatttaggtcaatccaccagcacaacctccactcaggactgaggatttaggtcagtccaccagcacaacctccactcagggctgaggatttaggtcaatccaccagcacaacctccactcagggctgaggatctaggtcagtccaccagcacaacctccactcaggactgaggatttaggtcaatccactagcacaacctccactcagggctgaggatctaggtcagtccaccagcacagcctcagtcaggggtgaggatctggggtcagtccagcagcacagcctcagtcaggggtgaggatctggggtcagtccagcagcacagcctcagtcaggggtgaggatctggggtcagtccaccagcacagcctcagtcaggggtgaggatctggggtcagtccaccagcacagcctcagtcaggggtgaggatctggggtcagtccaccagcacagcctcagtcaggggtgaggatctggggtcagtccaccagcacagcctcagtcaggggtgaggatctggggtcagtccaccagcataatcctcccaggagcccagcagtagagttgaccatgcccgtgacctttaaatcagacacctgttgggttcttgttctgcgtctcacgtgcaccatattttcaccatgtgaccttggccatggtattgaatgtctctggctttgtctgtcaaatgaaaataaaaatgcacttgtgagtattgggaggatacaatgagatactacaggtaaagctcttgcacacaggaggccagcaataaatgtttgctatctttaaaggccttgaaacatagcgttgttttcagagtgtcatgatgatcagtttaccagtctgtcacctgaaaggcatctgggaatgcagcaacggggaagacttggccaggagatgtggagaggagatcccgcacagggaggggcggaggaaactgagatgggatttcgacagggtgcacacagtggcccatagaggggggtcacagaacacagctgctagcattttgtatgaccatgcattgttaacgtttgattcacacagcatgatgttcaggccctgtacttgaccacaaaaaagatttaagatttccatccccaaggacagagatttatctcatttattttccacttaatacctcagcaaaatgcttgtccctgagtaagtgctcaacaaatacttgctggagaagaatattgtgaaattgtaggataattttctgacatcagtggagagttacgtgtagctcagaacacccctaaggtaacattgatggccttattacacatttgatctgtgtgggacccatttatcaaaactctccgtgacctcctgtggccctccttgcattccatcccagggacctggacggtgtccccggcttccaagccaccgtgcggcatgctgacttttgcaagccatgcccccaccctcgacctgcatgaacgtcacagtgggcccatgagctgatgacttcagagcaggtcctggaggccagggcagacactgcccagtgccattgggccttggcatatgaggccactgcctctggctagtgatgagggaaagacgaccttccatgatgacgttcacacactgatcataatgtcattcaggacacacactcttctctcaaaatatgggaataatttgaatccgtcatcttccttcgcatgagttgcatctcatttgtattagttcgttctcatgctgctatgaagaaataccagagactgggtaatttataaaggaaagaggtttaattgattcacagttctgcatggctggggaggcctcaggaaacttacaatcatggcggaaggggaagcaaacacatccttcttcactggcggcaggagagagaagtgctgagtaaagggtggggggaggccccttataaaactatcagatctcctgggaactcactatcacgagaacagcatgaggatagccacccccgtgattcaattacttcccaccaggtccctcctacgacatgtagggactttgggaactacaagtcgagatttgggtggggacacagccaaaccgtatcacagctcactgaagctagagtctgcaacctcacctatttctgcagctgacattcgagcatcagttcctgatttggccttgagtcatgcaacatgggccttcacggaacccctgttagtgagactcttttatgtcagtacttaggacgatccatgggggctactgagaaatcatagcggtttccgtctagattccagcaaactgactcatgtttgctaagtgttctcattaacagtcctcatcactgcagttaagttaattatgttttcgtgggaatctgccagtctgcggattgcactggatcatctaactcaggagtctgccattatttactgacactcaccatctgtttcgggtactttgtgacaatagctagaagcagttcaattggtgtcattttatatcaaactacagatggtggctcactcatgccctcagggctaatgaacccacttgcatgttgtctgtgatttgtgagacaagcctcacctctctaaatatttatcctgctgtttgttttgtcctacttggaagcacgcatgaatggaatcctttcccctgggatggataatggataccaggatcttccaaagggaaaatctcttcctgctgctgatgcgtgtagattagtcataaagccagaggggaaacagaaaaccactgttgctaccttttctcatttttatagatttgcactgtttcgcccagctcactatttcctgcagagcagaagtgatgccctccttgcccacttggacattctgacattttgcagggttctaatactaatcttggtccccagcccgaggtaaaacaaaaggctgaaggtgcttaggagagaaagtagacttaatccgcccactcaagtccacactgatttctacccaccactgccctacagcacataaagctccattagtgtcttgttggctgacagcacagggaggagtggaatttccacagatttccttatgtggccatttccctcttactctcctactagtgccaaagagctccagcctttgacccaaaaactgttggttctcattattcgcagtagttatgttctgaagtcaccaagaacactgacttagtgaatactgaaccattgctcctaggggaaatacaaggctaagttcctgcaagcctctgctcacaagatgtttgtcaatgatcagtatataagctggttttctgtgtaacggcaccttgtttagtgtggattgctgattcaggaacagtcaacatgcactcactcgtgcctgaatgcagcttctcttacatatgtgtttctccataagggacttcacagccttcttgcacttaccaacagtaggatgcacttcaacacaatacatggggggcatttgaaacagcaaaatcaccagcataaagcacaaaaatgtggaaaacagggcactacagagaccaagacaaggacacgtgtgtacagtatgagctgcagcaagaaggcaggagcgtcaccttgctggatctcagctgggactcattttgcctctgtgtatatctgtgaatgccagtgttgatttgggggggattccaagtgagttttagtgagtggacaaattgggaaacacagaatctgtgaataatgaagaccaactctatccaagctgggatccgaggcactggaggacagccgcagggagggttgacaatagtgatgtcaattgtaagcctcatttgcaatttttcaaccttctgtccatcacctgtgctgaccactgtccacacatatcaggatcagagtctgaccagctgtgcctcgcctggtgctgaggctccatctaagcatgatcgggcagcgccttggggaagtcgagcacaggcagacaggatcccagtggagggctcctcacaggagaaaggctggggtgggggaggggttcacatagcccctgcccccccaaccccgccctgagggcctccccagccccaccatgagatgttccttggcctgagggcacctcccatcactgtctcgctcgctaggctctggtccaccacaggtgatggtgtggagggaaaatagtagatttgaaaagttgggtgctaacgctgaaaataatttcttctgttttcatcctaaggggaacgaggcccacctgggagcccaggacttcaggggttccctggtatcacacccccttccaacatctctggggcacctggtgacaaaggggcgccagggatatttggcctgaaaggtaagcaggacttatacatctgtgcttcgacatctctaggggcaggagctggcaatggcccgcttaatgtagggggagaacagacgttcatttccacgctgtgcccagactccggtcaaagaggcaggagccatgatggctcctcctgtgtcatttccatcacctgcacgacctggtccctgggaagctgagacacaggccatgtcatttacttgctgtaatagcagatattcaaactgcagggggctcagaaatgtgcagtatgaacggctttcttcttcctcactgtattgtgtttagacaagtattaaatttaatttgcacttcctaatcacgaacgagctgaatattggaaagagatggcgtaaagatgaagtcacccgtcaaacaagtgtttgtgcgtcaaggttcacagcagcactactcacaagcaccgagtgctgaaagcaacccgagtgtccatcaacagaggaattaagaagcaaaatgcagtcagtatccacccagtacaagaggagtccgtcttttttgttgggttgttttcttgttttttgttttttgagacagccttgctctgtcgcccaggctggagtgcagtggcacgatcttagctcgctgcaatctccgcctcccgggttcaaggaatttttgtgcctcagcctcctgagtagctgggattacaggtgtccaccaccaagcccagatgatttttgtatttttagtagagacagggtttcaccatgttggccaggctggtctcaaactcttgacctcaagcaatcctcccacctcggcttcccaaagtgctgagacgacaggtgtaagccaccttgcccagcctttattcggtcttaaaaagaaggaactcttatcacctgctaccacctagatgacccttgagggcattctgctgagtgaaagaagccagtcacaaaaggtcggattctgtgattccacacatacgaggcccctgaagtcatcaaattcatagaaacagaaagtacaatggctgttgctgagggttggggggagagggacacggggagtgcgtgtataacggggacagatttcagtttaggatgagaaagttctggagctggtcggcggtgaaggtgaatatattgaatgccactgagcagtgcacctaaaaatgattaaaatggtaacttttatgttctacgtattttacgacaattttttaaaaacatagacaaagtcattccatgccacagacttgccagagactgtcgcctgaatgggtgacggtgcacctgactgcccccaggggccttggggccctgtttaaaccctcctttcttgtccctaatgccaacaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaaggtaacagtgcccatggccatgggccagcagccctggccacagtgagaggagccccctccccacagactttcgtgtccctaacgtcttgtttgtgttgcagggcccaggggtgaacaaggcttcatggggaacactggacccactggggcggtgggcgacagaggccccaagggacccaagggagacccaggattccctggtaagtgaccgtctggtatcttcagagctagtggctcagcccagcctctccaggcttggggacatcctggaggtcaaacggccaggatcctctctggcatgggtcacatgttgtaaagagcagggaggaaaccaaggctgtgcctcggatgttgtcacaggaccttggggaatggagagcttaatattcaaacggcaggcgctgagtcacggctcaggcccgttagtgtctggctcatctctagaaagcacagttgtctgggaagctccaaaagaagcctccctggtgagaaacgcagtagcactcggagcaagagagtggaacgaccttgtgtgtttactggggcctctctgtttcccttccaggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggtagagtgctgagctggggcctggagcccctcggggctgcccgggcaaggccagggcctgctggcattgcgtcctcttgtgttctctttgtggatcgccggccgtgccaggcgtggtcagtttccagccataacgcttctttggtggcttgcaggtttccgtggggctccagggaaagctgggccccaaggaagaggtggtgtgtctgctgttcccggcttccggggagatgaaggacccataggccaccaggggccgattggccaagaaggtgagtgacagtggggaaggaccttcccaggtcctagtgctctggatctgactcacagactgtggtctgcaggaaggggacacacgagagcccagaaaagccagaaatgaggcgctgccccaccctcctgctcctaatctgggcgtagcagctacactcctatgcccagcagaacacctggccccgagtcctgggacagcctccctccttttcctgggacacctgcggtgctgtggagtgggcggcagggatcagtagacttcaagggtcaggattagacaaggagccaaaagaaaccgactattaaaatgtacaagagccgcactgcgaagccctgtcttacttttttttcttttttggacagagtctcgctctgtctcacccaggctggagtgcagtggcgcaatctcagctcactgcagcttctgcctcccgggttcaagcgattctcctgtcttagcctcccaagtagttgggactacaggcatgtgcccccatacccagctaacttttttgtatttgtagtagagacggggtttcaccatgttggccaggctggtctcgaactcctgacctcgagcgatccgccagccttggcctcccaaagtgctgggattacaggtgtaagtcaccgtgcctggtcgtcttattttttaaaattatttgcacatatacagaatgaaataggccaggaataacagctattcatgaaaaaaaaaaacctcaaaatttgtcttaatcaacctgagctcagtttgagccaatggtctgagcattaaaattaaaattaaaattaaacataggggccgggcgcggtggctcacgcctgtaatcccagcactttgggaggctgaggtgggcggatcacaagggcaggagatcgagaccatcctggctaacacggtgaaaccccgtctctactaaaaatacaaaaaattagccgggcgtggtggcgggcgccagtagtcccagctactcgggaggctgaggcaggagaatggcctcaacccaggaggtggaggttgcaatgagccaagatcgcgccactgcactccagcctgggggacagagcgagactccgtctcaaaaaaaaaaaagaaaattaaacatgggtagtactattggtgtccaagtcaaaggaaatagcagtcccctgcccctggggacagatccgcagccggcaaattatgggtagtgtggggtgcacctgaaaacaaatgccagcaaatgggagcccgcccagggtaggagacaagctagggatggtggaggggaagtgtcctgggagaaagggccatgaccatgggtgtcccttggaaggggaggggacaatgggagaaagggtcactggggatagctgagaaatattcacagagctgctgtgctggaggcagatgagccacccccgtgtgctcctcgggtaggagttacaggaggctgcacgcagaaagaacattctaacccaggctgtggtcaagtgcgcagtcagcatggcctgcgatgagccatgtctcctggaagtgtccagcggagggaggccactgctgggggtgggggctggcctgcgatactcctccggacacttccaacgccaggcacgttgggcacatcctgaggggcacatgcctacctatggctgactgagtcttttatggaaaggacccctcctctgtgcccagtgccctcactgccatcatttcatgctactgagaacaaagtgtggatcaaatccttcccaagagtctcctgatctcaacagactgagccccaagatctggggaaggagagcgatggttctaggcgcacctggaaactgccctgcactcctgggtcccgaggtttctgtggggcggctgtcaagggggctgctctctctctctttctcaggctgcaggtgcactaggccgtccactctctctctctctcaggctgcaggtgcaccaggccgtccactcactctctctctcgggctgcaggtacaccaggccgtccactctctctctctctctctctctcgggctgcaggtgcaccaggccgtccactctctctctctctctcaggctgtaggtgcaccaggccgtccactctctctctttctcgggctgcaggtgcaccaggccgtccactctctctctttctcgggctgcaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctgggtaggtacctcccacccggcccccgttgcctgctcagggctggcccggaagtggccaagatcaaagggccacagcgagactcccaaaccctccacggctggtaagttcccctgacggaagggtccatctacattcctcgagtgcagaaagattaaaacggcctttgaagcagaagccttacaaagcccttaaacctcaggaccttaacacagggacctgccttttaacctggtattgacttccgcaggctcccatgtgacccgtctgacccccgacccctctccagtggagaccaccaattacttcacctccttcttgtttttgacccaagttctgtagacttggagtcaggcaggggccatgaggggctggggttcatgtaagactctcccatacagccccccgaggaaaatggacccatggacacgtgtgcatgctcttatttaaggaagcctttgaaaggcattaacgcgacttcgaatacagaaaatgcaatacacacaaattacaagtggaggtagcttagtctgaggtcctctttgagggggtgacgggaagggtctctgggatactggctgtgttctgcctcctcggtgcaggttacatcaggcgttctgcccccgggaagcatgttgctggctcatggtgccttcacattcctgcctgtgcgccccgcctccacaatgagtttctaaagaacaacggggcaaaggccgccaaggataagggccaaaaatagatctaggaacagggccaaggaggcagcctagcaccgggcatgtttgctaaaggtggctgcacttctgggtctgagcttttcagcaatccatgtgaagagggaaacctgcttagctgcagcattcgttgtggccaggagataaaggctatcttagtctccagaagcaataaagctacatggaagggagaagggccaggactccttctggggtggctccttggggtcaaagagcgaccccttggaggccatcagagttttcttggggccagtgctgttaagaccccactaaggtaaggctcacccaaaatgctattccatgaagacgccactccctggtgatccaacttggcccagtatgtgtgagaacttgtagaagaacagagctgttccaaaatgccagtggagtctgatcaaaaagagaaaaagaaagaaattgggaagccttagcctggccctccagtaggtggctaaactccaccaggtgccctggggcgagtccgtgacacacagcctcctgggcctggctggggctggcaggtgcgtcttctagccacactgcactgtgatctcatgacccctccttccacagggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatggtatgtggtatttgcccagttcccctccccaaccacaccctgctggggacacagcaagaacagctgcctttgtgagaagaatcagacacggcagtccagggtgtgcactgcacaagggtagttggcccaggaagcgagcgagagctggaacacagcttacacttggctaactgagccacatgctgggcacagggcttcctccacccagaaagggctcattaatttgccaccaggcctttgtaaggagtgtaaccaggacgaacttgcctgttatccgtcttactaggtacaacaccaacaccaaaggtgcagctgctttgggtttaccagaagtctaaatatatgggagacttttctctagaatcctgatcttatttagaatctatctggaacctagaataccctgaagaaatacctattaactggctggcttaaaatggatatatattcgtgaggaaaattctggaatacctttgggtataaaatagagagcctgtggatactttgaaagccaggagaaggtgcacaaccaggacctgggaaggcaccgcccacccttccggatcgcctttgggtataaaatagagaaccctcagctttggccagattaggtttagcttaacctccaggggagagaccacagcaccatagtgtctcttgcaatattgcctattaaagcagaggctcctcaacttggaatagggtcccgtcccgataaattcattgtaagatgaagatactataagttgaaagtgcgttttcaatttatgatgggtttatctggatgtaaccccaccaaaaatcaaatagtgaattgaatacatattgcttttgcaccatcgaaaactcaaaaatcctaagtctaaccatggtaaatcagggaccatctgtatactattgtagggagaaaagaaagtctcactgaggacagtgggtcttccagtgagtttatttatatgcattataactgtcataactccagctatatggattggatgcccagcatgttaaatatttcataaattatatatatatatatatatatatatacacacacacacacacacacacacacaacataaaatataaattacatagtgattgctaatctttcaaaacaacaggaaaaaaaatccggattctaggaaaggaaggaaaagataaacaagtattggcattttaataggtatcgttgctatgataagttggagcaacaggatgctaaatcctgggcagggacaggcacaatttctacctttccagaagcttatcatggaaggtgactttggagcaaccttcttttgtttcacagtgaccttcagggtgcccctgtgtcaggaagtaagctttggttgctcctgtttttttcactcccgttgttaaattcaaaataaatgagcctctcccttgtgaagggcatgattacacagtatccagaaaggtcaggcatcccctgttccattagcatcaggtttcaaatgactgtcacgagataagcagacattatcctctgcacacgtaactctctgcttacataaatggctgacagccccagcaagcctggaacttgacatccccaaaaggcatgggttgagacggctcctgggtcaggacagatgggccagaagtaccttgacttctgagaacagaaagtccccattgtccctgacaatggataagtgagcagacacatctgtgtactggagatgtgccccctccagatgtgccctgactgccgtctaggaggcaggacctaaaccaagacagctgtgtgcctcgtctgcactttaaatactctttgatcccttctgtgtggtgacaagcatatggtaccactagggctgctggcatctcagcataataagagctgactttggagaggagaggacagcttggctgagagcaactgccccaccgtccccagtgggtacgcagaaggcgagagcagtgctgaggctagcgcctggctcacccttcttttgtccgtgaggatgggtggccccagaggatgcattttctgcattccctacaagcgagcgccacgtgggagggaggacaagggcagagccccggatgcagactgcagcagcaaaagtcattttcctcccctcccctcggtggcctctctcaaagctgctctggcagaggctacaagtatctagccagccgttattttagttcctcttttttcaattctggctactatctggagccctcacagccccttctccaggtcagcctctcgtccaggcaattctcttaagatacatgagctgctatgagtaccaagccagaggtttgtccactgagagaagcacattggaaagggtgcgtgtgcctggactgtgtgcacttatgcacgtgtgtgcataggggtgtgtacacaagcatgcactgtgtgtgtgtgtgtgtacatgcgtgcatttgtgtgtgtgcatgagtgtacaccatgtgtgtgcatgtgtgcatgtatgcatgtgtgtgtgcgcagcaaactcagctcttacctggctggtgccagcctctaagacttctcacattgtgctcccttctgacctcgttctgggagtcccaggtgtctcctttgggcagctcccagcatggcctcagctccttcagaccaaagtgaagccggaggtgccctggaggacgtctccacttcttattacctgctcattagcagacaagagcaggcagctcagggctggacaggcttctgccttatgtgagcagaacactttttaaaggtttttgggtttttttttgtatttaaaggaaagcttaaactggggcccctgcccaaatatatcatagaacagccccttttttccctgcaaactgaactgagatatttctattctaagtaaacagattccaaagcccacttaccactcaaagcctgctcagccaagccaaatggcccttatacaccaactctgggatccaggaggcctgccgtgcgcttccataaaggctaaacatgttgatgcaacagaaagtagaactttaaaatgaaaaaaaaaaaaaggcttccttgaagacctcagccatctcccagccagcctcagaatcaactatttaacaacctctgattgaaaaaatatatatttaattacacaagtaatacatatttattgtgaaaaatcagcaagtacagatttaaaaaaaaaaataaaaccactcatctttcctccctgatcatcagcattttcagagaaggagctgggaggcctggctgggtgattatttttaacttattagcctcagatgccagcctacatcttaattttatttttttcttctaaaaagagtaaacattgtgttatctcttctgccaggtatttttctttgaatggatgattaggcagatgttttgttttgttactgaaatgcagtggattatatctaccgctcgtatctgctgtcacggctctagttcttaccgaacggccagcctggctgtgaattagtgtccatgcagctgcctctgcagcacgtcctggtgcctggggctgcctcctgcagggggcccatgtgtatttcaccagccccctcttgctgaaggcgcattcgcgaggatgcctcatgtccgtattgacactcatggtttgctgttcagtaaaaacaaatgcacagaagagggctatgccctgaccccgtgccacctgcaggctgtgattcctaaccctgtcctgcccccctctctgtgcagcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaa

SEQ ID NO: 1579 - DNA, 178274 bp, Homo sapiens
gcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcaggtaagcacctgggaagggggcgcggggctccgaggggccaggcgtgcgggcccctggttagcggctgctacccaacctcttcctcccgccgcggccccacacccgtgctgggcgaggccaggggctctgtagctctcggacggcaatgatcacctcctgggagccacctcgcccgggcgcgccaagttaacaaagtgctgggcggcgtgcggcggcggcggcggcatcatcccgctcaggaaagtggccatgttccggcattcgcacccggcctgttggggtggcttcgggcacctgctggcgggggaacgggcgcggcgtgaggcaccccccgccagcccggggcccgcgtatcccggtggggtcgttctcggctctcacagggttaagccgcccgcaccagcccagagcccctgagcgcacggagtcgcggaaatggatcaaaccgaacccacctaggcttttttttctttttcttccccgctgcctctgaagagagagaagtttatttcgtgttgcggcccttttagatgtgaatctctaggttgattttagtgtcgtcattcttcagctattacatctggtttgtttgtggcagacagggggaaccgagtggggaagcgcgtgttatactccggccgaaagctgtggggcgctcagtcctgcgtccagtggttaaattggtaaatgagttgggaagacgacccatccaaagtcttatttaaagttaccaaaaataagcaaagcggacacagtctgttccctttggaagggtatccaccgcgcggcatgtgcgagttcagtttcaagttacttgccaatataacccgtgcacttcagaaattgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggcacggagagattaattagcttgcccaagatcacacagctgcaagctgagatttgaacaggtagcctttgtagcccaggctcccagccactgagttgtcttgcctcttaggaatctgttgcctactgtttaggctgccatttgcttatggaaagatctgatgtaaaatatagagcagtgatcctcaacctttttggtaccagggactggtttcctggaagacagtttttccacagacaggggtggggatggggggagtcgggggtttcgggggatggtttggggatgaagctgttccacctcagatcatcaggcgttagattctcataaggaccatgcagcctagatccctggcatgcgcagttcacaataaggttcgtgctcctatgagaatctaatgctgctgctgatctgacaggaggtggagctcaggcggtaatgcttgctgacctgctatgccactcacctcctgctgtgtggcctggttcctaacaggtccatggccctggggttggttgccccctgtatagagcatgttgctctctggtaccttagcttatgactaaaggaacttttattttgaagccataatgaatatggtcctttttctgaaacatttactgctagagatttatacccttcccagaatgtctttgagctcatttcagagctaaacattataatgaaaaccattgtgtagtccagcatccagaacttgagttgattcttttttttttcactgcttctaacttattcttaataataccaaacatagcaaaaggaggttgcaatacatttgtttggcaagtttgggtattgaattcttgagttttagtagagccaagcaggtcggtcactatgtgtcattttttggtatctagtagaacggtttatttagataggtattgggttcctctaaattgcccatttagttggtttcagttgatacggaaccttcactaggctttaggtctatcttgtaaacaagatatttttaaagaccatcctagattgagagcaatctatttgttgtttttttggagagcgggggtttgttctttttctcttctctcacaactctggtgttttccaccatttggctggactctggggcaagagtgggctggccgagggtgctccagtttctctcaccccggaacagctgcctgcctctaagatattctttggaagtctatcctgaagcactccgaagccttgcttctgcttctgggaggaattccttggaggactagaggcaacagggggcctaatctgttgaaacttgtgtgtatatttcagggttaataaatctcagctaagaaaattaataaaaattccactgtgaatgagaggttggtcagagactaatgtcttgaaaatgctttatgataacttggaagaatttgagcagatggaaaggagaaactttgttaaggtctccctgaaattagtcatcacttcttacaagcagatttcacaaggtgcttactatctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaagtgaagttaaaactttatctttttgcctatgtaacatttatcaagtgagaaagtgagaatgcctttaaataagcatttgattgaaagccattagaaggtgagaacttgtatacctttttttttttttctttgggatagggttttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgctcccagttgccttttgtgttttttttttttaacttactgtaatacacatacagaaatgtgcttacatactttacatcagtagtacttaagagtccagcatagtagatgttattaatgaaagttgactcatggcaatacatataactaggactttgattccccagtttttttcttgctttcataaatctgtaaatcttacttaagaatgacatataaggaaaatatgatctccttccccttccttgagtgcagtctatttataaacaatagcacttggtgctggggtttgttcacgtttgtatgagggagattgtcttattttctgggatataatgcggagatctgtgctttttgggaagtgatggaacgttgatagtgcatccagcatttaggaatgcaagaacaaacattagagccttttgaggatggtgtcctctaactcctcttcagtccaacagccctgtgggtctcttcctgatcagcatttttcactaagacccaaacttatttcctgtaaaccaactgggccagatactcatgactgtctgtggtctgaagatagtagtttatgttttgttttttgttttttttaaattgaattgggtgtgttgttcccagatgaacactgttatcagggcctaaacaaatatttttgtcagggagatgtcacaattgtattattggaaggggattttctctcttagcttttaatttgcattaagaggtgtctgggctgtgggcaaaatagtggctaaaatgaccacttttatttgtttttgagtcagctattgctttttgtgataactgaaaactttagtcttttttgaaggactgaagtgttgagagtttcctggaatgagtggttcactagctgttgctgatcacctggtttattcttagctttttttgcattcaggagtcttagttttcccttgttctccaacttctgtaatctttaagaaaatgaaaggatatttagcagctctgatgacctgtatttgctggattgtaaaggccttattgcattttttatcccttctgtcttggtaaaagttcctgatagcagcagcttttataaaagtttgagcagaactaaggcaaggaggaagaactctaaaatagtgatttttgcttctcagttgttattagtaggttaatcaggagaggaagtaggacattttaactaaaatgggtttctgtttcagttatcaagccaagctgctatttttaagtttgaaaccatttttaaattcagacaggtttgaggattaattgtactgaaatggagctcacatctagtgctttagtgagtatagctaaatgtgcctataatagggaggaagtaaatcatttggtttgatgaactctgtcacttgaggtcatatcatagcttttctgaaagagtgccctgtttaaggtaattatattttatgcagacaggtggatagtaggtatctagtatatatcttttttttttttgagacggagtctcactatgttggcagactggagtgcagtggtgcaatctcagctcactgcaatctccacctcccgggttcaagcgattctcctgcctcagcctcccgagtagctgggattacaggcacaagccaccatgcccagctaatttttgtatttttagtagagacggggtttcaccatgttggccaggatggtctcgatctcctgatctcgtgatctgcccgccttgacctcccaacatgttgggattacaggcgtgagcctctgcgcctggttggtatctcttaaatatcttaatgttaaatttctaaatctaacatactgttttctaaagaagagaaagtactttagtttaaaactggacatactctaccatttgctgcctctatccaggctttgtaacctctttgctgttgacattttgggccagagaattctttcgtgttaagggctgtcctgtgcgttgtagggtgtctagcagcatccttgctgtctacccgatatctgccaacatcactgttctctctctgtacccctagttgtaggaaccaacaatgtctccagacactgctctcaatatcctctgggagtgggaatcatccctgttgaaactgtgttggctgtggcctcttctttatacccagtacatgtcgttagcacttctgtgttttaggaaggattgatcaaaaggccgaagctcaaaaagccaattagcattttttgatgggtgaactctattctttctcaggatgcctgaaattcacttacacatttaggattctagattgtagtatgttacaaaaaatttcaaggatagattatgttcataggtaagttgaaggaaaaaatggaagattcttataatggaacgtaaaaaaattcttttccaattggacgtgtgtattctgagaaaaacattagggtcaggtcattgtaaatagatcatcttttactttcttccagctgaattacaggttggcacttatccagatttattcctcttagcataggaagataagatatattgattaataaggtagtataaaaattgtctgcaaaaatgttttgaaatgtctgcagttttctcaggcagactgtttacttttcagtgtattgtttttatttctgttaattttgatgattctggttacaacattttaaatatcttcttgagatgagaaaaagcagggaaagaaactggaaaataaggagagtggatagagactttcctcctgatcatttcattttgtcctctaaatagcattttttacgaaagtggggtggaggtgggaggttagggaaagaatgaagttcttgacaaataatcttccttcttttgtctccaaggcctctggttttgaactctgctgagtcagctaactatgagtgaaatctgtctgccacctgtctttatagggccatgtgctaagaatggtttttacatttttaagtggtttaataatgtttcatgacatagccatggtcattcatctaccaattgtctctgaccactttcacacaacagtggcatagtttagtagttaagacagaaactggctcacaaaacctaaaatatttactctctggcccttttcagagtttgccaatccctagtttaaactatatttctctattgttaatattggaggcaaatagtattgttagatctgttaaagtagatgtgagttaattaaagacaaacaaaattctcgtaaattggttattagataagcattggtcaaactttgtgtttttagagagtggtttaaaacttgtgttatctacatgtttcatagatttccaggtatccttggggaactttgatgctagagcatcgacatgcttgatgagtttgtttctcttctttcacctgaaggttttgcactgtaggactgctctgggaaggaaggttctgggccatgaactaggcaaaattgatccatagcttcaagactgaaaaccatgactttatgactttttggatctgctgtaattcacagatgggcttaattctgagcccagtctgattgcttgggttagttagtcctgagaagggagagctcaggtataggtatcttcttcataagctgtaaatagaagatggaactcagccggtctctgggatcctgagcgttgctcagcttggaggcagggtactttcaggttgtcagcagaggtactggcctgctcttctgcttatcaaagagcagttcttgctaattttcatcattttcttcacttttaaagattatatgtcactttctttgctgtgttgctgtgacacaggctaacaccccatttgtgtcctcacagattttagtatcatctttaaattgcagtatactgagtccgaacaaaatgggggtaatgcgtctcatcgagtagtattaaggttagtgttaagtagagttttttaagtatttgtttttttgcatttaaaaatgtatgcatttgtgtatttttcacatgtaaatggatttaccactggcctcctttgcaggtggtgcctttggaagtccagagaaattaaatgctttttccaagagcagagaagactctaaatttgaccctgtcctatgttcttgctggtgcacttcattggcttcagtgaggagtccggagagctgggactttaccaatgattttttttttcttttaaacatgtaaaaggtataaatgcacatagaaataattcaaatgacatagaaaggtacacattgacaatagaatccctctcccttttttccccatctttagtccactcttctctgagtcccacttctgaccatttctttatgttccatgtgtggttccttctttaaatatatgcatatacctctgttttgatttttgtttcaattttgagctattgtttccctttataagagatgaagaatttaactcaataccccctactcttcccagtttttaaaaaagttttgtattcaatttctgtttgatatacattaacagctttcaatgatgtaattgcatttgttttcttgattcatcaactttaggcctaaagtgactccccactctgtcagtcaaggaatttggtacttctcagccttctcccactcaatttctcttccttctcatttctcaccctccctcagccatcagtttttttacatcaacataccttatatcatctacatttcattctgtgactgaatgtgttatgtactctgactataggttggttacaaaaattgaaaaccagtaaacaaggatacggaattttaggtaggaggaataagttcaagagatctattgtacaacatactgattataattaataataaagcatgtagttttgaaaattgcaaagagtagattttaagtgttctcaccacaaaaaagaataaataagtgatgtaatgcatatgttaattagcttgatttagcattctacaatgtatgcatttttcaaaatgatatacttgataaatatatacaatttttatttgtcagttagagctcgtttggaggttccagcaggggagtgcagctccttgtatacccttgaccgaagacccgtcctccatcagggatggtcatcctctacgactgagcatgcagcttcaggaggggctcacatagagtggtgagggaggaaggggacacccgcctagccagccagatcagccgaatcaaccctggcgatcaatggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgatatgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggtttttttttttttttttggtcgttcacaattactgtttcctcaaactgccatgcttcttctagaactgatagtgctttgtttcctttgtgatgagaagcctttcccttcagggtgaggacttcggggctgaagatgtactttgcagcagttcccttctgtttcttcataccacagatgtagaggaatgtggcatttatgggtcctggccttggtggtaacattttacctgtagagcatcggaacattgaagactgagaatgtgaatcattcttagaatcattttctacataaagtcctgaattggtgtttttagaatccagtgaagcagtcattcttttaacagtcaccagcattccagaaaagtcatgaaaaattcaggcacagaattgtagagtaggctgggtccttccaggtcaggtaatttttagtctttgatttttcagataagggcaccgagtcacacataaactagacctcagcaatttgcccagtcacaggatacctgggacatgcatcctgacttataattcactggccttccactgtactatacccatatccaacatatatttgaaaatttactgggttaggtaatatggaaattgtggtagacatatgttacttgttttgaaagaactttttagttatttagggaaacaaaactgccgtttgtgaaactattagagccagttaagtgctattattcattagaagttaaagaggttagaatgttgcctggcatatagtaagtgctcagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggctttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacagaacataaattgtgtgtgtgtgtgtgtgtgtgtgtgtgtgtgtgtgtctgtgtgtgtagggaggatgggcagcccggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataattgttttaaacaaaagagatttgagaagaactccagaaatttgtatccttaactcatctttgataaccaatggtatgatatttagaagtttgctattaatgtatttttatgtattatgttatgtcttactactgcatttgttgcttctgtgtctcaccttgcccttgtagaccagttgttacagatggatttttataaagaaaggcaataggaaagaatttgtaaaactttagagtctgtagtgcttgtataaagagtagtttggaaattcagaatttataataattcagatgagacttgcctaaatacctgtcccctgtcaataagaaatagaagggacttattcaggagatgattagtataaataaggttgaaggggggttgattatctacttaatacaaccctgccttcagaggctttccaaaactatttctgtatgaaaaacgatctcagacatgtcagttgcatttattttaataggccaacactgtttaggttgattactgacaattattttctttttgttttgaaattgtttgtcaaaattacttgtttaaaattataagatgttgacagaacttttgttagcatatcctaacatgcaatacatggcattaattcatggtaaatgtgtttaggtagtgtgaatggatagtgcctagtaaccttgtgtacaaagataagcatttgtcaaacatgtaagacagattaccaacatagaccagcaaccattgcctatatgatgtgttaacaacatgaccctgtttagctagctgagaattgttaaggcctgaaagcatatcacatgaaccttcatgcaagttcttgggtgggatacactgttgacagattctgtcagagtgctaagcataagaatataaattaaaaataagttttagaagtaaagtcggtgtggtttttaaaaaaaaatcctgcaaagaatagtgttccatagaacagattgggaagtgctgaattaaagaaagagttctgttagtcaacagttaatatgtttagtgccacttaattgcagttattaaatggatttgtaagtaataaaactgcattttattaaaattttataatctacacattttgccctagttatacacccttcttccactcacttttaagtggttatctgttttgcatagtctcattttatgtaatagcttgatgtctaaaatgttgcctcaacaggaggtagtttctgtgcagccatattgggctggtgcagatagggccatatggttctaatctaaacatacatctggaaactcatagggtggagctggtgctgtctcctggaacctgtagaaaacgtcagcaactggagtcctgaccacatttttggaggagggtggtgagggaatgagatgctattatttgaggtcagggcttggatcctgtgtagtgattctggcagctactaagttggtggcccagctgcagtagtcatgagtcccttgagtgctctgccagaacaagggatgttgggcttggagtcccagcttttcccttcacagtcatttggcactcttacctgcatctgagcagcctctgttactgtcatacctaggcaggtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacagccccagttcacactctttttggcctcagcactacacatcttaaggggtggagtgggcgcttggagggttacctgtcattttatcaagcccaaaagccttcctgttaagttccagagatctgactaaaggcagggtttttctgtagagattgaatagtggttgactgaccagggactgcagcaataacgatgacacccctgctggaaatacagactctcttttaccaaatcgcagttcctatatttagctttaatgcggcgcttcttaactggggatgtgtgagaatcgcctggtgagccattttaaattataaaaggcagatctctgcgcttttctaggtaatcccatttgttcccattgcttgaaattcatatttattctggccactcaagtttatatatttagccctgacttctctcttgagttccagacttgcatgttcactgacaccaccattcagctatctaatagtttcagaatataacatttgcccttctgtctcctccccagtaactggcttgtgggcctgttcctctaaaatgccacccataatcctcccccttgccctagcaaaaaactcaatgccaattttttttcctttcctgcccctcccattcctaactcatctttcttgtcattctttcatgttccttcccttcctgtccaagctaccatggcttttacctggcaaactgcagtcttttactccatatgccctactgtggctccagaatggcttaaaattttttaattgattgattctaaaactcagtctaagataaagatgttgatgctgctttttctgaaaattactttgaaccataaagggtgactctgtcttttcttaactcctttattcaaagttaggtgtagagccttgttagaccaaattatgcccctggaagacagtttatgaggttgcacggcctcaccctccattgcttgggctcacagctccttagggtcatggctctccagctctgatgatggagatttgggcaagaatttctctaaaaaggactaagcataagaatataagctttatttttgtagggccaactatttgctaagtatattagtttcttattgctgctatcaccacaaacttagtggcgtaaaacaagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttcctcttttccttatgattacattgggcctactcagatattctagggttttcttcccatctgcaaagccttaaaattaattacatcagtgaaattccttttgtcatgtaaggcaaggtattcacagatttcagggattattaggacagggatatctttgactaaacattattctgcttactgcaccaggcgctatttaaatttacttgcatatactaactaatcctcataacaaccctatgagttaggtattattctccccattttacagatgaggaaactgcagcacagagaagttatgtaactttgaacttgcccagagttacatagccagtaagtagtggtgccagaattcaaattttggttggcttcagagtctgttcttaattatgacacatactatctggaggtgcatattgtagtacccttcaaagtgatttttcaaaagccatacttttactatgtagcagcagctgcaataatactttcttcactgcttacttgttggcaggtcctgtgctaaattctttcacagccagtccaagcaatggatattagtatctgcattttgcccatagaaactgaggcccaggattaagttacttccccaagatcacatggccaataagtgcggaaactagtattggaagccagatagcctgaacaggagccaatgcttagccattaagctgaattgcttccacctttatctggtgaaggatgtcattaaagataaaggtaatctttgctcttacatggtgggcacatttgatgacataatcagagtccagaaagaacttgatgtgttggagtgatatgttgaatctaacacaattagatttgaaggaaaaaaaaaacataaatgaaaggtggtatagatcctaagtttcagatacatgcatacactttggggtaaagttttgtttcttttgaatgctgctatcggtgggtatattataaacatatatatcttctacagctcttataactagaaacttgatttggttgagtgcagatcttatatcactaccatgataggaaatagtccagaattatcttggggttctttttccaaacttccttcactccccacaagaggtgaaaataatagtctcttgagccaggttagtgatggtagtgaaaatggaaaacttttgattggactgtacagaatccataatctttgctctagaaagggagccacatattgtattctattcaccaggtcatggttgtcatcctgtggccaacgtgggtcccattctatgttatttcccaaacagcccatgaaaaccaccctattaattagctctttccttcccattcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagcaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcagtccttactgactgtggtgtacaatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgccttttaattccatctgggctcccagttgattggatggtgactaccacatttagggcacatcttctccacttagtccactcacacaccgtctcctctggaaacactctcacagatacacctggggcagctcaataattctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcacaggagggtggaagcacagagtttgacttttttagatgtatatagcatataataaatattaagttcaaccttacgaaattggtgatatttgactatgttttacctatgagaatggcattttcgtatagtttgatctaatagaacatgttacattactgagaatgagttgcttttagaagtggaacttgattgagcaatattgagagggtttaatcaaaagggcaaagaacaaagccttggagcagttgagataaatgggattgttgctcggcagagggttggcctttgaagcagggagaaggaaaggcacacagttttccaggaaggcaggagaagatacacagattcagccatgctggaaggatcacagtgaggccaataccagcgggtagtgtcctatttgaggcaaataattatgtaataaatttacggatttagctgtagatacacattgattgattttgttcataggactgagtggtaactgagcctgttctaccttgtggtagactctaaatttgttctctcaaaggtatttgatatgtgattttttgcttggtttttctctttcactaaaagcggagtaaatcaaatatcatgacctccttccccactcctgagcggtgcaatgctgtggcctccctgtagaactgattagcaaatcaaagaataaagtagttttctcataagtgattttcttgccctacagaaaattgtctttttcaatgttactataagtattctttgacttctcagcataattgaagcattatctatgatttctgtttctttaatgcagactacaagtgcatccttttaaggtcattccactcttctctgtcacatgtacagaatttgcttatgagggtgttcatttcaagaatttcacctgtttggagggagactttattccaccgcataatataattttaaaaatgatgttctttagaccattgtgtgcatatatccctaggccataattttctccatgtacttaattcagtacagaattccaggtactgatcattaatgatatctttaaagctaaatgagattgaaagtcatctttaatggctgtaggatccttttttcatgaactaactcctctagctaatgtttattttgaataatactcttatccatggattatgggaccaaagccataataaaaatattcccaggaagggttgtcttcttattcagtgtgtacttgttgagctataggcagttttgctgtgtatatggctctaaaatgatcttttcctcaaagtacagaaagatctggagaaatgtgggcactcatgtattaagtttgtagtattataatattgtaagtataagataaaatgtggtatttttttttttttgagacggagtctcgctttatcgcctatgttggagtgcagtgatgcgatcttggttcactgcaacctctgcttcccaggttcaagcaattcttctgcgtcagccttccgagtatctgggactacaggtgcatgccaccacacccagctaatttttatttttttattatttacctatttttttttttgagaccaagtttcgctcttgttgccgagcctggggtgcaatggtgcgatcttggctcaccacaacctccgcctcccgggttcaagtggctctcctgcctcagccttccaagtagctgggattataggcgcctgccaccatgtccagctaattttgtatttttagtagagacggggtttctccatgttggctaggctagtctcaaactcccgaactcaggtgatccgcccgcttcggactcccaaagtgctgggattacaggcgtgagccaccgcgctcagccgctaatttttgtatttttagtagagatggggtttcaccatgttggccaggctggtctggagctcctgaccaggtgatccacccatctcagcctaccaaagtgctgggattacaggcatgagccaccgtgcccggacaaaatgtggtatctttaaaagctctgtggtgatggcattttagattaaggtaatgttttattttatgaagatgtgtagctgtactgctggcgagatgaatcaacatgttctaatactgcttgtaataagagtaacttgatttaccattacctgctgtggtaaatttgtatcttcagtattggaattattcaacagaatctatcagaagggatttcaaaagctgcagtctgtggtgttgtgataagtgaagaaaagcatttcccctatttcagacagcctttgatagcatatgtatttaggaaaatatatacagattcatcaactgtacctgactcaaatatttttagcttctttgggttgaactttgggttatgccaagggatcccctttcgtcttttcatggagaatcacttgtaaccaatgttgatgtgcacttacaaagaagggtgtaaaggtttataggacgatactactcgacagctctgaggatctggaatctacatggttcaactagcttctctatttgagccctgaactagtgttgcactcatctcccatttcctttgctttgccatttccagttgtaaagtgatgtgtgctccctctcttgcctttcactggtgcagtggggcttgtctttcaggatgggacctgtgctaaaactttttcttgtctctgtgtatgctgataaacaggctttagagttctatcttgtggtgacttatcaccccaccccatcttagagatgacaattgcctttaaaggactatagttttaatgtgtagaggggctctttctgttatgtgcttctaagtagagaggcctgtgagagcatctttcaggtctgagaaggtacatggctgtcttgtgctcctttcttctctagcatcaggctgtagatattcacccctagtgttgtattgcccccaaccactgccacccccagtgatttgctgctaattttggctactttttttttttttttaattccaaaatctgttgcagtctcttcggacttctgccaattctggcatagtttgctcaaatgattggccttttcttggtagatctcagtctcttaacttctccctttccccttgttgaactgaccaataacctgtgagtataaaccttatatcttgtgtgttatatggtctttcatattttttcctaaagcatatcatgtcatacatactatttttaaactgccttttcaccacttctgaaaatacctttccttactttatcttctgaaaatacctttccttacatttctattttaaaacaatttatatttctaaattttcagtggctgacatcccttccatgataatgaatctatcgtttgaccagtcccctacttttgggcgtttggatattttctatccttttctcttttctcttcttccttctttcctttctgctttcctgttatttcctggtaatgagtatccagagttgtttgttcaccatgcatgtagttttttaaaaccttaatgtgggttttttgaggcttttgctagttataacatcaccttgtgtgttcaaagacaggggcccgtatcttatgcatgtcttcctagcatacatgcctgacacagtggccattcactaaagaattattgttgagtttcagaaatatgagggccatttgacaaataaatgagtaccttctatgtacttggaacccaggatataggggtgaacaaggtaaagattgtccctgctctcataaggtgaggtattattttgtataacgaggtttatgttacagagatggcaaccctcttaatgtgaggatcaatgaaaaaaatttaagacacacagtatagcaaaagcagactgaatgacttcgggtatggttacttgggagatgttcatgcttatggctgaattgactaattgatttttccatagatgatatttcttatttaggattatccactagtgttaagggattgagatggaatgatctttttcaagttcatacttttttgacccttgtgagtaactccagtcaattatacttaaattaaaaatttcatacctgaatataatatgctgttgtacagtgattccagggacccaaagatattttaggactgagtttggggggaacagaaatatttcccaaaatatttttggtctttctgttgcacgtcttaaaatatgattaagcaaagattgcagccgcggagaagattttctgctgtaaattggtgtttcaaccctgccagctgttcatgctttctgcgatcccacttataaaagtggaaagtgaagggtgagtggctgccctcgtaggcaaccacataatttaaaaaaaaaaatgtgtatgcctcagcagatctatattagtatttcatatagctgcctttttcttttttattgtagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcaggtaatgtatacattcgttaataatcactggcctttttttttttttgttctttttaagatttgacctgatgtctgttctgacttggtaagttgcttaaactctttggattctagtttctctttttgtaaagtattttgattagtcacatgaacattaatgttctgtttagtgataaaattccataattctatttctctcagtttatcttactattttatacttacgtgaatacagtctttttgtatgcttttcaggtcttattttctgtaatagttgaaaacctttaaaggtttaaattttgccagagatttttttttaccttcctttggagaatacaagaaaatccatgttcttattatatatcagttgtacattatagattttgtacaaagtaaggttagacttttttttttttttcttaatatccttttgcaagagggaagggaaatattctagagctgtactttccagtatggaagcccctgtctgcgtgtggctactgagcacttgaaatgtgactaatgtggcttgatatgtgctgtaagtgtaatgtacacacacagtgtttcaaacttagtgtgcaagatatcttaattcatttatatattgattatgagttaagataatattttggatatactggattaatgaaattttaaaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcctcgttttcgaatatgtactttccactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatctgggctggacagaaaggagttgcagagcaaccatggaagtcaggcagagcaagtcaggagggtactgggagagctgcaggactgaaggaagaaacagacactgctaacacatcctcctgcccagcttgtttccaaagatttgtcagcttatccttgagaagattttattttatttattaaactcatatattccatagggagataaatattattggcttaaaatactttgtattgactttcatataatttgtttggcctttaaattttttttataacttatatttggatgtgatttttgcagtctagttttaacataatttaaattttacaaaaggttgtttggttgtgttgtcacatttaatattatagagactatgaagaacaaaagtaaagttttagtttttttcccaccgttttttcctttgcatcccaacattattagccagaaggaatgctgcattgaaaagctagaaaacaataggatacataaaagctaaatctcaattttaaaatttttctcaatttttagatgattatgcctggttgaccctgttgtagttttacttctaggataagataggtagatataacatatgctacatggcagaatagctatagatagatatatttttgttcaggcatagatttttaatatacatgagatttactataaaataaagatagcacaaagtaaaatatcattttcagaactgtttttgaaaatgctgaaatatctggtcataatcaaatttcatcagaaatttttttcatggttctttttctataaatttctattaaattgttttggaagtaaagtaggagaagaaggaatagaatgaacttttttttttattagaagcggatgggagggattatttgtcagggtagttttgtagcacaaatagcatttcaagcctttgaatggtgatggaatattttctactctaaactcctcaatgtctacagaaatagttttattttataaaatacatatgcagagtatagcagtgaataattttgagcaaatatttaccaacattaaattaataattgttaaactttaattttttttcttttacatttttagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggtaaaatttgcacttcaaaaagacaggaggttattaagtttctttaggcctagagtcttttaatgagaatctggtagaggccacttctcaaatttttgagacattattctctgacttttaacattaatatattccttttatgtgtcattatgttttagtgttctcattttatcagtttatgtgccattcaaggatagtatctgtgcagtatgaaatggtaataaacaaaaaagaagggcttgcctttggggacaaaacagtatatagttttaagagactgcttgttcattttagtaactttttaaaaaatattgcataggaaaattatttcatgtctatgaggtctacttttagaaaaggcagaatactcatgggaaagtttgaatctttaaaataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgaccccgccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttctttgcttccagcattcatttatcttctacttacattttttccccattagtttattggcagatattcctatttttctattttgaagacaacaaaatatgttactttaggtctggacacatgatttagtgaagcattttttttgtgcgtgtgtgctgcttttggatgtgagaggtagtctgcaagcttggatattgaaatgcttggatttctagactacagtgcaatatttagtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctgtgtgtccttgggcacattgatttgtgtatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgtatctttgattactagactcacactcagtgaggtgaggtgctcccacttaatgtaggatctagatggcttatggcactgcagattttttttctctataaatctcataatcacttgactattcaattattgagtgaaatggtggcagagccacttgtaatatctaagttgttctcccttctctttctgccaatcatgtttagtttaattcttgttacttaattgggagagtgatgtgattccatagtgtaatcttccttgtaggcttataaatatacttcaaagtgtgtcttgtgagtcttcctcatatgaagcccacttcttcccttttcttgattttttaaaagacctttattcttttcctttttctgcaacttttaattctcaccaatctcatttcttgttattccatacatgggcacttaactgtaataataaaatccatggtttactgggcagaatgccaaatgttttacaaacatttagtgcatacgcatgaaggttagtgccatgattcacgatgaaggtgttaccaggttacatagctaacaaggggcaccagaatactttcctgacaatttacctggatctcccactaaagtaaattctagcggcaaagaacatatgcctcctattaaacacactctcctcatggcctagctgaacacttggcatatagaataattgccaaataaataagacctctttgacctttctcaaagcccctccaccacatactcatactgcacacacacgcctccacgcttgcaggtcttcgcagatgtaaacatttacagcacttttacttggtctcctcactagaatgttagctcattaagggctggaactttgttttattcactgctgtgttgggaatgcctagaatcataactggcacatggtactgagtcattagagtttggttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaagtattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactgcaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttcatcggtggattttcgtctattgggaatagaaatatttgaaatagatttttaaaaattttctatatttagttccccaactttgtgaatttatgttgctgtgtttttctatatatagatatttttctttttggactgagttggtaatatctctcaagaaaaggtaaatttcaaaatatgtttgtattttaataaaattccaaattatgttacagtctgaaaagatctaacaattgtcataaaatatttaagtgttttacatgagtaaaaactgaattggaaaagaattgtgaagtaaatgctgataactttgtactgttatgcttttgaaagttttgaatcatagaccatgaaattaaatgttagttgattgatacatgttcatgttgtatttaataagctgattaaaacacaattacagcacctctgtatctataatcttaattctttgcttcccactagttaaactgctgaaatatttggttaattttacttcaaagaagtcacagtgtgtggagagaagataaggtatactaaatgaaagattggacagcatattgttagttaagcaatttgtgaaatgaacattagaaaataatcccccttgtggtatgactctaaaatagtaggaagacctaggcccaagagttacactggaaaataattttcttttgtacatttgcaattcttttgtagaactttttattgactcagagggtgattaggactttttgcttttttgtgtgtgtaaaattaagaaacagatgtttgcatttagtattatgataattatgtatcctctaaaaaagtttgtaaaaaaagaataaaaacatgaggaaatcagtgtaatatttccaaatatttctattcaaatattttcaagtatagttagaatttgaaaatagttctggtcagtcatagttggctaatatctctattaggggtgtccaatcttttggcttccctgggccacattggaagaaaaattgtcttgggccacacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcggaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagttaatttaattataaattctcagaggttggtgaattgaagctcaggattgcctgattgtaaaatctgtgttttttccatttacctctttttattgcctcttaagatactttatttagttcaaattattctatttcttttcttcttgtgttgtaggcattagctaatttaacacatttatctggactttgggttattaatagggttgtcagatttagcaaacaaaaatatagaatgctcagttaaacttgaattttcaataacaatgaatagtttgtgtgtgtgtgtttgtagtttgtgtgtgtgtgtttgtgtgtcccaaatatcacatgcagcatgcttatactaaacatttatttgttgtttatctgaaattcagattcaacttggctgtgcattttatctgacaaccttaattgttaagaaaattgtagcacttgagttaaatggcgctgtatggctatttagaattctgtttttagagatctctaaaatatgtgtattgagattctgttttagaggaagaatagatggtttggtctctcattggactttattctttgaggagcacatatgttaagcagctgctgagaaatttagatgatcattaaatagctcttctttctcctcagtttcagttacctttgtctgtctttcaagcctgggtgcttcaaaactctccagtgccctggtaatacaaataattactaacacttagggaattattatgttctgtgcactattctaggcattttacatatatcacatccattactcctttcagcaacttcatgacagagtctgtaattaccctcccttcatagatgtgggagaagtggcaggagagagcataagtgatctgttcatggcagggctaggtttgaaatcaagtgatctttttccagaaccagtacttgtaacagtttttaacatattgcgttttttggataattcttctgaaaccacaggctgagcatataggagggaagtcttttaagtatttccaagccaaatgtcaactactttagtattattaaccataaaaaagatttttttcagctatcttgcaaaagtggacatctcactgcactatctcctatccttcttttccttctgatttatcttaattgaaatgaatgtctctgtccctaaatactatattagtacatgagatagtgagtgattttcctgattgccacattttctacaattagaaagtgatttacaagcaatattttccagcttttgttttgttttgttttgttttttgagatggagtcttgctctgttgcccaggctggagtgcagtggtgcaatctcagttcactgcaacttctgcctcccaggttcaagcaattctcctgcctcagccacctgagtagctgggattacaggcacacgccacagtgcctagctatttttttgtatttttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatattttagacagttttctcattatttcaaataaccaagctctgtttggggaagacttactatgcctgaagtattgtcagtcagtgttagatgctcatagatgggatcattaatgagggaggggaggagctttagcacagatttagaaattatcttggagattgatcacacaattgcagctatgagaaaaagtatgcaggtcttctaaggggcacttagaaaagcaatataataaggggtcacagttgtacattgtacgtatagggctgcaggatgaacaaaacgcctgctgtcctaacaataatgcaaataggttcctctggtgtggggtaaaatttccagtgacagcatcttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttcaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctctatttggaactaccaccctttttctctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtatgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtggaacaaacctgcaaatatacctcttgaatctaaaattaaaaaaaagaaaataaattattagatgaaaggatatttctgtttttaatgaactttattttaaaatttgagaatatttatcacattgaaatggaaaaaaaatcttgaggcttaagttgcatgtgttgtttattaccaatgtattatttatctggatataattattttttattcaaaaacttttcatgttttcctgaagattggtgcttatttaacttttgagtggaattaatatacttaaaaaatcgttattaataaaaataaaaagaaaagaaaaaatcattattatagcaatcaaaaccatagcagtgtaacagtgctttgtggagcggggtgccttcttagggatgggtgttttaatcatcttagggctcacagatcctcttaaaatataagtattttggaaacttaaagataatggacaatgattattaggtatagcatcagaacagagagtgaacatattaaagctaatatggttgtattattttatctttagtttcatttctagctgaagtaataaatttgcatttgtacttttttcctagtccttttggctatacctttcattcatcttattaagtacttattgaactcttgctcttatatgtttgcagtagatactagattaagtttgagtggtatgtgtgctcaggcctgcttctaaaatttgcaggaactggggcaaagtacacagaggcccacataccctgtgtttaaacatttaagttataaatcaaagaaataaattactaaagaaaaataggtcttctcctcttgcctggagaaatagctcagtgatctagaagaccaaatgtaggtttagattgctgttgctctagttccccactggaatatggtggtgtgtatggggagagccagcctgtggggcaggccagctgccttctcctcccaggcctggccctgtcccaaaccaggaaggaccttgattgaagcggtcctggtgccaggtctacacccctacaaactacagcctcttggccactgtttaggctagagagggtcggtcccatttgttagggttaagtgccctgatggggagagacttataagaatcccagtaggcttccagtctggggctgtttagacagatttctggaccctggtactcagaagggcagggcaggctctgggtcagtttgtcctgtggatttatccaattgaaaggggtgtagtcagaagaatagggaggtccttctagagtccagggctcagggccaggtaactcttgcccacatcctcatggtggtacttagtgtatatgcccttgaaccaaataaaactaaatgttcctgaagagcatcagaactccacataatctctagatttccaacctatggctgagagctcaaaattttaaaaataaattgtgatttgtgaacagttactaggtgcttaattgttcatgaacattgaatgtagacaatagagtttccagctttattggctttttttattttagaacttaaaaaaaaatagtggtatcgaatttgggtttatgcctgctttgtggaacttgtaattatgcactctttgttttaaatatttccccacttatttaaaatagctattagcttttttatgggtggtaatagtgttagaatggaaaagaataaattgaaaggtattcttaatgctgttctagccctcgttcaattttcagggatattccaacagaaagaaaaaaagctgtgaattgaccacttaagtaaatcagtttgcaactcagtgtcctaagattattaaatctagaggtaggaatataattttatgtcatgaaaattcatcccctaccactttttataaaatactatatttctggttggtctcatgttaatatacaattgtagtttttacagtaatttagaaaacgaaagaaccaattcagtgtaaaaggaaatacttgattactctgttgtataagagcaataaaagctaatttactgttatattactcagtactgaaagctgcaagaggctatctttcagttcattcttcattaattatgctgtatggtggtgatatcagtatgagttttatggaacgctttcaggttgacctctctgagcttgtattttggctcatgtgaatgtctttaccatattttcctcatgattgttgaggggtgaatgaagtgttgaaggcaaaatggactaatcaatcactgtgattcctctgtgaaaactcccatgataaactcttttttgaaatggccttagttcattcatcacagattataactgttgaaaataaatagttgtgcttaacaaaaaacatacaaaaaaacttttacttatcaatcttcataaagactaacccttaaaaatttgccttttatgctagattactggagttttattatcaaattaatttggaggcatttcactatttatagttctttagctagtagccagataattaggaattagtttgaacctttaaatttaggtaaaagatatcatgtgatatcttaaagacgataattctaatagaaccatttcatttacatggtccttgttgcacgtgtataataaaagcacggtacagaaatagatttacttacgtacatttgaatttagctcagttttgcaatatgtaggtagatatagtatattcagttaaatattatgttgatatttgataaaataaattcttcccacattgcaatctttatttcttggatggtaatgacgctgatttgttctagggctgaataagtttgctagggctgccatagcaaagtaccagactaagtggcttaaacaacagaaatttgtttttttcacagttcgaggctagaagtccaagatcaaggtgttggcagggttgatttcttttgaggtcatctctccttggcttgttgatggctgtcttctccttgtgtctttgcatggtcttccttgtgtatctgtgttctaatctccttttgttataagtacatcaatagtcatgtaggattagggcgtatcttcatgacctcattttaccttaattacctctttaaagacctgtctccaaatacagtcacattctgaggtggtgagacttcagcatatgacacagatctgtccataacaagggcatagagtgaattcagtgcaaactgaaattttgggtaaccaatatatgttttaagatgtggagcagtttatataagtgttttaattgtatactttacaaattgggtgttcagaatattttttatttcccctttacctaatttaattgtacagatgtgggaaagggcagttaaagactgatgatgatatcagttctgagcacttgatgttttttaacttggtagtgttggtatggtcatcagggagttagggcatctgggttggttggactttctgggctattccctgggaatccagaggtggatcctggctcagtgctctgggggcagtgttccaggttagtactttggtgaagctaggtgggattctttgcagaccaccatttcatgaaatatctttgaggttttaaaaatagacacagttttttttagttaaatgtggaaaaattgaagtatccaggaggtgttctttggtaccaaatcaggttaaaagtgccccagatcaagaaagtcctataaagactatttgacattatatttctatttggcctatagcttcatacgtgccacattgtaggtgctcagtaaataattgtaggatggatgagtagatttcaattaaagcaagaggaataaataagtcatagctgcagtgctcttttcaaaagctcatattcacattgtcagaatagttttgtcttctctgccctggcaggcttttattttttatttatttatttattttttgccagcaaatatagtatacatattaatttaactatatacagataagaaacagccatttggaccctcttactctttaattctctcacatgtaagtttggaaacaatagaccaatagttcagcttggatatacaggaacttctccttatacgattttttagatgggaacgggttattttttagggggtctgctttgcctgccaccagtagacagaattggtggctgtgtacgtttttgcttggccgttttagtagtctgccttgtggtgctatgtttgcacctgttggtgttaaaaatgtttcttatagccaaattgcaactatctttagataaaatttccaggatatttggaaagtagaggaaaaaacaggagaagcaaactgtcaacatctacagttctctttttgaaaaattttacctatatgcattcgcatttgttgtttgattagtgttactttgtgcttctaaggaattgaataatgaacagcttttgggaacaaatgcctgtattttgcagaattctacctctcagtgttcatatttatggtgtaattaccttattggtctgctgaaagcttttaggtatagtttatacttgcaatctcttttttcttagtttaacttatttaatgggtgaagaattttagatgtggcatgagaggataaaatttggatcccctattaggataacagtactgccaacttgtaaacagtgtttagatttttaaaattcaaaaaaaattccttagagataaaaaattgaattagatactataattattaaaatataaataactgctttttggccttaggtcatctatcttatttttctcatttctatctgaatttgtgcagttttcagagtgttttcattgttttaatattagtgggtttctgagtcccatgacaactaaaatggagtttcattaattgaaaacacctgttaaatttaaaaatatgtctatgaatgaaaattctaacgatgtccaaagtaatgcaatggaatgtgactgagttgaaatcagccatacgaattagacctttgtggtatatttgtgtcttgatttaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacatggtgaaaccttgtctctactaaaaatacaaaaaaattagccaggtggtgctcacgcctgtaattccaactactcaggaggctcaggcacgacaatgcttggacccagaaggcagagggttgtagtgagccaatatagtgccactgcactccagcctgggtaacagtgcaagactctgccttgggggaaaaaaatcctatgttacaactttgtcccacaaatggaattactaggtcaaagtggcttaatagtttaaaagttttttttaagtatataattaaagtgacacctgtatagtttgtttcaatgtatatttcaatcttccatatagaaagtatcaatttatttgctttttagtcagcaatataatttttgaagttgttggccaatttgatggttgaaaagtttaattttaattttaatttttgattggtaacagtgttgcatattttctcatacaggttaaggtttttgtgacttgcttattgtactttttcttactgatttgtaggagtatttatacatatactccttaactcatatttttcctcagatttttattttcatcttttagtgtttgatatacaaaattttaacatatttatctactcaaatctgttattctgttttcttcagatattgcttttgctgtcatgttttaaaaagttttctccaatctagaggtcaaataaatagtgctttttttcttcctaatttcattttttaccattcactttttaaaaaactgattaaaaaaaatacgttacgatgggaggttttctgatctccatgtatcccctggagttaagaattatcttataatgaattgttttctttaatttatttaatgtcacttatacagcgcttactgtattagtccctgttctaagcactttacaaattgtaactaataatcttctaaacaattctgtgaaataggtacaattgttatcattgttttacacataaggacactgagtcgtccaggatcacagggcagcctggcattccatgtagtccaggctgtccacctccagaggctgtcttctttgcacactgcgccatcctgccttcctaagattgaattagtccatccttttctagtgatttgaagtgcaatctttattatatttaaatatgcattagtttctgggcattttgacttgtttcatggacttttctgtttgactgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaattttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaattgtgcataagcaaggcaaaatttatttcctcatgtaatcaatcacctgggaactcattcccatttttgaaacaagtgtttatggcagaactgactgtacttattttttgctactgttcccctatcagcttttattttttgggtattttatgttttttttttttttttttccattcttgcctgatctttgttggcttctgtattagctcattcattcattcaacagacacttcccgaacgtctactatgggacagggactgcaaggtgggcactcctagactaagatttatttttcttcattgtaaactgtatgtatcatcattgataccatcttttctcttttttataattaatattgttatactaccactcttttgttgttcgtttgcttgagtttgctgtcctttttacttgaaggacagtcagcttggtggttctaaaggctgggaactggaaccagtccgcctaggttcaaattctgccaagtcccatctactgtgtggctttgagcaagttatttaacttctctatacctcagtttcttcatttgtcaaatgaggataatattgaaaccaattttatttggtttttgtgaggattgaattaattcagacaacatgcttagcacaatgcctggcacattttaaaaccccaataaacattagtgcttttttaacttttatttgagactttgagtatttctcctggataccatatgtaatttttaatgctgaagtcttctataatgggagacttttcttttagtttttgtttttttttgaaacagggtcccactctgttctcaggctggagtgcagtggtatgatcacagctcactgcagtctcaacctcctgggctcaggtgatcctcccacttcagctttccagtagctgggactacaggcgcacaccaccacggtggctcatttttgtattttttgtagagatgagattttgccatgttgcgcaggctggtcttgaacccttgggcccaagtgatccacctgcctcagcctcccaaagtgctgggattacaggcatcagccactgtgctcagtccgtataatgggaagattttaactgtaatttttttttctcttctctcttaaagctttcttatataatgcttcattgaaggtaactttttccccatgctcacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcatttttaatttgttgtatttactgtgttttgggagatttttcccaagagtcttccctgccactccctcggttcagtactctggtattgagtcttttctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtactagttattactggctgaccagcatccacttcacctgatttccttttgggaagtggtctctcacccaaggaagtcagctcctcttccttgttgcctagcccagacaagtcagctgtgacctgagctcagttaatcagcatattatttcccagggctttgaatctttagagagcgaagtgagggctgacagatggagggagggaagcagacacagaagaatgtttactggtcattcctcacagcaccttgcatttgcaagactcttcctgtaataagatccctgtgttccctgcagcatgatttctcattttcctccagccctttgttaagcctggacttttagcctgtcttcagttctgtgtgttcaagacagtatccagcatcagtttgtattgcttgcaaaccagaaagctagctgataggaacttacaacgtctccttagttcctctgttggagaattacatcctgcaagattatatgagaatcagggatcagcagttggggaaggtgtcctggttgtaaataggacagagtgagagaagagaggagctggggctatgagaagatctggaaaaggagtgccccatctatgaaaggttttctgtttctttggtgtagctgctgagcctggggctggctttctccctctagctttgtttttgtgtggcctgtaagccaggtaggagatgtgtgtctgaatgtgctgcttcacagagtccagccacctcagaaggaaactgggtctgctgctggctgcttgtggtcaggtgaggccagccatgcttggctctctcccagcatggcttcattaaggagactgcctctgcagcagtcacagtgcatgggcagagagacttctgcagagggggactcacacaagtgccatgagggcgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagtacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactcagatttgtctcactcagattccttctgagtgagaacagcttttttggcattggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattctgagcttgtactaagtggcattactaatagatttttttgtgtgacttctagtgtaatgcttatgcagtggcttttctctttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattattattcaactctataagcttttaaaagtgaaaatctagttaactaaagagagatctacgtaaacaacatctatattttctgtttttttgtgtgatctgaaataatttaatcaattataatcatagtacctactggtaatacatatccagtggatttaaaagaagctgccttccattaaataatcagtgtattgttttctatgcttgttttattttgaaaatgactggtggtgtaattttttaaaactttttaggcttcacatttgaatattttttggctaaatgcagttaaatactgcatgatgtttataatacatcaaaatgtgaacccttattgagagtcaggcagctgaaacattagccttagcatttcctttgactagcacacagcatgttacatattcattgttcctctctgggctctgagatattggaacagcttttatattgcatctgctcttgctattgagaccagtgttgagtggagaaacccacgaattattagaacctaagaacagtttatatattcaccaaagtcttgaccagtttctctttgtggatcttttagtgtgaaaaggggctccaaatgtgtgctgagatgaaggtaccatcagttagtatagattttttatcttcaccaaattggtgggtttcattgctttagcaagaatgcaaactctttatttatataatctttgtactatcttcttacaatttttcccctaggtttatatttaagtgaaccttccactgtcttctcaactatctctgcttgcttcttgaaatcagagaaatatttgatgttacatttttaaataagaatccaaacttaactaatgtgcatcttgggttttctaagaaattggactattaatcttcctaaacagactaattcattatacgttttatacaggttggattttatggtatttaactgaaggttgctgtaaaatttatagagcaatgggaagttacagtgtgtcttgtgatattcagagtcatttgcagatttggattgagtttagaatctaaagatatttagcatttcatcaaagcactgaaagcaatgcaccagggtctaaaataactttagttctaatagttgaagcagtggtttacgtttattttagaaagcatatgttctatccctaccttttcaattccagttcgtcttgagtgagacggctatccttccacctctcattcccttcaaccactggcatctatttatgtcatggagacctgtaaaagccatgagggacttctcaggtgctctgcccatcccttggatactttctcaagcctcagagaggatttttttgcagcattgacatcgatcactccattctcctcgaaattctgtcctcttttggctttgaagtgaccttgagctctttcactttcgggtctattctggcactgctgaccattcatttttcatcacctctctgatttcctcttctgcttacttccccaatgttcctgttctcgcctgttggggaacactgcttagttttcttcattttgcatgcttttccacactgttgttttaattaccaggcatttggactacttccagatctaaagatccaacctggacttcttgttctctagttagtggcaatagtaagagataagcactcgtttaattattcagccaatcctgtagcattctcttgagttaaggttctttatcatcttcattctcctgttgaggaatctgaagcagaggtgttaaggaaagtgcctaaggtcacccagctagtaagtgtggaaataggacccaagccaggcagtcttgccccagaaatagtgggcaaataatcttcacctctgtggtgctctgcctttccacctccctttcctgtgacatccagttagtccctaaactctgtgacttctgcctcttcagtgtctccagactctgacccctgcttttcgtctccattgctcttgtctcgtactattgtgaaaacctccaaatggcctttccatttccagctgtgccacttctaagtgtctgccatttcatcaacagagttagttttctaatatgtgagtcccaccatgtttgctttaaaatgctttgtggtgcttcagtctcaaaaggcacaggccactatcctttgcctgacacatactgactttttctgtctgattcctcccgacttgctcatccttatctccagtcacttcctgcttcacactctactcaggcattctgagccacgggtgtcctcagacacatgccgttttgtgcttcttaggaatttgcctgtgttcagcttggatttttatttttttccttttgtgcagtggataatttcagtcttactcatttttaacactcagctgaaatattacctcatctctgaaaccttcccttatttacttctaccattcattcagcaaatatttattgtgttatgctccagaaatgtaggaggtaagcaagactgacctggtcccagccctcagaaaacagcagggaagacatgtaattaaacacagtataataataaagggttttcttctatagaggcaagaagggggtcttggaaggcctcctgaagcaaatgatattcaagcttaaacctgaatgatgactagaactagccagtcaagaagtgggtgtcagagggcagagaaggaattttaggttgtgagaagagaatggtgattatgggccagggattaacaagggcatgtttgaacatctgaaagatgtttattagacagcagcagttggggagggtgggcagcgagggtgtgtgtgtagaagctgggtaaatcttggccatcagggagatacatatcaaaacttctagaagatactgtttccaacccttttagaatggctaaaataaaaaagatgacaacgtcaaaagttggcaagaatgtgtagcaacagaaactcatatgttgcgggtgggaatgcaaaatgggggcgactttctgaaaagcctccaaagagttttccaaacttaaaatatataccatgtgatctgggggctccactcctagcaatttacccaagagaaatgaaaaaatgttcacaaaaagacttgtacagacattttcatacaggctttttcctagtaacttcaaactgcaagcagtttaaatgtccttcagcaggtgatggattaaaaaattgttgtatattcatacaacagaatacctagcagtaaaaaaatgataaattactgaaatacacagtaatatggatgagtctcacaaatgttcagcagaagaagagagacagaagagtaaatattgtttgatttccattttatgaattctgagaggagactcaactgatctattgtgatagaaatggaatgtcagagtgttttttgggggcagggtgagtgggcgagcatggattggaacggggcatgagggaactctctgaattggtggaagtagtctatattattttggatagtgattacagttgtcacaattcatgagactgaaaatatgtgtattgtatattgttatatctcaattaaaatattttagaaaatgtaatacaatataaacatacaatacaataaatacaataatataatacaatacagtaaacataatgatatatgtctctcttgatatggaaagatgctcatggtataatgttaagtaaattaacttggttaaaaactctggctcccataaccctttgtgcatatatatcaaggtagtgagtttttaaattttattctttaacgtctttcacatttttcaacttattttgaatgagtattttatgaataaagtattgtttactatacagtgaaagatttaaagtacatcccctgcttattaaaactttgcagaaattattgaaccatatgagaaatttatttttatttctattaaattaaattaattaattaattttagagacagggtctttgtcactcaggctggagtgcagtggtactatcatagctcactgcaacctcaaactccgggctcaagtgatactctacctcagactcctgagtagctaggatctacaggtgcaggccaccatgcctagccaatttttataattttgtagagataggttttactatatttcacaggctggtcctcaaacccctggcctgaggtgatcctcctgcattggtctcccaaagcacagggattataggtgtgagccactgcacttggtcccaagacatttttaaataaattttcatgactatttttaagctacagttctgttacttttttttgtttgttttgttttgagacagatctttactctgttgcctaggctgagtgcagtattgcagtcttggctcactgccacctctgcctcccaggttcaagcagttctcgtgcctcagcctcccgagtagctgggattacaggcatgtgccgccacacccagctaatttttgtattttttgtggagatggggtttcgccatgttggccaggctggtcttgaactcctgacctcaagtgatctggcagccttggcttcccaaagtgctgagattacagatgtgaaccaccgcgtctggcctcagttttgttagttttcagtgcttaggagacacaggttatagcatttatagttcagaaaaaaatttagtttaatttactttttaatatatgccccaatatatacaaaggatacacaatgaaaagtaaggtactcagccactcctgtctccttgtcattttgctcttttcacaggaggtaactactatgaccaggctcttatttattttatggatgtatgggaaaacatatgcacatgtacataaaggcataggcatatatattatacaatgatagcatgccatgcacattgtgctggttttttttttttttttttgagtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacctgttgaacagtaattcccgttcctcttgctcctggcaaccactgttctgttttctgtctctacaagtttgactactctattaggtgccttatgtacgtagaatcatataatttttgtccttttctgtctgccttacttcattcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatccattcatcctttgatggacatttgggtggtttctacgttttggccactgtgaataatgctgctgtgaatatgagtgtgcagatatctgtccaggtcccttctttccatctccagaaatggaactgctggatcacataataattctatgtttaatttttttttaatcactgtcatttaggtgtatttttttggcagagtaaaacatttaaatattttacatagacataaatatgagcatgataagcattgacatgaaaatggcagtaattctgtatgtgtgcttcttgtatttttgttatatttttatgtcatgcttttttgcaaaatacattataaacatttatgaatttcactagttttctgtgatatcgtttttaatggctgaataatgttctgtcactgtatggatgagttaacttgactaatctcttacttttggagatctaggtaattttttaacttttatctttgaaaacatctgtttgtatccatgatctctatttataatctaattttatacaaaggtaacaaagagctggggggagagggtgggtacagcagtttcatttgactgacaatataatcaacatttagctgtatgattttgtcctctttgttgcctaaaacattattctctagggctttccccaaattgttttagaacaagcaagttgacatgctttttctatagggtatactgcctgggaataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtgctttttaaacatgtatcttggagaatcttttagtaaagtctgttatgtgaatgggacttgttatttaactactcccgattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttttatgagccagttatttctgaaatatctgcattgtatcttttgccttttttttttttttgcattatcagtacccatttcttacaattttatgctaataggaacaatcagtgttaaatgatgaacaaaactgatgtgattcctgcgctcatggtacttacagcctgttggaatagaaagatagtagacatacaaatatgcaattaaattttgttgtaaatgttatggaagaaaagttagattttctgtaagataacagttcaggctggatttgggtggaatgtggtggccagtaacagcccctaatgaacctgtaagaaccaatgaggcaaatatttgaagggaaaacattccaggcagatagacagcatggacagctagctgaaagaagggcatgtggctggattgcaatgaggaagaaatgatgagagatgactgatttgccctctgttcctcatacactaatctgtatagatatgtgtcaacaatgttcaaaagtatacagtgagtttctcctatcattatataaggggctttaaaacaaatctttttccctgcctactagatattctccaggaaaggaatatgaatcagacaatctgattagcagaatgtctttaggatataagttgattcattgggagcttctgtgtttttgaatttttcatttaaaatttttttaaaatttaagaatgaaatactgtatgtcatcttgtattatttcctgtttctccagatgtgtcattagaaattcagctggttttctcatgtgaaattaatttgtgattctttgaagcttgctaaatgatgcattgtttgctactaagttgtctgtaacaatttccccattagggagaaaagctctttgagtgtgtccttctgtgtgtgaccaaattccaaatgtctgatgattctacataggggaaaaagtgacactcagagaaaatgatttgcagcttgttgtgctttgcagtaaattctgcattttaggtaaaatgcggaatgacagatatgctcagcttagttttgatcagtaattttcttaagctttctgtatcaaatttctcatcattgaaatagaaacatggtggtattttaatgtcttttaccattagttacaagtcaactcagtgtaaaaagtgaaagacaagtattgttaattttgaaaattagttcctggtttcttagtttctggatttgttagataaacatatacctttgtttcccttacttacccaatatcctttcactttggcctttaggtttcatgtttattaggaaatatcatgaagtgtacatgtaaaatagacagagaatgtcttggtagaaattaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctaagtaaatttttttatagatacgggtatttctcattacttttaaaaaattgttagtcttgaatgtacagctacaatccatcttcatcttatttttatcatcactaacaacagtggctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttttggggactatttcttgtttttctttcactcatcagatgcttccttaagtgcttatcatgtatgttctagaattcagggcaaatttgtgtccttctgatgtttttgggttttgttgttgttaatggcaagtgtttttgctcaacacagtaaatattttatatcagaccaaatcttcctgcttgtaagaatcttctggtttattatctgtttttctattcttgtggatggattagagggtaataccctaggaaaaacaggcagttcaatgaaataggagtactcactaacctgattattctaccaggtatcatactattacaatatggtccatattaaaataatgttgtctcttttcttccatgggatgttttgttctatcttataaaagaaactatgctaagaggaactaaaagctatgtgctttctggcctactattatgatgtcatttatatatgatatgatatatttgcctatttttgacctagtcatgcaatttttctgaaaaacctgtatgagcatagtattttgaaatatgaatcccttggcttccatgacataatatcttggcattttcttatgagctggttttaagtcactctgattgagtcttaaaaagaaaaaatataactcattctttctccactaaatcaatggctgttttattgtatttttatatttttaattgatgcaaatatttgtacatatttatggggtataggtgatattttgttacatgcatggaatgtgtaatgatcaagtcagggttggggcgtccatcaccttgagtatcatttctaagtgttgggaacatttccagtcctcttttagctgttttgaaacatacagtacattgttgttaactatagtcaccctactctgctgtcgaacattagaacttactccttttatctaactgcatgtttgtacccattaaacaacttctcttaacccctcttcccaatcgctaccctaagtcaaatactcttcccagcctctggtgtctgtccttctactctccacttctgtgagatcaactttttttttttttagctcccaaatatgagtgagaacataggatatttgtctttctgtgcctggcttattttgcttaatagaatgacctccagtttcattcatgttgctacaaatgatatgatttcataggtttttatgactaaatagtattccattgtttatatatataccacattttctttttccattcatctaaatcaacacttaggttgattccgatctttggtgttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttcaacttcctattctgactcactgatgtgtttatttctaagtcacagttatggtagctttttaatggcttacaccaactggaaggacagattgctctttattactcttctctagactgtttcaggctaaattcagatttattatttttgtcatttaacatttcttatctccatttctcttatattttccttcagcttgatctttgactctccttttgcttgttttttgttaacttctcatcattccctattttctcttttgttaatagttctttgaaacttaactttttaattggccccttttcttaaacttactcttctttttcacttaactccttttggatgtcacactgtcatcaaaaagccctgtccaaatttgtatgcattactacaaagtgacttcctttctcaacgcaattgcactgtttgtgtattaatactaccattccgttagacacctggaattaaaactgtaagtcatatttgcattaatcttttcatctatcttcagtcattttctaattaccattgatactttttcatgtgatgtctcccgtcttcctcctcctccatatttcataattactactaccatgttctagatcatatcatctcatacctagataattgaaacttcattctgactgacctttctctttctattttattttgcaaatatctgtgagcttcttctaatataaaaactgtaggtaaatactaatattaaactgatggccttattcattaattcctcatttatgtaataaatatttgaatgaccattatctgccaagcaagcttctgagtgccggacgtgccaacgtgaacaaaacacattctagtccatgctctcttggagcttacattctaatggtgggtagaggtcgggagggaaagagtggagatctgacaatgaacaaggtaattttggtttctgataaagactgtgatggatagatagaatggggggtacagtgggagtgttagtttagcttgggtgcacatgaagacatctctgagctgagctatgagggcagttgagaccagccagactgggaaagatagggtagaagaaaatagataaatgctggaaaacattttaataagtgggaagtttttcatgcctcctcaaaattaatagacagaatagtctttaacctttaagtacagataagaattcagtctttgatgaaagtagcatcccaggcatcatggaggagaaatggattattaacaaatggagctgggaaaattagttactgtatatactgtaattcttggctggttgactttcttgaagaccattgatgcctgtgggacaggaattatgttgtaaattaaaactaatatagatgaaaaaagttctatcattggagtaaattttttccacttaatttttagttttcttaatctgcagtttttttctctattcaacatcagcgaagagtttatttttgatttatatctgaacttatgtctgaaattttccaaaagatctatttattgatatattgaaataatgaagtcaagtttccgtatttgataattagataataaatctcatactgtcctgacatctcaggctgcgaagcataacgcataaggggcaggtttggtccatagcctctagactgtggctaaatcaggcaatcaccagaaagataagaaaaagaactaattgtatgcataggtctattgacagtaaaggtgggaccggtagccttgaatttagttgtgttcttaaagaagggcgttttttagaaatttccagcttcttcattgtagattcttgatttgggcctttgagaatctgaagtttgattggatattgtgtttctttagacattctaatgagtcatcatattctccatgtgaaattatattagttggtgatccccatggcaacataaatttatttctttaatttttgcagggaatttattatttgattgttttttagaaattacgtccattatccactctgttactggttatatgatcatgcatatgtttgaattacatgttgtgttaatgttgtggcttctatcatatgctttgtaggaaaatagttattcatcctctgtgcctctggtctgcttcaactaaatttggcttgagagttggctgttagctgtaggcatccagtgatgtatgtcctttttaaagctgctttgcttctttctgaaattttaccccattttccaaaccatcttgttgcaggctggcaagtctgtggcacttaagatagatacttgctcaatttttttttcttttttctttttctttttttttttgacacaatgtctcactctgtctcccaggctggagtgcagtggcgtaatcatagctcactgcagcctcaaactcacaggctcaagcaatcctcccacctcagccttccaagtagctgggactacaggcatgcaccaccacacctggctaactttttaattttattttgtaaatatgggatctccttatgttgcccaggctggtctagaattccttacctcaagcaatcctcctgtcttggcttcccagagtgcatgaactacagggctgagccactgtgccagaccttgcttaaattcttgacttttatgcttccttgggcactatttcaaatttttaatagttaatgattttttttttcttctcaggggaaagtatcttctcaaaacaattttattaggattagggatcttgttacctggtatggtattatggcaaaggaatacccaatagacaagtaatgaagctgttagagcctttcactcaataatgaaaaataaactgtatagcctatatttcaactgaatctggggcaaagtactttatgatgttatctgtattcccagagtcatgtggtatttactagctttacccttgttattttttagggtagtttgcatgatcaacttatcagtgtcagaaggactaaagtaaatattgattttttgataaaagtatattgaaataaataatgtgcttaaagtgacagccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacgtctctaccaaaaatacaaaattagccaggcatggtggcgcatgcctgtaatcccggttactcgggaggctgaggcaggagaatcgcttgaacctgggaggcggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggcaggggttacctgagacaccgggtgctatcatgaggtcttgaagttgaaattcattcactggtttaaacacattttttgacaactagtatacatactggttatatttaaaggctgttcttaatgtttatgcttgtttagtttttcatttgaacttttcttaacatttattaatgtagactcttgttattttctctctagtttaatagaaaatggtcagcttgaaattgtgacaggtggctgggttatgcctgatgaagctactccacattattttgccttaattgatcaactaattgaaggacatcagtggctggaaaataatataggtatgtattggtatattctttatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatacggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaaatggtcttgggggaaagggaattgtggagagcagggtcagctgcacctaaaggcatgagaatgggtcctccatatgagtggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgttttttattgaagttatttttagatatttccttattttaaaaaattgtcccttagagataaaattcttaatccctattttttctttactttttattttgagataattgcaaatttgaagaaatgtataagaatactgcaaaatattctcataaacccttcacccagatttaccagttgttaacattttgacacatttacttaattttttctgtttccgtgttgttgtagtggtgctggtatttcttattatcagaaccatttggaagcatgttgcaggtatcatgcccgtgtagaaaatagttagcatagcaggtctgctatctttagaaaggccttgcttgcaagattggcccttggttagtgtctgggaacatggatatcctaacgataagagtggctcactgtttttaatctgtttgtacaaacaaaatagtttgtgctaaacaattgctttccttctgggagtctgaattcttagtatgtgctgaacagagggtgcctacatgaccagcccccaacattggacactgagtctgtaatgagtttcctggtcaacagcacttcacacatactgtcacagtttcgtgctggagcatttaaacacatcctgtatgactccatggggagaggacgcttagaagcttgcacctggtttcctctggacttactctgtatgctttttccttttgcagatttttttttctcatttcactgtaataaattataggtgtgagtacgacaatatgttgagacctgtgatttttcttaacaaatcaccaaacctgaaggtggtcttggggaccctctctacacaatgccctttttcttaaatacttgatatgctaacccaagaatattcacttcataaacctccgttatgaatgttttttatgtttttattgaagtgtaatttacatgcagtggaatatataaatcttaaatgtagaggtcagtgagttttaacaatgtacatacccatttaatctatacatttattacccaaggtctctcatcccctcatctttccacttgcagccaactgctctttgatttctgtcattgtccatgagttttgtttgaagaagaatttattagtatatgaactcacataatattattttgggtcttgtgtcttttgcccagtgtaattttttcttacaactttattgagatatatttcacataaattcatagatttgtgcaaccatcaccacagtctatttttagaacttttttcaacatcccccaaagaaaccttatacccagtagtagtcactccccttcctagcttcacccttccctgccccagtctcaggctatcactagtctttctgtatatatggattggactattctggacatttcacatagatggaagcatgtaatgtatggcctttggtgattggattcttggcataatattttcaaggctcatcatgtattatagcatatatcagtgcttcattcctttttatagctgaataatattctgttgtatggatataccagatttgtttatcccttattcagttgatgggcacttaggttgtattttgcttttggctgctgtgaataatgctgttatacacatttgtttaaaagtttttgtgtgactctacctttcttcctaggagtagaattgctgagttatatggtaaaaatgtttagcattttgagaaactgtcaaacttttccaaaagagcggtatcgttctaccttcccaccagcaatgtgtgaggtttctattttctccgtatcttcaccaacatttgttactgtctctcttttttattgtagtcattctaatatgtgtgaaatggtaatctcattgtgattttgatttgcattttcctaaagactagtggtactaagaatcttttcatgtgtatatcagctgcgtatagatcttttaaggataaatgtctattctaattattttcctatttttcagtagagttatttatctttttattattgacttagaattttttttatatattgtggttaaaagttctttgttggatagtgatttacaaatttattttctcattctgtggttttttcactttcttgaaggtgtcttttagtgcacaagttttaattttgaggaagtttttcttctgttgcttgtgcttttgatgccatagtaagaaactgttgtttaatcctgaattataaagatgtactactgtctttaaactagttttatggttttagctcttacatttatgtcagtgattaaattaactaaatattatatttagttaatattatatagttaatatataatagttaatataactattaatataattgttatattaactaaaatattaatttttagttaatatttgtatatgatgtgaggtagagtttcatatttattttttttgcatgttgatacccagttattccaatgccacttattggaaaagatgattctttcctcactgaattgtcctggcacacttgttaacagttagttaaccataattatgagagtttattcctggactctcagttctgtttccttgacttatatttatgccagtaccgtactgtcttgattactatagcttgtataagcttgacattgggaagtctgagttctgcaacttccgttctttttttaaacttgttttttccatgtgaattttaggccagtttatcaatttctgcaaaaatatcagctagaattttgctagtggttgtattaaatctgtaggtcaatctgggggaatattgccgttttaacaatgtcacatcttctgatatagcaacatgggatggctttccatttaagtagatcatcgttaatttctttcaacagtgttttatagctttcagtgtaaaagtcctgtactttttttgttaaatatgttcctaggcattttgtttgttttactgccattataaatgggattgttttcttaatttcattttaggattattcattgctagtatgtagaaatacaattgatttttgttagtgatcttatatcctgtcaccagcatgaagtttttgggattcattcttgttgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaattagagttctgattgttccacatttttgccagtgtttgctgtgtgagtcttttttcttagaaccatgctagtgggtatatagtgatatttcactgttattttaacatgcatttctatgatgactaatgatgctgagtatgttttgttgtgcttattggccagtggtataccctattttcaagtttctaagtcttttacccattctttttatttgaattgttgctatatatatatatatatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgtgttcccctctctgtgtccatgtgttctcattgttcgactcccacttatgagtgagaacatgcggtgtttggttttctgttcctgtgttagtttgctgagaatgatggtttccagcttcattcatatccctgcaaagacatgaactcatcctttttatggctgcataatattccatggtgtatatgtgccatattttctttatccagtttatcattgatgggcatttgggttggttccaagtctttgctactgtgaatagtgctgcaataaacatacatgtgcatgtgtctttatggttgaatgatttataatcctttgggtatatacccagtaatgggattgctgtgtcaaatggtatttctggttctaggtacttgaggaatcaccacaccgtcttccacaatggttgatttatactcccaccaacaatgtaaaagcattcctatttctccacatcctgtcccgcatctgttgtttcctcactttttaatgatcgcttttctaactggggtgagatggtatctcattgtggttttgatttgtatttctctaatgaccagtgatgatgagctttttttcacgtttgttggctgcataaatgtcttcttttgagaagtgtctgttcatatctttcgcccactttttggtgatatcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattcgtttgtttttagtggtatctttttcatttctcttaatcatttaataccagtatataagaaaatttttcatatgcatgtgtatatgtgtggtctaaagttgtataaatcctatctttttattataaatattttatataatttcttattagttataaatatgtaataaaatcataaaatgaaaattatctttttaaatacttatagtatttagactatatgtctgtttagtattttattgcatagataacatctcttatagtaatgacatagggtagtggtctttcttgttccagatttttaatagaaattgtttagctgttctgtattaagtatcatattatatagtatttttatggtaggtgctatttatagtgtttagaaaattattttcttcttagtatttttcacttaacagtgaatacgtaatattactggttttcttatagccgtctatcaatactgtatggtttttctcatgtttccgtggatgtgacagcagtttgttcagttaaaaagtcattgacttcctggaataaatcccttttggttttggtactattgaatttaatttatttagtggttttatgattttatatccattttcatgagtaagattagttttcttttttaatgtactacatttgtattttttttattggtttgtgatacttaataaaatgaattaggtagtactgaattcttccttgtattacgtgacagcttatgtacattagaaataatttattgctcagatcctaggcttagaggggtcttttattggaggtagattttttgataatgttaaaaatttctccaaagttattaatatccaatttacatctaaaatgtaaattgtattatttttgttagaaacccagccttcttatcaacattttaattacttggagtataaagtaagaattgtatatagtattctttgttttaaacagtattttattaaataacatgcagtcagtgtgggaaaataggaaaaaataatatactagcagaaagtaaggagaaatccttctgtaccctttagagataacctgttttgtgatatataacattatagcattctggactttttcatatgtatatttaaacacagtataagtttttttccacaaggataggatagtattttaaaacaaatttattagagatagtaaagtgtttaaagctatcttctctacaacttttgtatctatcttctttatagttttctgtagggcatttttatttgactgttagtctgtgttatttattttttaaagagcaggttaaaattttttaagctaaaaggtattttgtgtttcttcatactaccttatctttattttcctctttctttgctccttttgtctgttttttgtttctttttctctcaaggagttggcaacaggtgcatgtgcacacatacatacattttggctcatttgttctttttctacaacgtgaaggtgagtggcagcgaggcctcttgtgagagagcatacccatccatctcactcatcctgtggagtcagcataggcaaactgctgaaatggagttggagctcatttctgcagtccaggcagaggacaatggcaatgtggcagggtcagtctgagaatgtatgttcctcctacctcaaggtgccttggagaagatcagtgctggccttcgatgtgctcaggggatgtacttatgactcttagcatgtgatatgaggtatctcactacttcactctttcctccatcccaaatagtgaacacacttaacaacacttacaacatcataaaactgttcagttttagaggtataattgtcaaaagcacaatgtgaacaaatgcagcttaaagattgaattggctttattaagcaattcatgaacagggcaacatcccatctaaaaaataatattctgatgagcaaagcagagaagactggctttataggcagcaaaaggctgcaaaagcagaaataggaaacaaaaagtaggttggttatttcaaagttacttcccttacagggttacaacagaggagacttcgttatcatgctggctcaagtagaccaggccccttctgattgtggatcagattgcttcaaatctcctggtttttgttgttgttttttaaactggtacatattcaagttcagtttgattatgtggcacctagcacaagtgactgtattctggtttgatgtggtcttttggggtgtactgcagctgctcagcctaatacagtggccttccataaattttatttaacatagacctctatgaatttaattagtaggcttttgagcatcagagtgagactcactacatgttccataaagctgagaaaagccaggttcagggagattttcccttggcccagttactttctttttaaatataaggaacatatctgaggatatgacatttctttgtattgtagctttggctgcatcttatgaattagtgtccttggttttgttttcttttttttttatttttaagttttttttaaaatttattttagtattattattatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcactctatctcccaggctggagcacactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattacaaatatatttcctgattcctcttaaactatagtattaaatatacttagaataatccagttttattaggtactattcgtattactaatgttctaatttttaaacctattaggtttgccaaaaattgactgatgttaattcttcttaatgttttccatactttgttcttgtattttgaacagtttttacttttatacttttacttttgataatcttgttcttgcatgaaggcatgaaatctttttgatgagctttccagttttattagcaaatgtgccctctttataaaattttggatttttcttatattgtactttttcctaagtttgccccttaccctccttttaaaaagtattgccaagaaaaaccctagcaggacactaggttcctttttaagtctatccctagttctccactcctttcatatcaaagttttaaaaaatatagtttacactttctcttttctacattatttagtctcagggactctttattccattgcagctaggttgctacccctctggatccaacggttttgatgtggaaaagattaccagtgatgttataattgttaaattgaatggacactataaactctttgacatcactgcagtgtttgatactgatttttatctttttttgtaagcttattctgtccttgttatttggacaatacatactccttttttaattttataacttaattttgatataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatataataaagttatcaaatcaggaatgttaacagtgatacagtaggacagtgtagtccacaggctgtattcagattttgtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatgtgatgtcccattgtcctcactgcatcatatcaggaggcatgtgatgtctctgtcctagtactggtaatactgggaacaactagttaaggtttgtctgctaagtttctccactgtgttaaatttttgccctttctaattaatatgtgggagatacattgggaataaatattctatacctcagccatctctcatgtttatgttttagtgtccattgatgattttctaattccttctataattgctagttggcattctactaaagagaagagctttccttcttattttctgtttatttatttatatcagtatgggctcatggttaatattcactgggttataatgcattatttattttcacacctcagttgtcccagatttggccattagaagcctctttggtcttttcctgagttattttaatatgcccccatgatttcttgactgtctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcctcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagatcctgacttttccttattgtcctttactggctccccatgtctatgttcttctttagtgttgtttacaaagttctagttctctttgttgtcttgtgtgttactttgtgttacacttatttgaatgacagcctctgcaaactagagtcaagatctaatttaactcgtttttgtaactgtggggtctttcatcatcttaggtaaggtgcttaaaaggtgtttgaatgaaaaaaaatacacacagcaatattacttatgtcagtttataagttgtaagtagacactttatttgagaatcccaaataattaaaacatcagatttttataatgctagatgaacaatcttattctaaccagtacatttattatctttttcatttttatttttttacattttatcctctgtgaaattgagatatatctttagtcagtagttcacattattggtgtgagccagctatgagaaatcactggcacctttgtaggtagagtgaaagcaccagcatcataatgacttaagatttaatgaaatatggtatagttattttggcctgttctgccactgtatcataagatgatttggggcttttgtaatgtgtaaaagacagactaaaaaagtccttaatgttggtgttgggaaatgtaagttgaaataggtacgttacttttctttatcatgtaatagttccagagttatccagctccacagatcacaggactgtgatatccttccaggaagggccctggtcctgtttattctctacctctagttaatggcagtggctttataataggtaaaagatgttaatggctaaaagatggcagtatttatttgaactctaactgattaatttcagtgagcatcctctgcctatgtggataggcagtggcacaatcctcccttcatgatatcttgctgggaatacttggcagaggataatgctgggtagatccttggtctgatatctctaggagactatacaatgacaatgagtctgaatgtgttgtgacttctttttatttcatatatcaattaaaaaaattaacacttatcatctttatccacaggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagaggagaaaagatctaggcctcttgggaggcctttgcctttctcaacccctatttaattcagaccaccttattttctatttatttatcgagcctttattatgggccatgtattatgttacctctgctttatattcattctcatttaatctttttaatattattctttttttatggtgaagcaatggaggcttagatatgagaagccatttgccaaaagtcatataggtcatgcatagagagcagagatttgaatgtagttctgtgtagttcctgaagcccaggctcctaacctctgtcattgtgttctcagtaaactttcatctgaaagaaatattttgtttataaaacagtgtttgagaaattactgcattacattatacttgttttcttgtgtaatctagaccccttaagtgtttcagaaaaatcatttgtaaatttagaccgtaactttcttatatgtactcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaacagattttataaatgcaggtttgtgtgttggctctttattttagatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcaggtatgaaaatgcgtatttcataagacaacatcttgaataaagtagccacttagctgctagttgctgaagggttgaacaaatgggctttattagccaacattatccttgtttgaagtattcattcaaaccagatctaaagcaacttaaaaatgccagagccttgactatgccggttatgtgttacattttaatggaaagtgaacaatactagatcaatatacaatggataacctataatacactattattaccatctcctttgccctcattataaaagccttctactgtgtttgattgatttcatatacttttgttgaataaaacttctggtccctattgtacaaattggtaagaaaagcaattcaactgcaaaaacacatttattgaaatggagcacataaagagtgtaattatctgttcccttaataacaatttcaataatagtgaatgcttcccagctctggtgtatacacatctttgcatcattctgatgtttttgacttacagtaaactttaattaggaatatttatacttaaatacatttaaataaaaatcaaaggtatgaatcatttctttagaagaaaattgtgctaatgatggaagcatctcattaaaccaacttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtgaaatgagatctttttaccttcaatgagtccttagaatcacaaagattttctttgtgagcctctcactgtggcagacatgaaggtgttttagcatggcagccttcttaaagtcatggagcccttctatcaaaatgtgactttaatagttatttagaaaaactgcccaaggttagggattgacttgatttcattttcttggttcctacagccatgagaaccactgaggaattctgaacaacctgctttctagctagggttgggttaagtaggcataagagaataagccagtatattgtgtggtggaaggtgtaataaaaaggaagggttgagtgtgggggcaccctggcctgtgtaggtgggcaaatagctgtttatatttacaggtatttacactactctctgctcaggtgaccagggatggggaagttcttaaaagtgaacaagatgtttcagctggggagtcccagtgcattcatagtattgtgagccctttgttctttttttggggggtgctactgagactacctgaggcacattattgaggaaaaaaaggcttttttataatccttttgctatgtcatctaacctttcaacaattgcccctcaggatgataccttgtgctcatttagttccagtggttttgaaagtgatttccaggcacctgggggcatactgttgaatgagtctatataatacttagagattttttctttttaaacttcttggccgggcgcagtggcccatgcctgtaatcctagcactttgggaggccgaggcaggcggattttctgagctcaggagtttgagaccagcctgggcaacatggtaaaaccccatttctatggcggcgtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgatcctcctgcctcgccctcccaaagtgctgggattacaggtatgagccaccatgcctagccctgttcaatttgttaacgtcccaaagaaaatgaaatttaaccataatgtacagatggcatcttttgatatgtccagctcagcaggttcttctactttgcaagtaaagaaatatcattctttgtcaagttcatttttggtcaagtactatatattttaagttggctttttctattgaccgtcacgtgatttgatgtttcggggattttatttttcttggttacagttaagttgacatttcttacctggtaaaataaatcaggagcaaattgcatctgtatgttttcaaatgtgatgttgggtcaattgatttgttattggttccatatatttaccatattaccatttaccaattaccattggaccatatatttagtgagtgtcttcttcctgccaggcgttacaggctggttacttggctttcccagtgttgacactttctggacaggcttgagagttaggatagatgtgaagtgttaaaggcatgccattaacgtttgtgatttcttttctttatatgtgctttacacatatgtatacaagatactctatatctaatagtaaacccttttttatgctggctgcctaggaaatctagttggagctcaattatatcttatatctatgatttatatatttgattatttttactcatttttttttggtagccttctttctatgtggtcaatctcattcttcatgtgttttttatcgtaagtaacctaaaagtgttttggcaaatgtggaatgttagtaaattactagtaaagataaagtaatgtgctaatgtcagaaaactaagcattatatgttacataaggacgctgtggttatattttactcaccaaggtattatgttactgctaaaattttatatttgcaaagcaatttcagagattacaaatgtaaaaaggaccatatgagatttaaatttagttaaatgtttataatttttataagatgcttcattctgtcattggtgttctttgagatactttcgtaagtttttatattgtgaattagaatttacttttggatgatccttgaagtgaaaattataaaaatacttgtcgtttaatcactgatttcttaagctttgtctttgtaaatattgtgaactgctttgggttcatccacttgtataatttcattttcacaagccctttgtcttagtttgtattctcagactttcttaaatgatgccctaattcagtgatttccaaaggacattctgcagaatactataatagaatatgaaatacaaaagctattccatcaagctattggttagagtccagagaagtagaaaccaaaataactaattcaactcctaatccttatctgatggtcagtattgaaaaggacactgtgacaaatactcagattattggtggcaggtgacaagtgtgtggatttttttttctttagaagaggaaatatgactctataaaatgttacagattaacatttattcccttttggttttgttcaaagtacacttttttctatgtttaatcagataattttagattagagaaaggaatattaagacaaagcaaacttcaaagtctgtatatgtgggaagtccttattgtcttactagataaatcattttaacacctgggctatctggtattcaatctctgtggctgggctttaggaagtccttggtaccccacttattatatgccaagttggtacatgaccatatttctccaaagataatccattggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaaggtaaggagaaaatatttatgattccgtatttgaaattgaacctttattattaaatgagactataaacagaaatccttagcttctttgtcctacatcacagtgcttcttagaatatataattcttgtgtaaaatataatccattaggaagaaaattattatatgctatagttccatatctaaagttgtcccgttcctaacactccttgaggattaaagaggaatttacttttatgtgattgaaaatatgtacctaccaagttgtgatatttagtcttcagggacttactgtttttgttgtgcttgttttgttttgttttgtttttttaccaacattgaaagtctgttatttctctctgacagctgcatccttgtgatttagtagcatgactggcagatgcagatgaacatgtcatgaattttgcaaacaaatgtcctatgtccagagaatacactaacatttttttttaagtgagaagacttctaaaattaatcgtttgcctatggttcttactctttttttttttcttatggaaaatttaaaatgtactgtaaagttctgaaaatagcaaaaattgttccccttctccccatatccatggctcagctgcagcattcttcaactcaagaccactcttgtttcagccatgccacactgctgtctcactcctccccataggattatattgaagccaatctcaggtttcatatagtttcacctgtaaatatttcagtatgtatctctaaattataaaagttctgtttaaaaatataacgataataccattatcacacctaaaaaactaacaataatttcatgatacatatctggacagattcaaattttcctcatctcataaaaaacaattcttttaacacatgctttgtttgagtcaaaattcaagcaataatcatatattgcatttgatcaagtttttaattacaaaattgattttttattgatacataattatatatatttatgggacacctatgaattttgatacatgcggagaatgtataatgatcaaatcagggtatttaggatatctaccacttcaaacttttatcatttgtttgtgttgggacaacaggcttttaaagtcttttttttttttttctttttaaatgtgtcttagagactctacataagaagattaattattcagcatgtttattatttcacatattgacatgtaaaagtagaacatctgtgaaaatactatagaaaggaagtgatattactgtttaggaaatttgaaagctgatggtgaactatagtttagtaagaattcaagtttattaaataaacctaagtaatatcaaatagataaataaacctaataaaatatcaagtttattcaggattgttacagctgaatttttatcagattatgaactcggatcctaggggtatgtttaaattatccgtgtattttcctgagagatgatgctcatacatgaatatgtgatcagaggaagggatatatatatgagtatcttatctgtaattacatcttactaggaagtgattttggttcatagaagcatctggtctcctgtctgactgaaaaaattagaccctgattttagtattctacctatttcatcctttgcctactagaacagttttttaaaagtcatttaaaaaattgaagtgccacatacatagaagaagtggacaaaccataagtgtgcatagaattttgcaagtttaaaagtctccatgtaaccatcatccagattaaggcttagaacttttattgtccctcagatctctttccagtcatcaccaactgccgcaaaagcaaccactactttcacatctgtcaccatgattactgttgcctgttcttgaattttatacgatggggaccatacacatgtactttgtgtctggctttttcttttcacattatgtttgcgagagtcatccattctgttgcaggtagcagtagttcattcctttttagtactgtgtagtatctctagtattcattttttgatgaatataccacagtttattcattgtattgttattgggtatttgggattgttcccagtttttgtctatcacaaataagtctgctttgaatattttgtccatgttttggttacttgttatgagtttacatgggtataaaatgggatgtaattttttggccattgagtatgcacatgttcagctttagtatatattgccaaactgttccaaaatagatgcatcaattgtgttgtacaagaggttcagttgttccacaccctttctcagtttgtattgtcaggatttttgttttccatttttatccttttgatagatgggatggttttattttttatttctcctgtggttaatgaggttgagtctcttttcatatgtttattgccatttgagtatcctcttttgtgaagtacctatttaagtcttttgatgattttttaattaaattggggttgtctttttcttactgtttatagctctttggtacattttgaattctatcttttttcatataaaagttatgcaaatgttgtctcctactatgtagcctgcattttcactttctcatgctgtcttttgatgaacagaaatttttaattttaattaatcaaatataactatttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtctacactctctattcacttttattggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacgtggtgtattttgtgtattaatgcaattgatttttgcattttagccttgtatccagtaactttgttaaatttatttattatttttagttatttgtggattctttatggatttcctatatatgagtaatggcatatatatgtcttcctttccaaagctttaaatctttccatctactttcttaccatgtacaatggctgtgtcctctagtataatgttgagtaggcgtggtgaaagcagacataattttctaagagagaaaacattcgttagtcataatgtttgctgtagaattttgtagattccctttatcagattatggaattttccttatattcctcatttacagagtgttttttcatgaccagatactaaattttattattttcttcttctaggacattgctttgtgttaggcctttatgtcttgtgcaatgattgaaccagtaccccaagatgaaaatttggtagagtatagggtccaccttaatgcattttctttctctccaacatttttatcccttaagttctggctgctttagttctttaatgtcttcaaagctttttctttctacagtttatctagttatatctgtttcttgtgggatacttaaagttactttgtctgaactggaagcataaatttaatattttcttttaatgaactggagaacaaaagtaaataactgagttcagatggctgaaaaattgacgtggaatagccaagacagtcattttgccatttgatcatcatttaacaatttttgtaatttttcttatgtgttgtcctgatagaattcttacatttaagattaaagttgttgccttttaatgtaaaaaccatgtgaatatttttatttggttattcttaaaggtgtcctaaatatttactttttatgagctaccaagagactttctagagaaatttactttaaataattactttaaaaaatactctagcacaggtactgagttatttttctacccttaaagattgaattaagtttttgagaaagcctactaggctacttatctaaactgctctgggacattgccaagaaggaagtatttttatcttggctcataccaaaaactaattgaaatattttcaaagggtatactttattgttaatactaattctgtagcatgctatagatttctaaactttgaagttcaaaatggtttttattgtctaaataaaatcctttgttttatgtttgaggaaagtgagactcagaaatatttagatcgtagactattttgtcactcttattatttatactttcctgagctcatctgtatctgctggatatgaagttaatgccatatttccttctattcgtgactcatttcttttatggttacacacacacacgcgtgcacacacacacacacacaaacacacacagtcttcttcctagtaatgcttgtgagtaataatactcttagtgttagctaaaacatattgagtgcgtattatttgctgtaaattgcttaaagtactttatttaacttatttagttatctgaacattttctggtaggtcctatgattgttcccattgtagatgaggaaattgaggcacaaatagattaacttgcccaagatcactctctgtttggtgaagccaagatacattggctacaccaaattgaatacagttgaaaattgcttatctttaatataaacataaggatttagaaataatcatctattttgctgtaaaaatatattgcaccacaactagattacagtcacttatatttgccttatcagtatcattgttgtaaatgttccagtcgcaattttgtctttgcagtgaataagtgatagctaaatttataccattattggccagtcatggttgtaagtttttttttgtttgtttttgagatggagtctcgctctgtcacccaggctggaatgcagtggcgtgatctctgctcactgcaaggtcggcctcctgggttcacgccattctcctgcctcagcctcccgagtagctgggactacaggtgcctgccaccacacccagctaatttttttttgtatttttagtagagacggggtttactgtgttagccaggatggtctccatctcctgacctcatgatccacccgcctcagcttcccaaagtgctaggattacaggcgtgagccaccacacccggccagttgtaagcttttttcttagagccctattcactgtaacgtggatagacagagaagttatgtaatatgctcaaaacacatgtcagataagtggtagagatggaattcaaagctatgctattgctaccttgaatcaaaatgacttgcaatatctgtgtgtgtgtgtgtgtgtgtgtgtgtgtgtgtgtgtgtatgtgtgtaggaaacaacaaaatccgcatctttcttttaaaaggaacacattccctgttaaataatctgtttatttttgacaggactgccttttaatatctgtttacaagatttggtatcgtgtttctttttgtctttgatttgtagaatagtttgaactcataaaaacgaatttcttactgctgatttaaatcattagtcagaaagaccggtgtgtttaagcagccagacttgccattcttagcactccttggatttaacttctactcagtgttacctactggtagagtaagttcatttttttaaaatgacctgctgttcttaaagtcccttctccttcacaagaactcaactgggggaaaacggagatagaggagggtatgatatatgaaataccttatggctaacagaattattcttctagactttatggctaataaaactgttattgtagacttctggaacactttaatatgtcttttatttttgctgctgccctcatctttcatttatgtggattaatccatgcccaaatcattgtacactttgaaattctagagatatgtaggagttttcatattcactgatttgtagatctaaatagctctccttttaactgctgaagtgtataagttttcccttagtttaatttgggccttaatgtaagtaaaaaaaaagtcactattattttcttccctgcttctgatttttataaaatctgagctatgtattcatcttaacttggaaacacatgttaaatatttattattaactttccctaacagtgtaagaagtaaataattttaagatagaatgaataattgaagtgcatttttttaaaactagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaaggtacttttacctttctatagctacatgtattttttcactttatattatcataatctttttgtagagttttacgtaatatacatcattcatgtagtacattatgtagtgttaagctctaattaagcacttagtgtaattgtgaaattttaatgcaatcagaaatacgtctccaaactacaatcaaattattacatgggtttttgttctggaagaaaaaatagtttatttaaattagatttttaaggagttgtattctacattttgtatttttctaattaatttacctgtgttatttgcacaccatattaatattcagtgacaccatcatgagtgtctgcaggctggtaatctgataggcttctcattggaaacataggtgagcatcaaagaaggaaatagggcctcccagcagccaaacgtgagcttcaaagttcacagtccaaaactaatgtattttgtatgtgggagaactttagactaggcttcatctcagttcttacatacttatttgaagcacatttctataggcacagtcatctgcatagaagaacaacatttgaaaaaatgatgactgatgggtcagatagtgattgaaaatgtaaatggatacagagaagacagaaaagtctgtagaagacataaaaacactaaactgacactatccaggagaactttcaatcactgatagaatgttctatagtgataggttctatttctgcactgtccaaaatatagtcattaggtacatgtgactattgagcacttgaaatgtgcccatttaattttaattaatttaaatgtcaatagccatgtgtggctatggctaccatattggagagcatggtcctaagtaactaacggaggctggttgttgataaagttaaaactactccagaggctcccaaagttttctctatgtatagaccagtaaagtaattcattttcatgatgaatcttgatgtttgagttagattgtacttaccgtcttttatatactagtggacattggttacattttggaaaggctttttattaaaaattatgaatttaagagttgtatttttatatggtagttttttattgttaatattgtgctgctattaaatactatttcaaaagcctaaccttttactgttactcgtaatatgccagaaaaatgtctcattttaaaaaattattttcattattatagatacatattagttgtacatatttatggagtacatgtgatattttgatataagcatacagtatataatcaaatcgtaatttgtatattcatcatttatgtgtttcaaaataactaaaagtagaattggaatgtttcttacaaagaaataactgcttgaggtaatggaatatatcttattaaatttaaaataatgtttacatattatagtgactatccattcttaccctacagaatatcaaccagttatctcttatactattctaaacttttctgttataaagtgggttatattctcaataatgtagagatcgttttggaccactgaattagtgatttttaagtgccaaaaagaatattggtttatcttaatttattgaacatattcaaggcattgtggttactgctagtaatatatttggaaaatcctgctgcattaaaacaaaccaaaaaaccatacaatagttatgactttccaaatgtatttatttatacataagtttgtctgaaaatagtaatatttcatctctctgctcatttgcaaaatgtggataaaatataaaagtatagggaagacaatatttcccaaatcttctttttaacattttagggtgtctggatatgcatatgtactccttttaaaaccaggaatatttgccatggatatacgttaacatagatacacaatttagttaattcaagcttagtgattgttacttcatgatttttggaaggattagaatttaaaagtggagattgtttactctcctttgattatttctacagtttagagaaatgcatcattttacaaacaaagtatttctagtgtctcctcttttctgaatcttgataacattttcaagttgccttgattctgtctgcattgtccttaaaacatgtttcgtgtatagaaccttcttatactttttacttcatcaagccatgtctccttttaaataagtttttaagaaaaacttatcttgagccatatcctctgatgaaaaaacataaaaggtggaaattatagcccccatgttcttcttagactgaaggttttttcctttaaaatatactacaaaggacattttttttttaagagacagagtcttgctctgttgcccaggctggagtgtagtagtgtgatcctagttcactgcggcctcaaactcttgggctcaagtgatcctcccacctcagcctcctgagtagttaggactataggtgcatgtcactacacctggctaagatagagtctctctatgttgtccaggctggtcttgaactcctgggttcaagtgattttcctgccttggtctcccaagatgctaggattacaggcataagccaccatgcccagccgacatactgtttatcatctttcagtttgtattgttaaattctctgtatttgttatatgttatcattcaaaactgaaactaaccctttcccctgaactattcttgggccattattttctgcctctcctctcctctgagtgtcccgctcaccgaccatgcctttctttctcatttctcttaatgtgtatatgtgagagtaaatgatattctggtgatgttcatggtctatgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttctttttttttttttaagaggcatattgacataataagctgagaagcatagccaggaaggaaaaagacctataaaccttatcatatgtggatgatataagccattgggaatgagaaaggatgacctgggtgttggtatcaaagccatctttaactcattgaagggctctcagatgggcaagggagtagaagctaagttatttctatattaaagactttgaaacaatgagtataggcatggtctgagataacagaggacttggcaaacagagcttcctaataagggggaagaaatcttaccttttgtagtagggagttctctatcctcacgccagcctttggatgaccattcattcattaggatcagtgcagggggcattcctagattggggaaggagttttgactattttatttactgtagtttagactattcttcctgatactgtttatcagcagtgttgtgctttgataacattttaaagtcatttaaaatatactgtgattttcttaaagaatagattttaaaagtgaatatccttagtactactccttgatgagaaaagcgtatacaacacataaaatcaatgttaaaaaattgactcacgacttatattactaattgtagtaaatgttaattaaatttttagttacaatattttgactggctttctagaaattgggggaaaaagatattcttgggttttcattagttgatttcagtccttaaaaaatgcattcaaagtagtatcttgaatatcttctccattttttaatggcaaatatatatgacacccacctgtcgaggttgatctggggttaaagtagaaaaccctcattagatgataaagatggtatttctcccacagaaaccatttttgaaagtaaggtcagatcctccttttttccttcttacctgctcctggcctgcttggtttgttgagagtttaaaagtgagactgcttagaatcagaccagggtagagctcctaagaggacatagaaaagtcattttcctacaccgcccacttgctatctctggctgtcatatcgaaagagatttgcttataggtcattgagctttggctacagaagattttttgtatcttgacctgtctggaagagctatcattggttcctccatatgttttgtgttgcttttagcttataaaaacttccccgtgtagaattgcgtgttagagaaaaaaaggtagtaagtctcaaactgtacttggcatttgtaaatttgctatgttagtacttcacagttcattgaaaagtcataaacaattaccaagtcattagcacagacattttaaggaggaaatttcaaaacataagttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatggcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagacaaactatatagtggcagacatgctaacatctccttaatacaacaaccataacagcaaactaagaaactgtgattcccaagtgatttttcccgaaccgtattccgtattaataggataagtgtatgtttggaaattagaggccctgaaaaaaatcctgtattaatgaaatgttgaaacgtttagaattttgttttacccaatgtttcccaaatgtactgtgtttcattttgttttgttttaagcaaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaatttcagtgaccaaaaaatttaacagggataaagacaatttcattattcacatctgtcaaaaactcttgttctggttctcttgaacaagaacatgaaactaaattaaacaaaacatctattttaattcttggggtatgacttgtatacgaattgaattttcttgtgagctgaattatctcatgtttttattcattgttaaaacccttgttagagctttttctaaagtagcaaatcattgtttttttgatagaatgcttcaaagttattggggtgatcctactggatattattatttggtgcgatattcatagaaagtatacatagtttgattatgtttatgtgtttcaggtgtgtccagaaagctttcggttttaaatggattcttgtcagttatatcttctgatgtacttagttctaggggaaaaaagagcaggtttgtcatagattcattataggtttcactttgaatacaagatgaagatactggtggtttggctattagtaatgaaactgaaaatattgtatgcagatttttaaattgtttctcagactaataaaatttttgatttacagactttttcattcgttaatggttttggagaagataattggaaattctgcatttcttcttattttgaaggacaaactcacatacgactcttactctcctgataccttcctggagatggttagtaatttcatctatggtcatcataaaaatgtgtaattccattgttcttgcattagcaaagaggatgagaagcttaatgaaaaaagacattgaaatataattttttgtacattatttgaaagaatttttatcacttaatataaattacctgtatgttcatcttttctataaatatttcaaagtatgtgaaatatgtagggttttagaatactattaagatgttagtaaggcaactggggcattataactagttgttttgcttggctttaattagaaaccccttgatatttaactttttataagtccttaatctgttcctcctaaacttgaatttgaatggtcttctggtttcaggatgagtccatggagtgttaagtaaaattaaaaaattactgttcatttttataggatttgaaacaaaaatcacaagattctctgccacaaaaaaatataataaggctgagtgcggagccaaggtaaattcataatttcttacaaatgtttaccactttctggcttaatagtttttggttttatggttctggtttttagttagcgtatattttgaggcaatcaatttattaattaaaaaactcctaaaaaatggattttctttcatgactgtgttatgctcagtgccaatagctaacacagtgcttagtatattgactgctgaataaattattataacaatatttctcacagatataaggtatagcatgataaatatatagcttataaaacattttcttatctctataaaattttcagattatatcctttcttgattaacctttcatttaactaccttgttttcattaatccctgatcctatttttatatgaaagaagaaactttattattattggaagatcaaggtttctactgtaaattgtttattagataactgtcattttgctggtgaaacagccttgttttagcactattgatttatgctaaagtaaatgggaagggtgttcagtgaccttaaaccagggcatttaattggtggctacctaataattataaagaaatgcattatgttttattggtatttctttaaacagcaaggtatctgtttttaataaccaaatatttgttggtcatttcctagttgacccaggcacacagtggttattttttgtaatataacctttaactgtcagaatcaagatatttagtacctcctcttgccaattataggataaaacaataatttcaaagagtaattcattatttcaactaaatatattttattaaaattatttaaaaataaatggaatgaatgtaaaaagaatttatagttgctagtaaagttgagactttttgttaagcatagactaaagtcttagttgtctaaatttctttagtaagtagagacataaggtgtatacagcttattccttagaacgagataataagtttttttattttagtaatactaatgttctctgtaacacggcagaagccttaggagctttcagattgccaggtcatagttaggatgaaaggataatgacactgaaagaaatatttcttataaaattacaaaatgttttctttgtcttaaaataagttatgttttgatgcatttggggttatatgcctgttccttaaatattgtgttcctagtaaactctggcattagtaaatctatttggctttaggcatagttctctcatctattaacttttctttctttttatattttggtggaggaagatctttgtttttgctggttataagaataatatatgctgatataagtgatttgtgccccatctctgggtgctcttatgctgggtgcagtgaggcagggctggaaccataataggtcagaagaaaagatgttccctttagtttatctccttccttcactgtctttgccttagcaaacaataattgataattttgcctttctaatgccagaagaagaaagttaggaaatgtagtatattaatgaaagagaaaaatatttttaagctttcatattgaggagttttaactacaggtaaacataaatggaatttcgggggctattagtaaaatgattgctttttgatatttctttttaaatagtttttatttaaatagtatagggtttatcttcctattacttctttacagttctttttttatcaaatattgacttcctatttctgtaggttggtaaattaggaatacttctgattggcagattcttatttgtttttatgcttattatccattttataggttagggcttcttagattttaggttttaaaatctctattttacttgttagctgcaaattattttagttactgatctgtcagtaaaaatagatgaacaatgaaggaatgatagtggcctttaaaatggaagaatttgattgttttatttagcaggtactgaaagtaaaataattgcccttttcagtttttaaattggaagccttagaggtgtggctgtgagtctttgtcatattcttcatgagtcttctttaatgttgtaagggttggctttttttttagttataaacacagttcctgtttgagtaacaaattatctctctaaataaaccatgcattctcgatgggggagatattttttccaagagagtgaaaattggtttttggggatttgaagaaaatcttactctttttaatatataaagcacagatatagtacgtaacaggtaaacagtttgtgtgtggcattaaaattgtatgtgggtgattagtaaatgtctaaaaagagtccttagggaggtgataatgtaaaaaagattgagaaatactaacttaaacccatagaatataaataatacacgtaaatttgatcatgctgttggcaatattagttatagcaataaacctaacataactttgtaagtatttaaaaagtagtccaagatctgtttaaagtgacattagtacatgttgatatgcctaatttagttcacacagttatgtgagctatatcatgtgtggattcgtagtttttgtgtagaaaacagatacttcagaatatcaactaagatataaaaagaaaagccctcccataacgcattgccattggcttgtttaatggttctccctggatgacctcccagcaccaataatttaagttcctctgattttctccatacatgctttccttttggatgccagtcttgattaaaagtattgttatctttttagttatctaggttctgaaatcccagaacctactttgacctctaccttttattattccttaaatttcatcacttggagagtcttttttttctcatctgtgaaatgcatcttctcttttcctgttactttttggttctaagccatacttcgtgcctgaattacttcaacagcttcttacccttttgtcttcaatttcctatgccccttatttattacatgaagttatcagaggaatctagccaaaaacagagctctgagaaagtcacttctaaattcagcattctctaggtacttcttcttacctattgaggaaagtctgacctgatggtcaaatgttttagtagactattgcctaacaaactaatctaaaacttaatgtcttaaatacaatttattatatttcccacgtttttgtagaactgctggtcagttcttgcttggggtctctcataccattgcaggcaattggagattgggactggagttccccaaagatttgactgggctcagtgtgcaggagggctcatatacattgctgaaagttagtgctccctgttggctgagggttcagttggagctgttagctgccagtacttacacatggcctctccatatgacttgggcttctctaaccatagtggctggttccaagggggagtgttttaagattgaaagtctcaaaagtgagttttctgggtagaaacagcaagacttcttaagacctagctttggaagtcctagaaggccattttcattacattctattggtcaaggaagtcattaaggttagccaagattcaaggggagggaattactctccatttcctgatgtgaggagcatgtataggaagcagtgggaatgatggtagtcatcttcggagactagctatcacagttcacctataggctacctcagttcacatacctttcatgtacggagtaacctcacccacctcccaagatgtccaaagtctcatcccattatgctattagccccaaatttctacctagatcaggccaaaatgggtcactcatatggctggcagttaatgctggcttgtttcttccagtataattatttaaagttaatcacagtagattgtaaactccttgagagtaggaattatttctttatttctagcatcatgcctgtggtattatatgcaacatagcaagagtaattacagattcattgaaatacatttaaatattgactgaagagaatattaagcttcagacaccagatatgcatagaagaacatggttcacattctatgtgaaaatgtggtatcctggtatatattctcctcaggtggttctttggtctcatatttggaggttgggtgccagagtgcttctaagtaaactttaagaccgttacaaataaagataaaccataattcaataaagcttggaatttgtataactgtccatttaagattttagttttataccatgagacctgaaaaatttcagattgcatctcagcatcattgcattcttacagagttaacttcgttaagattggatattgggtgaatgttcagaatggatggatataaaagatagttccaaatagctgaatgaattggctttatcagattggtttttatatgtaagacttattgttatgatcaacatagcctgattctacattttgtatttttaatattgttattgtaaacaattcttctggcactaattatctattagtttaatgggattcaaggctagcttttttcttttcttatgttatcaatatatttttataccaagtaagaatgtgtcttagaaaatatctaatatctctaccagttgtttacacataagttttaaatgaagaagccaaactcgcaaccttatttttattgtttggaaatggaatttctaggaaaatagaattctgaccactcagattgtggcagcattatttgatagaggcatttggagcttaacggcggaagtgagattccatgacttgaaccaaggcggctctagtctgagaagtgagtctggtgaaagagctgttagtgtacagagggagcgcactttgtgctcaactgtggaggagatggaagtgttagctgcgataattagtccaggaactgtccttaatagctcatggattatgatggtttaagcttaaaccttgacacgtactagaaaactagtatatagaaatgtctttccattagttaacagaaaaatgagtgtaaaaagtcagtaagattaaaggttttctttcttgaaactggtcggctatattttttaattatcctaaagaattcaaggcaataatagaatacaggatttgacatcctggaccctctccagcttctgttattttgagaaaagctgagatatttttaccttttaaataaagctgttttgaacttttcttttggtgagggaattagtaactgatggtcctagagactcttaaacacataaaaactaagctattctgtattccagtctagtttagttgtatctaggcattaatagtacagtgtatttatgaattttattggatttgaaggatgagtttataaactgtcctctaggatgcttttctgtttaaatatatattgcttgtaaaaggtatttgtatgttttcacctatgttctgtctctgttatgtgttaactctgatttttttcaaggtataggttggctagttccctgattatccagaagcacttttcatcttgtctgtagtctactggagtgttttcagaaaggatgctttatccaaaagactgaatggaatatgttatattatgtaaataaccaaaagtttcttaaggaattcaaggtacctgcaagatgctacgttagttaattttatgttaaaaattatttgcattgactagtggttggtactagtgttggagcagtcatggcttggtagcaatacaaaataatcttatttggtgtttgccattccaattcagtcatcacaggattacattttgcctaatttttcaagaaaatataaaggtctcttggggaggaaatgaggagaaaaggctccacctttgttccagtccctcccacccttagcatttctatgtattttatgacatcaggaatgatgagtattaattcctgacatactgtttcaacctcacattgactgaaattaaataacatctattatattaaaaaaatagttgacacttccagtttacgtgatggctgactagagaccatgagactgactcttagtttcccattaaagctcatatgaaaatgtagaagatgatgaacagttgtaggaataccaaaaccttggcttgacagtcagtgtattatcacaatctaagatgtccacaaactacaaagctgatagaactggtctgaaaaatgcaattacttgctgattaatgataagcagttagaaataaaagcaacctgcatgtcttttaaagcaagtatggagaatgattccttttccttttcataatgtctacccccaaggctttcaaattctggtattatatcaactagaaaagtgaacaaatatttttctattggaagagtgctacttttgaggctattaggaagttaggtagcttttcttttttttctcttcttcctccctgcctaaggtctctgttgaccatcttcatttaattgaccaagtagatcaactgacactcttcattccttttcagtgcccatggtaatgtggccttgtagctaacaggctgttagctagcaggccaatgtacttccctccctccagtctttcagttgtgtgattatcatgaatcagttatttattcctaaacaagttgttgttatttttttctcataaaccattttattacgctgttgaattacataaaaacccttttttatgaagttgaggactttggaaatattcagcaaaggtgagtcactgataaatgttggcgagatgactgcaaaagatttgggaagaaatcataaaaatatagaagccggctgcactcagattttcttaacatttttgagtttaagttcttgctatactttagagaaacctaagcttggaaccacagaagattatcacatgtttggttatgcagaaaatatgaaaactccaattactggttccatagtcaaaggatttgcatattttgaatatgatacatgtatatatttcatggtaaagtaaaatattaagaataacacatacatatcataatgatcttctactttaacttttattttcagctcaactttaactctttctgttaatagatctattgccagccttgatcacattgatgaaagggcttccactgtgtccatattttgcaatcaatttggagactaaatctgccagaaataaagtaggcaggaacaaggaaacttaacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagactcagaagtgtagcttacttattaaaatgatttattacagagaccagatgaaaatttttttaaaaaaagaggacctggaactctcaaaaagttttgagttataatctctgagaaatatgaaacaaggtgaaacactgaaacaaaaagatgacaaaaaatgaaaatgaaaatatttggaagaggagaggagtgagataaggagagattgttggaggggcaataacagaccatcttcactagtgatgctgaagagtaaagctgacactgaaagagggtatggatgtgaaaaaaaagtccatgagatacttttttaagaatgtagacaaaaggaagacaaatgccaacaatgagaaggaagatgatgatcggtatggaggacaagattccaacaaaagaattaaaaaactttaggaaaaaatacagcagaggcaatgatcaaagatataattgatgaaaagttttctgagctgaaaaggcctccctttatagatgaagagggataagtgctgggtaataaaaatgaaaaaagagccaccccgagtacaccatggtaacttagttcaactaaaaggaaaaaggacatattaaaaaagtgcccaggcagaaagactatattgtataatatagaacaaacgctagactgacttagacaggaagactatgaagttttgaaatcattttatactcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagtgtccatttagttttgatagaatttaacagcaccatggatctgcagcttcaggttatattaatgcctgaaataggtggagaggcaggagcatataggagatcctaaataatagtttttcttcaagaagatttaaaaaataccaacttctggtgagagtgatatttcgtattccattgccttcacttactatcagtgtactgttaactcctcaaacatctgtctctgctgagaaaagtctcctaagttctagacccactggccaagtggatagctctcttgggatggcccattagcagctccatttcaccgtgtttaaaacggaactcctcttccctgcttgaacctgttctgtggtcccaagctctttcaattttagagtgaccagatatgacagttttttcactattagcctctttcactctcaaaattagtttggacaataaattatggggctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgggtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatggtaataaccctgtgacagatgtccctgcctcacacatttgttggcggagtttaatacggttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagagaactatcaattcttggacactccattttttgttatattacctctacatctttactacctggggggttaaaaaaaacaaaaaagcaggccaggcgcagtggctcatgcctgtaatcccagcactttgggaggccaaggcgggcagatcacctgaggtcaggagtttgagaccagcctgaccaatatggagaaaccccatctctactaaaaatacaaaattagctgcgcatggtggcgcatgcctggaatcccagctacttgggaggctaaagcaggagaatcacttgaacccatgaggtggaggttgtggtgagccgaggttgcaccatggcactccagcctaggcaacaagagcaaaactccgtctcaaaaaaaaaaaaaagcgaaagaaccaaatcacaacaaaaaatctccaatcttggccgggcatggtgacttaccctataatcccagcactttgggaggccgaggtgggtggatcccctgaggtcaggagtttgagaccagcctggccaacatggtgaaaccctacctctacagaaaatacaaaaattagccgggagtggtagcatgcacctgtaatccctgctacttgggagactgaggcaggagaattgcttgaaccggggaggtggaggttacagtgagtcaagattgcgccactgcactccagccagggcaacagagtgagactgttgtctcaaaaaaaaaaaaaaaaaacaacctcagacttcacctctagatgcacccgaatgtgcacacacacagacatgcacatgcacacatacaccatttgcctgataaatttctgattgtcttttagaactcagcttagatgttacatcttacatcctctggaaacttggttgagatccttgaagctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggaaaaggacgtgcatttcagctttgtttatcatgtgaacaaatattttaaaagacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaataactaaaaattggaggtggagagagtgaaaattatgagaaaaagtcatgtaatcattaggcaattaaataatttatccatagtgatgaacccttatgggaaaagttttgatttagaatcatctcgcattcattgttttcttctttaaaggtgaagttttttgtacttgttggctttcctttgttacccaatatgacttcttgtatgtatagtgtttcattttgtattgcactgaactgcatacaacagaaaccttattacaatggcttctgaagaaagccttttattattcttatggacaagtttcaaggcaggtagttagggctcatgatgggttccatggtgccgtcaaaagtccaggctgcttttacctgttagctctaccactgttagcctgtggctcttgttcttgtgaactcaggatggttcctgcttctacatacagtacatctgtgtttcgtccagaaagagggatgagcaaaggaggaaggtcatggcagttgggataaactggggactcagtaactttgtcagaatttccacatactggaattctaattacatgtcattgtccagaactgtgccacatgtctgcatctagcatggggaagcaggttttttttgttgttcattttgattttgttttttaagctatgactgttgccatcctaaataaaattggctttctatcaataaaggagaaagagataatggttgttgggtaggaaggagcagcatctgcaaattagattcattaactagatcaaaaagcagctaccagattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaaatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtgccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagcaagcttcctaaaaagatgcattatagcagaaaccattttgattcttctaaatggcattgattgttactatcatccatacttgggtgcctcagcttttctttgttctgattcccatcatttcaaaaatctgttcaaaaatgtctgtctcttaagaaatctttgctagctgagcagtgcttttcacccttttgtaccacattctctaaacatgtaggtatttaggtgttgactttttttttctttgcgagaattcattccttgactttactgagtgttgtagcttcctaattatacttcaagcttccctcatcatctgaattcattttttcaaaagatttatcgttctattcttgcatctcctaaaataatgctttttgcatttcttgcatcaggcagtttaaagtttatgataggctacctaatacaatataattaaatatatatttttactgtcatttagaagttcgaagaaaagtgtttgtcattaggctattaccagtctcacacattgatttttaagtgatatgcagtgtgggatttgccttagtgctttaacagcataggattttaaatcattcttttcttcaatttcacatgaactttaaaagaatcttccttaccaggcccttataatttagtctgctatgattttgttcttaggtacaaaattcttttagattttatttgtgaaagtaattaaacagatagattgcatttaaagttatattttttatttttatttcttgaaaaataaaggcagagtagcttaatgttctgagaccacctgctaaattgcctggttagtctgtgttttaattgattttgtttatattttaagtcaaactttcttaattaactaattgcatggttctagtttattgtcagattattatacagtgaattcagtttgcaaagtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccatgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaactgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagattttttttccttctaaatgcagattaataaagcgtgcacaacaagaggaacaaggaaaaggattttagtgaaggtatcctgatcctgaaaaagtcagggagggcttcaagcccatcttggacttcagaacacctcacaactttgtggtaaaagaaacattttaaatagagcctttggacttatttatttcatccttattcagagagtagcgctttttttaaaatttttattttttttaggcaagacaattgtatgtgaaatcgcgttacttttcaaactgaaacatagggtttcagatttgttgtaggtacttaatatatactcaaaatattacaggtagttggttggcttgtgtgtttttctttgaaatgtgttcttttatcccttgtgacattgtgtttgcattcactgtgagtgatgttttctctagtgttttgtatctttaatcggttcattgggttgtatagtagggagtctttcctaggaccaatattgtttctaaaaatactttgaaagtagaaagtggtttgtgttttattgttttcatattttttaccagtcatatgatggcttactaatgtgaagagatgtagcactagtaaaaatttgttgttttctcctctattcacctggaaacctcacacaggatagatttcatttgtcaacacagatatagacagtgaatacaaacatctttgccatttctgtccttaacaacaaaacagtcttattttactttgttaactttttaaggtcctttttatttgtgaaaattaggttgtttatgtactatgtgttcttccaaagttacagagttatattcattggagaaatgaattttcttccagtagatgaaaattacattttgattgaacatcattccttatgcagtcacccataaatataatgtcttttgctgtcttttcagaaaatggctacagatgtgatttctgaattgacaaggaaatagaacatcttaatgttttaggtaaaacagatggtatttttgtttgaggcaaaactcagagaaagcaacttaattggtgacaagactcttggggtcagccaaattatatacaatttgtgtttgtttttgttgctttaatatcaaaagttttagaatacttggaatatttattcttttatttgactttactattttctgttgtgtactggaaatagttgtaaaatttttcaatcttttctttacaaaaattgtaagtccacatatttattctgcttcggttacatttatggtcttagaaatgctttttgcattgtgaaaagttcctgaaatttgtagttctacttttgagggttaacattttcatttgtagttttaagttgcatttgcaactacaaattctgtggacattgataccaactctgttctttccatgcctttgagctctaggcagatctcactgtcagatgcctggaatttccggagcacagtgttgtgaagggacccttgcatgagagtcagaggactgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcaatcatttggataaacaccaggaaaggaagttttgaggaagagactactgtggacaataaccaagtgtttccagtaactgggacataagataatctgtcttccaaaatatctccagtattccaaaatgaagacctattatgtagcaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactgaagggagacagcaggtcaccttccctgtctctgactccctgacggattgagtttgaatcctggctgtaccatttctatggctacataaccatgagtaggatacagaaccattctatgcttctgtaaaataggcttgtaaagtaactgctcagcactgttttaaggctaattaagtgctagctgttggtattattatcatcatagctgctaagattaccataacatctgaaaaactctgctacgagctaagtcatttacttaaatatagcaaaaatattcctttaatacagttttatatttgacttactgctttgtctgttagtattataaacaaacataactgtctgccccagtaatattttctaacatagagctttctagaatatttacttaataatatcatactttccttgccattcttagtttagaaactaaaagtttattagtaatattttgtggaattcttgcatttgaggagaataaggtatttgcagcaatcacttagttgccaacagcaattttaggtactgtggtcatactgttttgtgaaggacaactttatatttgcatttgatcacacatgcagcatgcttgtttaccttccttttgaatcttttccttggacaaatggctctccatgggatgataggctcataatattttgtccatgattttaagaatgatttctcctaaatatagagaaaggtgtgaaataaactttcatatattaggaagatagggtagcatttatgtactactatatccaagtaaaattctaatttttattgctgaaagagtgttctgtaccttagcgttgaatttttttttcttgtaagagcaggccatatttgttacttaaccagctagtagcttccagaaaccatcatttaaaatttttcccttgtgaatacaggagagagggcaaagggctagacccacttcatttaatctttgcttggtcccagttccaaggaccccaagctcttcttgcttgttactctttgcccacctccatcctgttttccaggactcaggattttcttttatatatccttggtggtatgaaactggaagttagtcctcattttcaacaggaatagtgtaacctggtatattagtttcctgttgctgctataataaattaccaacaaacttaattctactaaaaaatacacacaaatttattatcttatagttttgggggtcagaagttcaagaccattttcactggattaacaaaatattggtagggctggttccttctggcggctctgaggggagaatcatttctttgccttttccttttctagagatgacctgcattgcttggcctgtggccccttccttgtatatcccatccacttggttctgttgtcacatagtcttcttctctgttggatcgtccctctaataaggacccttgtaaatacattgggcccacctagacagccccgaatgagctccccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgccgtcctgctttgagccttcaccccttaagttctttctctgcctggcaactagaaataggtattaaaaaggaaaatttgaccatgttaaaccttttccatcaactgcacaaaaagctccaagctccttgtaatgactaaaagacaacccactccccactatgacttgagttttatctacttttctaacttcatataattgcattttagagatgcactttactgtgtagcgtctagtggtagtggcctgtatatcttgaaaataacattatttcccgtatatctgtgtctttattactgaaaaggatttccctgcttcctttgccctttaaaaaatttgtttgtttttgatgttgttattgttctgaatttttctaataaacacgtaacttcctgtagaatagtgtttacatccaaagctattaaaaggatttctagcatattcactgataaccctagaacctagaggaggtaactattaacaacagtttctttttagaattttatatatttttatatttcactgcttattctttgtatataattcagaatattcttttgtatttaataatgcaacaaacattttcttgtatttaaaaaattctttataaatatttaatggctattagtattctagtacgtaagtatacttttaattgttaatgtgttccctcaatttaatattatattgattagctaatataatgttttgaatagtattgtttagatatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaactccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcattttctaaggatatttttgctggatatagatttttaggctggcagtatttttttgtttcctcaccacctcaaatatataattccattttctcctggctttcttaattattttgatatgtcagctgatgatcttattgttgcttctttgaacagtgtaatcttatttttactggctgcttctcagattttgccttttcataggggatttaacatgacacaccaggtgtattttctccgtttggggatcacagagtttttttgtatctgtgggttagtccctttccttagttttgggaaattctcagctattcaggtaattatattgtgctattttctcttttatttccatctacacatatcctatttcacatattagatcttttcactgagttccctgtgtccctaacgttcttttctatattgcatattctttttttcaccacttccatttgtatgttttttattgacttctcttttgctgagttaaatatatttattctgctattgttaaagatatctttggagtttttaactgtaaatatttatccttttagaatttcatttgattattttgtaatgtgttaatttctatggtaaaattctctaccttgtcctctacttgattcatgtttttctctttccttggccatattaattataattttaaagtcatgtcagctaacttcaatatctgggtcatgtatagttctagtttctttttttcttggtgtttagtcacgtggctctgtcttttgtgatgcctcttaatttcatattgagtactagacaattgtgcataaaatttagagagactctagaaaatatcttcttctagatagatgttccaatcaaggactatgttaaattgagactgatttattcaacctgttgttcacctggctttctaagtaatttttcaactaatagcctgcttatattctgtaggccctatcccctggtgggttctggaatgtcatgagatgtctctgctctacttttcagaagctttctgttcaggttttaagcttccctttctgcgcagcctcagtatttggcacttgtcgtaatgaaaaaatcaactgtgtacctgaagcctcccaaagtctccacaaaatgctcttttgatctctttgttccccagtgatttcttccagactttccactaggttttgcatggaactcacagcctctcccttgctgagaattggcatgccccagagtgaaaatgactgcagaaggctggtcacttttctgaagttttttcctctcttcagcagtttttctgttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagttttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttacgaatgaattttgggagagttgtgcttttgcattattttagttttcttatttagaaagatatgtctctccattcatttttatgttctactaagtgacattttttcattttctgcgtatattatacattctgctcattttgtataaaattaattttctgttttgattggtctcctgaagattgttaatcttcctaacagccgtgtgtgtgtgtgtgtgtgtgtgtgtgtgtgtgtctgtgtctgtgtgtctgcatgcatacgtatgcatcccatgacatgctattacatacctttgtcttattgcctaccctgttatattgaacttaccagtttgtttctgtgcctctccctcctaaactgtaggtactttgttgactgggattatgtattcatattcataagtttataactacacataccatacagcatctttctctcctttctttgcttgctttttaacttagccataagccatgtggttactttgaatgtgtattctcaccactaccatgttatcagaattcttgtttcaagatatctgtattatcacctgttgttaatttcctttatttagatttatacatgccttacacaaaaaaaggatttatgacagctcattgacctgggtttgttaaatcgttcactgtactacccagtgtgatgatgtgccagggtccttggtcaggataccatgagagtcttgtaagggaaaggagagaagtgaattgttattgagattctttttttgtgcttggtctgagctaggtggttttctaaacattttataatttaacattaacaataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaattgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttctgttaacatgtaaattcatgtttccatattcagaatactgtataaagcttaatgtttttctttaggttatattccactaatgaggctacttagagaagatgaatgcattcttgtttgaaatgatttttttaatatgttgtcattgattaagagtcagacaaaatgagctctaatttttgctttattcttaactttctttgtaatattgaatgtgccatttgccccatctttacaaagggactaattatataatttatattttcgaagaattgaaaagcactttttaaggaattgaaataatcaaaatggaactgctctgataaaactataaagccccacatcagtagatactatttacaagtaataaattctcctagtggtatttttctgcactgatgattcattaactactgaacattattctgtgctaggtacctatagtaagcacatgaaattacagttatttttcatatgccttttggtgtttgcttaactgattttaaagtgcacttataaagaacttgaaaaaatatgtatttttttaatcttcattacacaatcataaaaatatgtaagttgcttttaaaatgtttcctcaaatatcgtttttgcttacttcatgcagtgaggtcatgagatgaactccttagtatatattgcaagtttttttctgttccagtgttccagtatataaattttctttcacaaatataatatacttgaaatgtaaatagcttattgcttatctgagcttcctgaggagagaggctctctggggatattggccttgctaaggagaaagttcttcacatttgaatttggatgcaactaagggaatctccacaggaaacttcagctgtcacaactgtcacaaagatccttatatgcctggcctgtgagtgaagtagttaagaagatgggtgtggaggtgaaattgcattataagccctattgtggcactttttacctgggcctgtcttggcaacattcctgctcttgttgaacctcagtttccttatatgtccagtgagaagaatgaaaggttgccccacaggggttgcccatgcaggtctgaggaccagcccaggcatgcaggatgcactctgaatgaaggtccctctgaccaaggggcatgttccttccactttgtactgcagccagtcctagaaggaagcctgtgtgctcccagtctgttgttcacattttagtgggcactgattagatttacctcaaagagaaaattcagtattccatagttgtcttttttaacatgatatgaattacttctatgaaaggtgaaggaatttttagtatactcatcctcagtagaatcttcaaggacagccacgtttacactgggattcttccataaagtgattcccagtttgataggagcatacagatgttctttcatttttgtccattcgtttttctccagccaaagtagattatcttctgccctctagtttgattggcaggtaacatatgaatgctttttcttcatgaggtgagagtttttccttgtatatggagaactgagataattgctcataaccctgaattatgggggcccaatgtcacagtgagaactaggaggctggacgtgacttggtgacagatgatacgtaagaagctaatgctgatgtggtggaaattggagaagaaaaaagcactgaccttacagctaaaattgaaattaaccctccccattctgaagatataaacataattcttttgttaatgtggatcaaatattgttaattttcagtaagtgagtatgatattatgatatactgaaacctattggtttcattcacaactagagggcctgaaaggactcatgtttggggatattggcagtataacaaatgtttgactaccaaatgtgatgacaatgaaaattaagttatttatgattgtatacttatttccaaaggaaatatctatatatgatcatcctttctctgtactctacttaaaatgtacatagataggagttcgtgtgtcagataaatttgttctgtgatgcacataaaaaacatgctgtgaatctctaatcatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgagtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctctgggaacatgggtttcagtagtaaatcactcatttctggggttctgctttgaacatctttggtacagagaatgagtgatccaccactgtttttcttccccattgcaccttagaaatataggacagtcccattggtaataatgaatcctggccgttgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccctcgccttgagaattgcttctgtgcgtaaaatgggattttatctaagtactaggaggattcgttgctctttgtaaatatgtttgtgactatgtggtttcatctgttcatctcttgtatacatatggaatctcagtgaacataagtaatacaagttaggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcaattaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcctctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatatagtttactaataaaaccatcatgtaaaaattaaatgttatgtgaaggatgtcataatatgctggtataaaatattggaaaaattgtgtcccaaatttcagttcatttatgtttttgttcataccaaaagttgcacgtagttgcaaatattgcctaaacttattttaatagtttgcattttcctttttctacctaatcccaatcaattttttttttcaccattacttactataaacatttggggccctgttacaagtggattcacttcaagtgaccttttttagaatcaactttctttaataataaagtcccattgtatataaaatatatgtgtgaattatgtgattttccatatatagccatacattcttagtggtctaaaatgaatattagatttttaactggaactcattgtgatgaaattgcaaacaaattgtgaattttttttattctgtgagattaggtaggaatcagggtattagttgtatggagctcattcttttaaacagatgaataaaaccgtatttatataagtctttttctggggtacagaaaagctttattacacatctatgaatatcttccatttgtaaagcattaattctttagaaagggcttctgaatcattatttaattaccctttgtactgtgtgatatttgttgtgatgaaattgcctgttctctgaaagttctcacagaatattcctgttaattcttctccatgagttgactctatgactgtccatgaactgaagtattatgaagggtttggaaaaaattagccagatgtagtagcatgcactacacctgctactcccagctactcaggagactgaggtgggaggattgcttgagcccaggaggttgagactgcagtgagctataatctccccactgcactccagcctgggtgacagagtgagacgctatctcaaaaatatatatgtatatgtatatgtatatgtatatctacatgtatatgtatatgtaagaagtaaaaatattttgagatcccaataatgaagcagctgtttttgcaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgaggtatgttgtagccatagaacttaaggaggcattgtaaaacaaacctagccagtatataatttgtgtatgtacagtagcccccatttagccatcatgttggtgtatgtgaggtgatgaaagttgtaaataccagagagtttaactggtgggtcaaatgacactaaaggaaaaatgatcctgtgttccctaaaatgttaatttctttgttagtatatatattgtatcttattatatgttgttcatatgtatattgtatatctttgtaaggatgcatactgtttattctaaggtaatgcagtaattattactcataaaattttgaatgttttgctctaagtgaatttaatgataattatgcatatcgaaagtgagataaataccacccttagtaactttggatagttttaggttttcattgcaaaggtgacataacacaccatggaagagaaatgccctaaaataattaagatgcttcttttgtgagatataattgtggaaaatctgtgctcaagttaataggtattttttgtgccaaagtttcttaaaataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgagacagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagagggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttattaaccgaaatatcataatattgcaaaaaaaattaataattaggaaatggcattgttgtaaagcccttacattcatggaaaatttccttctctaggcattctagagtacagccaaacaattgagaatgatcatacaggttcacatattggataaaaacattagtgcttttgataggcctaccaactttaggttattaggttctctggataaactgagacatgtatggtttacccataagatatcaaacatttatagaatattgttacacagccatgccttggtatctgtagaggactggtcccaggaccctctggggataacaaaatctatggatgctcaagtcctttatataaaatggcatagtacagatgatccctgacttacaatggctcaacctagatttttcaattttataatagcgtgaaagtaatgtgcattcagtagcaaccgtacttcaagtacccatacaactattctatttttcgctttcagtatagtatataataaattacataagctatttatatttagtataaaatatgatttgtgttaggtgattctgcccaactgtgggctaatttaagtgttctgagtacatgaaaggtagactaggctaagctatgattttggataggttaggtgtattaaacacctttttgacttacgatattttcaaattctaattggacataacccaatcatgagttgaggagcatctgcatttgcatataacctgcacacatcctcttgtgtattttaaatcatctctaaattacttgtaacatctgatacaatgtaaatgctatgtaaatagttattatactatagtttttatttgtattttttgttttttgtttttttttcaaacattttttatctgtaattggttgaaactgtggacatggaacctgtggatatggagggccaactggattctctttttaaaaaatatgatagtttgttggttttaccaaaaatataaatggtttgcctctcagtagataacatttatctttaataaattcccttccctatcttttaaagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaaggtatgttctgaatagttctaaaattcatagaatgcttatcatttttgctacaatgtgtgtagattaattaggcaaaaggggaaaaaagtcttaagtagagctgtatcaaatactcttgagtaaaaggaagcatgagctttttgcaccttcattgaccacttgctgctcacatgtatagtctgtgggtggcgctactccgtggtctgtgtgtcactggtccaccagataagtacagaaattatttttttaaattgtcatatacatagaaccagatgcaacatgcttaacatcttagtggtgagttgcttattattattttttttaatctttagcaaatgatgactaaagaagatggtaaacaccatgaagtaaatgtgcaattttcatggtatggaaccacaattaaaagagacaaaagtggtgcctacctcttcttacctgatggtaatgccaaggtaagtggtactgatgagatgacaaatggaataaacacttattgaaagagtattgaggaaaaagataagtgagtgtcattattttatcatctgttgatttattagggatagatgaacttttggttgcagtattatctatcaccttattgatacttagcaatttgtagtcgaaagttagataaatggttgggcgcagtggctcacacctgtaatcccagcattttgggaggccaaggagggtagattgcttgagctcaggagttcaagaccagcctgggcaacatggcaaaaccccttttctacaaaaaatacaaaaattaggcatggtggcctgcacctacagtcccagttactcaggaaggctgaggtgggaggatggcttgagcccggaaggcagttgcagtgagccaagatcacgccactgcactccagcctgggttgacggagcaagaccccgttagataaatagttttttagagttggaatttgttaagatgctacaatgaacaatgttcagttaggataaacaatgaacatgggaagaaactagattttacgtagagttagggagctttatatgtatgcattttatacagacacaaaacctctagccgtatgggaaaaatagattttccactggaccatttttctccttaactttcagccctttaaaaaacaaatctttctcactcttgactataaaggtagtaatacgcaaactctggcacattttgaaaatgccagaaactaaagaaaacattaaaatttaccaacaggtgcacaatcccatgaaaaccattgccaacatttggatgtatttcttattgtcttttattttatgcatatccttttctccccgttctcaagtcttgacttattgcatgtacatattttgtttttcatttgtgacagtgctcacaatctgatggtatgttttttaaaaatccaattttaatatatactgttgtgtttaagatgttgcttatattctttttctcccgattcttcactaccataacattgtaataagctttctttgtagcattcaaaaagaatgctacaatgcaattctgattaattgctgagaataactttctagaagagtcattttgtatcagtgtctgaagtcttttaaggacttttgctgtgtactgcttatcttccctctagaaagactaggtaaatgttcaatcccaccagcattttttgagattaactctaaaatcccactccaagcactgagaattggccatattacaagctttgcctataatagtaagttagtagaaaaatatttttctgttaagatttttgtggttactagtaaggttgaacgtttttgtaccttcatttatctttcatatttcttttgtgattttcctatttctattctttgactgtttttctgttggtgtgtcctgatgatctctgagcactctatatgtggtaaaattaatccttttccctatatgttgtaaaatttttcttattgtgtcatttagtttgttaattattttattgtatttctcatttatagtggttttaaatttttgtgtagtcatttcttttttttctgtagagtttcttcctttgcttttatacctttataggttttctatacctcaagatcagtgaaatgttatcctaattattgtcttgttagctagggacctatctcctgaaaaagttacttttgttccacaagttatgaaacctgctaactaaaatccaatactggattttaagggattgtgtaggctacagtaaggactctaggttttttgtttgtttttgtttttggttttttttttggctgtttggggtttttctttttttttttttttaagtcagtgaagaattaaagacaaactacaactcatatgaggcattccaggatgggcagtgagtcccaaatatgagctgtttcagtgttttctcattcaccagcttttgtcattggacattttattttgattgactgtatttatacttaaaaaagtagttgtgctatagaatttcatgcgtagataccaataactaatttatttaaaaccattttatctttaaatagctctaatgtcagatagaaagataaaacaattgtcatttttacagagagaaaataaaaaacatcagggaaagaggcagtctagtgcatcagaaaaaggcaagagcccagaactcatcatcccaggttctcatcccctccctcactttctagctatttggtaattaggtacaagaaatttgtaaaccattaagcattttaataactccagaaaattttccctagccaaagaggtaaatttggaagaaaattacacaattctgaaaaaaaaattttttttttttggagacggagtcttgcactttcacccaggctggaatgcagtggcgcgatctcagctcactgcaagctccgcctcctgggttcacgccattttcctgcctcagcctcccgagtagctgggactacaggcacccgccaccaagtctggctaattttttgtctttttagtagagacggggtttcaccatgttagccaggatggtctcgatctcctgaccttgtgatccgcccacctcggcctcccaaagtgctagggttacaaggcgtgagccacggcgcctggccgaaaatcttacactgtttaagtagttcatattgcaagcctaactttctatgctattgttgagctaaggtatctaatactttaaaaatataattactcataaatgttttaaatttgcttccatgtcacataagttatgtgctttattaccattttttaaaatttaaataaaaactaaactagtggtttccaagtagttttttcaagtttgtgaatttatattcagctagttctttcaagtaaaaggacagaatgttttatagtttagtaaaccgagctatgattaaactatgtttctgaatcctgctttcagtttgcttagatgactccctgtagtcatccttgccacctgtcccaaaccctgaacattagggggctgggaccatggttataataattatttacctgggaaaatgtaacttctgtagaatgattgctgtttctaataagtaactatatggacaaatagaaggattttagttagaaatttgtatagctgggaggaatgctttctagaccagtgaagttgtaaacatttttatttcctattttcagcatttttaaaaataaaaaacacgttcagtttttatcacatgcatattttgttaccttgtaagatctggtttacacttaaaattgcaaatatcaggtgatacgtattttctatttttgaaaccataataaacatattcttttaaaagtttggaagccaaaatatttttcttaaatatattattttcttttcagccttatgtttacacaacaccgccctttgtcagagtgacacatggaaggatttattcggaagtgacttgcttttttgaccatgttactcatagagtccgactataccacatacagggtaagaaaataggaatgcagttatgaaacatatgtattatggtttttgaattcttgcttttcttatgccattcttaaattaacagttggtttttgtagatgatgtttttctaaacttgacatttttaatatgatttaaaatatgaaacttaccctttgataataaaaaatggtaaaacgtttcaatccctacatatacatgttcctctgtatatcttctcttaattgttgccatattggtcttgagctcattaactggtaactttatttttaacacctgaaaacaatacagtgttttgattttatgaaatggaaattatattaaatacgactttcagttaatagaccacacacatatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatttaccatattatcaacactcttagaaaaagacctcataaaaatgccatttaaatttatctttgctgttagctaagttgaacaaattagaaaagaaaaaatactatttccctgaatcttcatacaggtaaaaaataaaggatttcacaaactaaagataaatgtataggtaggcacggtttcctttttaggtattgtgggaaagcaaagggatactatgttcagggaatctcttaaatcacagaagttcaattttctgatttcatagttaaatttaattttgcttttatttaacttttttattaacttcaaatttcattagtatttgctttttgttagaatttcaggtatggacaaactttctcatgcaacttctttaggtaataatatgataggtttttcagaataacccatgattcataggatgaatcaagaagtaaaagttctctggcaggtgggaaaaataatgctagacactaattttgtgtcctaaatgtgacttctgaagttatctgtgatcactttgctacctacaggaaaacctgtagttctgaaataatcttctattgagtttctcaaaacttctggtaagtcagaaactgtttttgatcatctgtttgtactcttgtgtaagccattatttaatacccctgagagctctaagttacatcttcaactttatagcattaccccacagaagatatgctgatctatttttaagtttgctttaaactattgttttttagtggaaaagtttttcctggagtacaacatggcacacactttggcacaaacttgtgtcatcaggtttgatttaccattgtttttcatcagttatatttagagatgggctatgtctcagaggaaatgctgtagcaactcttcctaaaattccaacttctcaatcaggtatatttgcataattgcttttgcttttatttaattatgtcactgtatcttctgggttttccttggattatccaggacctctagttctcacatcatagggcagtttgtgtagactagatggccctgttctgctgctagtggctgtagcttagtgcttgacttggaaattaataggctctgacttgcctatttacttatttgagcaaactacactcatcagaactaaatgcttgtcatttttcctttccccctctcttcctgtttccctctgggcagtgaactgtccagtggctaatagtgttaagcaggagcccgggccactgaggtttgactggctcctggccttccaaaggggctctcaatgtagcccatttctatttgctggtcttgcctctgcctcttttctcttttttattctttagttttctttctttctttccttccttttttttttttttttttttttttttgacagagtctcgctctatcgcccaggctggagtgcagtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctcgaactcttgacctcaggtaatccacccgccttgtcttcccaaagtgctggtattataggcatgagccactgcacctggcttgattttcttttttcatgtgtttcctttctagattatttgtcttctcttccttggtgttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggatcattttttttttcaacatgaaagcagttggtaggaaatagagataccagaatcacctgaaatgctttcttccaaactatataccttcccgtgtttgtatttgagctcctcttaacaaatctccctctgggaaaagataagcccggttgtggagagagtctttccttagtaatcttcatgactcacctgtctctcctgtttttcacataccattgcctgaacactcgggttgtctcaatcctggctgattgtggttttaatgaaatcactaatcaaggcccatgatagatatacgaagtcttcagggtatttggctctatcagcgttcacgctgcctgaaagggtgatcagtcttcagggatctgttatttagtgccaagtcttccttattaagaaatactggaaagttgtttaacattctaaactttggcctcctgtaaatcagacacctggatgattgatcaaaatgcatagacaaaatgtggcttttcattttagatgcaaaggaaacgtcagccaacttccatgctgttgtagattggcttttagctagtattgcataaaataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagcaacaaggaataaagaaacagaaaatgagttagtattaaagattgtctttgttgggtgtctatttttgttaaaccttacaaatccaatttaaaaactaaactaacgcatacctgacaaaatattcttacatttctcagtctctactttagttgttctttgacccttttctccccaaagtaactattgcccaaattaagcttcaggagaaaacaaaatcaagaacgacaagcaacatttccaaaattatataaactttttggtccttaatgattttgaaacagagttgagaggccgtatagttcaacctacttttgtttttggtttggtatttaacttttgtttctctatctgcattctctccagattctgaaaatgatcagaagtgcagttgaagggctctctctttcttaacatcttttaaactaataaaagaacactctgttttccttttcattatcgttcagacatcgcattcaaaaggtttctaaaaatactaaattagaagaaatcttgtgctcactagccttaaaagctctacaagatcagagcagttcagaatttctaatgaaggcgtggcacggtggctcacacctgtaattccagcactttgggaggccaaggcaggcggatcacaaggtcaggagatcaagaccatcctggctaacaaggtgaaagaaaccccgtctctactaaaaatacaaaaagttagctgggtttggtggcacgtgcctgtaatcccagctattcgggagactgaggcaggagaatcgcttcaacgcaggaggcggaggttgcaatgagccgaaatagcgccactgtactccaacctgggcaacagagcgagactctgtctcaaaaaaaaaaaaaagaaaaaaagaaaaaaaatttctaatgaaatatattgttttgcccatgtcaggtttaataaatccattttatagcacccataatttaatgaaatgcaatttatttcatttgtagaaaataacactcttctgggggaaaagttgagggaggtgggaattaatttttcttgcagtataatcatctttcatttaattgaagctttaaacattaccatataggctgctactttagcttttttggttaatctgtaattagaagatagaatataatacaaacagaagctcctgtatcctcttgtgttttatttaatactgcacctacaaggaaagtacataccttgcaataatataataccaataagtgacattgttaactgtggccttatttgtcttcagagctgtaattattggactttagtgtcctagtttctgatatcaacagctactttgaagaattaggtcactgtgggtaacgagtatgtcgtgtacatttcattggcgcaaggactgtgttctcctaggcaggtgtttgttagcgagttagtatgtatgtgtgtgtaaaccatgttttaacccttaggggaaacatcttaaatgcaatacttctgccctgttttccaccaacatattataaagtattatatgtaatggatcttactcaaagaaaacaagcagcctggaggtaaaatgtaatgaactgacatcaaaaagtatggaaggaaagactttcctttgactgaaatgactgattttcttgcatatttagcaatcgaacagagttgcttagtttttctctgagcaattttgaatatataaacataagtggatttataacctgactcttggcttttagagaatcaaaatgagcttcatctagttaaacatattaggggacttcaaaaagtttgtggacaaatggaattaaaagataaaaattaaaaatataaactatttctcaacataagcttcatcaagttcatgacgcttttgtaagcaatgaatccagctactcagtccatccctaaggaacagagggtcctggaaatttaaccatgtcatttcagtctacttatattattaagtaaaatgagtgcccattaaatatttttttaagattaggaaacaaaaagaagtcaggaggagccaaattagcactgtaagtgactgcctaatgattttccattcaaactgtcacaaaattgcccttgtttaatgagaggaatgagcaggagcattatggtggagaagaactctgatgaaactttcctgggtgtttttctgctaaggctttggctaatgttctcaaaacattctcataacaagcagatattactgttctttgggcctccagaaagtcaacacaccaaatgccttgagcatcccaaaaagctgttgccatgacttttactcttggccagtcttcttttgctttgattggaccatttccacctcttggtagccattgttttgattgtactttgtcttcagaatcatactggtaaagctgtattccatctcctgttacaattcttcaaagaaatgtttcaggatcttgatcccacttatttaaaatttccattgaaagccctgctcttgtctgcagctgatctggacgcaatggttttggcacccattgagtggaaagtttcctcaactttaatttttcagtcagaattgtataagctgctaattgttagttctcttcagttagagcaggagcaaacttaatttttttcttgaaaattggtgtagtcttcgtcttctacattgtcccatcccttcttaaaacaatttatctgttttgtaaagtgctgattttcttggaccattgtctccataaacttttcataaagcatcagtgatttcaccatacttccacctaagcttcaccataaatttgatgtttgttcttgtttaaattttagcataatttatattgctctgataggggctcttatcaaatccaagtctcacccttcttagtgctcaaactagatcctgttcagacatgttacaataagtaagtatgagtttattttgatgaaatccatgcatagttttttcatgatatgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcttctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgatcattccctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgtttgaccttgcacaggttactgccaacctggctttggttttatcatcctgaaatgttgacagtagtaaaatcagcttcagaggatgtttggagtattcaccgagtaaatatacaaggaaccttacccatagtgagtgttgtatctacttacaagagtgagtgagccagatgggttagatagtttactattataagacaaagcatggtcattaaggattgggggaattggggaggatttaatgaaggaagtgagtcactgagaggctaggtcttagagaatgtcacatgaaaggcagaaaggaggaaaagaatatcacaatgtgtgaaataaggttgtttagaaccccactataaggatttgaagaactctttgtcccttatatattttttaattgacttgaagtttttctttatacatttaaataattgcaaaggatgttattttggtgtattgtacatggtgacttttaaaaataagcatatccaatgggcagtggtactaaatcatgtgttttttaaaagcctgcactagctttttctttaactgtcggaaacttcacatcattattttctccttataattacattctatttctccacagaatgttatcttaatgtagtatttttgtggttcagagccttgttattggtcagtctttcattacttctctaaaacaaaaatcatgtgtgtgtgtgtgtgtgtgtgtgtgtatttatgtatacagttttaaaagtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggagttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtggacacagcacatgtttcagagagcaaggggttgggggtaaggccatagattaacagcatcccaaggcagaagaatttttcttagtacagcacaaaatggagtctcccatgtctacttctttctacacagacacagcaacaatctgatttctctttcctttccccacacgtcccccccttccactcgacaaaaccgccatcgtcatcatggcccgttctcaatgagctgctaggtacacctcccagacagggtggcggccgggcagaggggcccccccacttccctcccggatggggcggctggccgggccggggctgccccccacctccctcccggacggggcggctggctgggtgggggctgtcccccacctcctggagggggcggctgccgggcggaggggctcctcacttcccagacggggcggctgccgggcggaggggctcctcacttctcagatggggcggcagggcagagacgctcctcacctcccagacggggtggcggtcgggcacagacactcctcagttcccagatggggtcacggccgggcagaggcgctcctcacatcccagatggggcggcagggcagaggcgctccccacatctcagacgatgggtggcggggcagaggcgctccccatatctcagacgatgggtggccgggcagagacgctcctcacttcccagaggggatggcggctgggaagagacgctcctcacttcccagactgggcggccgggcagaggggctcctcacatcccagacgatgggcggccaggcagagacgctcctcgcttcccagacagggtggcggccgggcagaggctgcaatctcggcactttgggaggccaaggcaggcggctgggaggtggaggttgtagcgagccgagatcacgccactgcactccagcctgggcaacattgagcactgagtgagcgagactccatctgcaatcccggcacctcaggaggccgaggctagcagatcactcgtggttaggagctggagaccagcccggccaacacggcaaaaccccgtctccaccaaaaaaatccgaaaaccagtcaggcgtggaggcgtgcgcctgcaatcccaggcactcggcaggctgaagcaggagaatcaggcatggaggttgcagtgagccgagatggcagcactacagtccggcctctgctcggcatcagagggagacggtggagagagagggagagggagagggagactgtggggagggggagggggagggggagagggattgaaggagttttcttataggaatatcattcagtactttgaactcctgagttagatgccataagccacagactgatctatcgtcaaacattaattttaatcaattatttttaaagatctactgcctgacaacctgattaggtatgctttcaattttggtgaaagcaagcaattggaaaccatgtgttttgcagaaatatttgttgcttagtcattaaagtccagtcagacaccaatatgttgaactgtttttgttcagtacccactaaagaaggtgagagatatgctgctgcttgttttattttttttataagttgggagaagaaatagagtggtggaaaagaaacatctgtcatggaggcaggtcattatgaggaatcttttcctgcctaaaggtgccttagaaaggagcatgtttgggaaaacaggaagtaggtaagttcagagtaactgccagtgccacagatgtgcagatcaaatatcatgattagttcagccaacttctctcctctgtcctagaccagcccaagcctgggacacggggaaggcaccaaaaaactccggtgttgtgaggtattttattcacctcgtaggggagtgttttagttagaccttatttattttatctattttgaggttaaaactgatgtcggtattatgatccctccaaaacagagcttccaaaaaattctgttgtttcataacattagtactttaaaaaaaaaaccaaaaagcctttcagttttgttttatgtttttcatttattatgtcttcttcaagtatatcatagtttattggtataatctttacccaacatttgcaattcatatgatcaaaatgccatacctttcctattacagatttagtttttgacattttcatgagaattattgaaatgaaaggcataaagtaggtacactagtgcctaactcataagttattggtaagtaatagtagctgtttatctagtagtgttttatgaatggcacaaagcagtatatcatcattttcttaaatttgtgacttggaatgaaatttactaaaatttgtattcatgaaagcagatgttaacattttcacttgtggagaaataatcaatatgaacatttacagacccagaaatcggcagtgactcagacgataaattagatcttataatgaatggtaaattgagtgagtcaacatggaaaaaaagatcatccagtagtgggaattattaccatttttattttggtactttcagatataagtacagttttttttttaaatatggtcacgataatattttctttttagaaacatttagatgttgacttactcagtttgtcattgttgtgagaatttcatataagcatacttatcgaattaagcagtatatgttaattaataaccataagcttgagctttaagctaagttggataaagtttacaaaaacatcactaaagtaagtgcataatagcaaaggtatttttatatttttgatgattaaaatacaaaacaaaatgtttcccatattgaagagggaatattcaaaatcagaagccctagttttttctgatagctattattatcctacttctgcaacaaaatgatgattctgtcatcctctctgctcagacacagattggaggaaaggagatgagagcaacaattagatagataacaaggttccctttgcctgagagccagtatttttaagacactcagacatttctttgaatcttagatgggtgttttggagatttattttatgtgatttgatagctatgttaaatttcagttaaacttttatttgcagacttaaatatgccgcttaggattctcgccatcacttgtctttttcctaggtgaccgtgggccatttgctattgtccctcttgatctaatgagttgtcctaatcacattaggtgccactgataagatactggactttgctgggatatgagtgaggttcttttttgtcgtttttcccaagttgttgcctctcactcctataactggttgagtgtggtgagagtggtgtatggtttatgagtatattccttggaaaagtatactttgcatttcaaaatagctagaataaaatgatctggagaggtggagagggttgagctaactctgagattctgcaattcagggttgaattaggcggcttcagataaattgttgaaggatctgagagagttggtggtacagaggaagtaaaagcctgggattttccaaaggccgtcattagttgttgctcagagctatgactccagggtttccatttgcattttttggagtccttacaccctcatggatgtttcttttacctcatatttcaggcatggcgtgtgtcgggcttgccctccagtttttcttttaataataacaataataataattattgttattattatttttgcgatggagtcccactctgttgccccaggctggagtgcagtggcgcgatcttggcttgctgcaacctctgcctcctaggttcaagtgattctcctgccttagcctctgaagtagctgggattacaggtgcccaccaccacacctggctaatttttgtggggtttttttttagtaaagacagtgtttcgctatgttgggcaggctggtctcaaatcctgacttcacatgatccacccacctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacgtgcaccacacggtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcagctaggtacagtggggaggaactgctgtgcaatagagtatctgtctttaatattaaatatgtattactttcttggcttctaaggtgagtgtgccattttaaaagagagttttgggttgttttaaagagtttttggggtctggaagcctcttgtgctttatttcactcaaatagctcttgcaggatatcagatttcagttcagtgccctctgcccttaaaaacaaaaacaaaatctggaggtcttctctctactcgcttactacaaggcctctcccagcccttggtcccagagtaacttgagccttctccaatagttggtctgccagtgagacatgatgatgtagtagtttagtcctggttctgccagtcttgtccttgggcgagtgatttcttcctcagcttagggtcaggaagaaaggagtcattatatgtaaagcttgtagtaaacatatggtacatagtaagcatcaataactcttggctcctgtcattgcgacatagctgccacccttcactcagcatacgtttaccacccttcactcagtatacgtttattgtacatgtctacgtgctgggaacatgaagataaataagacatggtctctagccttagggaacttatattctaacatgcatgtaacatatatgtaaaatgaaagttcttattctctcatctttccagctacttaaactttatccatagcccagtttactttcctcccatgtcagctaacttctgcatgataaaggacaggctttcatatcttagctatttctgtctaacagtgattcagtacttaccatgtaccccaaatgttgttaagaactggaatgcaaagatggtgtgtaagacagtctgtatctgtgagaagctaacattctgtagggagattaaaaaaaaaaaaaatcctagctccgggtgtgagactggaatctacagcatctatagaacactctgatgtagtgggaccttctgaaggactctttttggcctttttattaccacttttcacctgtgaactggctctgttctaccttgcgttgcctatgcaaataaggataaacaaactccattctctcttccaagggggagagaattagcagcaagagggcacatatttctctttgttaaaacctgggaatggcatcactcctttctttccctagtgactaatcttgtaaagtgttaaagagaagtctaagtcccccagagggacttagaaagccctggccattcatgcccaggtggagccactttagtaaaaaaaatagcatttttgctgccatgtgatgcacaggtaaaacagaccactggatactgctggtttgcattcctgcttcctgggaagttctcccttccatttcatgagcctctttgggaaaggtacaaacttagggaattactgacacagaataggaacaattggcaatcctttcactctttcacatatactgatctttaaaaaaataataaattatcattgagaactcagggatacctccttgcttttatgaccattacaggttttgtttggcttgttcataataagcatattaagtttaatcttattttaaaagtctgtcctgatacaaactttaaattgatatcttgctgaattgtgaatggacataaaggctccttttaaagagctttaagtgtttgttgccacaacagggtctgagtataatactgaggttgagaaagatgattttctcaacagaaatactttattattgctagaggtagtgtgaaattatcattttttccttgaagcatgttcttttataaatgctttctggagatacatgaattaaaattaatgatgttctcttttgttaaggctttatttcatttcatgtattctgttgatctttgagacaatatctaatctagagagaagaaaacataaaatagtactaaaaacccaatgaattcttttagtgaattagagtttacttcttgtcatcagctaagctccctagtattacgtgaatactatcatgcttggtgctacattttgtgttttggatgtttttggttcatttgtagatgcttatcttttgttattaaaattccatatacatttcattttggctttacaaaactattttggttaatgtaagcatactgaaaagagggtttgcatttagagtgatgcatttcgtaggtcagagaagatactgttatttatcatcagctatatgtgtgatttctttttcaacttcccaatagtggtggagatatttgggtcatctatctttgcaggtccttgtaataattgtcatcaggaaatgtacatgtgtaggtaactggcaggggttagtggttcagactatggccattaaaaaaaaaaaaaggcattagctgggtgcagtggcacatgcctgtagtcccagctactcaggaggctgaagtgggaagattgcttgagcccaggagttcgaggccagcctgaacaacatagtgaggccctgtctctctcttttttttttttttttttttaaataacattccgcatttcctcacccatggagatggtactcataatagttttatgaatgtaggaagaaactgaagttagctccattcaagttggaagagcagtatataccggaaagaaattcagtgagcattctgaaaattctgatcctagaggcttcagcccatttaagtgttaatttatcactagattgttatttttattttagaatttccattgtacttttcagataaatctatggtgcctacactaacagcatttacattctttttttttttttttaacagaaatgtcttagcctctggaaggccattttattcactaacacatgctaggaggcttcagcaatatcctgctccattctagaaaacagcaatttgatccttttttcctcctcagtcattaacaagattatgcatttgcggtgagatgatccttcttgaacaagtagccagaaatcatttgttccagtttcttctcaaggtgctgaattaagtctcgtctcataaatcttgtggcttccttgatgatggattcaaaaaatcatttcttgacttctataggtccttgcagtccttcaagcaatttgaagagtttttcatattttcgtctaaagtgttgaatttccttcactaattgacattttatatcagcattaatttcttcttgacattttggaaaagggagtatttctgtgacttttaggtcatctccagagaaattgctggtaatgattcctcctacaggtgcatttctaccaggtttctgcatcagcccatctttgctgcaaccactgaagtcatcaaaccgagaatccaattggcttggtggaataccatctcctgccataagcttcttttccttggacatggcagagcctccaataaggctgtctcctgctctttgtttccttaacaacagggccatcttctgccttttctgagatgaaggagtctcagattccctgggacgtttaaacacattttcaggttctacagcaaccttctctgctttatcagtcattgtttccagaaggaccgatccagtatggcccaagggggatggaagggaaactgcctgctatggcgtgccctgccccagccaaatactgggaacactgggaacctgtgtggtgcgccggagtcctgaggagaagccttgtgttcagtaggatcacgggtgccagccccgacaatcatggggcctgcatttacactctttcccacaaacctcacagagttaaacttcctttctttaactctttgctgtcaccttctgctaagctctggggattctacttgtgtcctaggaaaaagtcttccttactcctttcctaccttatgcatttttccttttttcctttctgaacctcagaaagcgtcagctttattgaatagaatgatgtcactctttcttcttatgaccactttcctaattgctctctttagaaggtcctgtaatatctctctcgcaccgtttttaaaaaaaatttccataggttattggggtacaggtggtatttggttacattagtaagttctttagaggtgatttgtgaaattttggtgcacccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaaccatctcattagatctcctgtctcttttcctagcaataatacactgtcacttgaaccagcagaatgtaaactttactggctcataatttctggtctataaggagagaatggtgaaaaagtgggctagaatggctctttggggaatggtggtgcagatgagaagtggactggcctgtagctgggcagcccttttttcatttcatgtcctgtttctcctctagaactcagagaatcatttacatgttatacatcatctacatttttctcatcccagctgcttcattctttagatgaataatatgctcccctgaataagtgctatctaccttctgatagtttttaaaaagaaaagttaaattgtcatagcatttattatatgagagatgttaagacaagaagtagaaaacaagaaaatgtaactttggaaagagttctgtatagtatatttcaaaaaggtgaggcaagtaatttctttctattaatccatatatatttttttaaatttaggaatagaaggacagtctgtggaagtttccaatattgtggacatccgaaaagtatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcgggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgtatttttagcagagacacggtttcaccatgttggccaggctggtctcgaactcttggactcaagtgatctgcccacctcgccctttcaaagtgctgggattgtgggcatgagccactgtgcccggtctgtttttgtattagcccactctcacactgctatagcgaaatacccaagactgggtaatttataaaggaaagaggtttaattgactcacagttctgtatgactggaggggtagcctcaggaaacttacaatcgtagaggaaggggaagcagacaagtcttacatggctgcaggcaagagagagaaaagcccaggggaactgccatttataaaaccatcagatcttgtgagatctccctcactgtcaaaagaacaccatggggggaaccacccccatgatctagtctctgcccaccaggtctctctctcaacacctggggattacaattcaagatgagatttgggtggggatacaaagtctatattagttgtcctcataaggaattgatccatacctattaagtttgttccctatatattggtttaatgtatgatctaataatgggcccttgtaaatttcaggaaaactcttcctctatatgtgtgtgtgtgtataccattatacatacacagacacacatgtatacatatacataggtatatctattcagaaatgggcaggtatatatttaatcaaaattttcatgaaatgtttcaaattgtagtaaggaaattgatttatacaatcttatcaggttgtcaattctccaatttaatagagcacttttgattgttacctaaatctctgttttctgagtgtatgtgtttgataacatatctttgaaataccattaaaaccatgagcatgtttttaaaacaagtgttttagaaatttctggctgtgaatagaaataattttacaataaacactttgattttcaactgggggtgggtgaaaaagattttaataattttctcttctatgatttcctgcaaaagttaaatttaaactttttccaaaacataaaaattgcagcatacattctgaattagcatgttaattcgactacagccatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtagtacttgggcaaaactaggtatctagctccaccagtggggaatcggggtagcaacaacacgattgtggtagttttacattttttaaaataagtttacatttacaagttaattgggtttggaaaggagaaatagagaattcttttaaggtagctttacttttttttttttctttaaacattttacagttgtagctttatcagtttattaatttcccaaggctgccatacaaatggaatcacgtaaaacaacaaaactttattctttcacagttctggagactagatttctaacatcagggtgttggcagggccatattccctccaaaagctatagggaaataaccttccttgccctttcccagcttctagtggttgcctatgcttggcattccttggtttgtgtatgcatcactcccatctctacctcttttgtcatacagcgttctccctatgcctcttgtatctgtctgtctgtgtccaaatttctctcttcttgtaaagatgccagtcattaggttaggtcccaacataatccagaatgacctcatctatttctgcagaggctgtatttcaaaataagatcacattcatgggttgtgggtggacaggaatttgagagagggaggcattattcaacctagtacaaccagtaatttgagggagacattgcagggttgctgggaagattaaagatcacatttgtgaaatactccggaccatgcctttcgttaatgggcacttaatacatgttaactattacggtaactttgtacctcttcttttcttcacttttatatccaactttcatgagtttaaatgaggagatgacatttttatgtggtatcattaagattcactgataatagggttctgagcttagagtcagtcactgtgacccagatgggctttggggttaccgacagtctttctcaaaaagtagagtcatatttcaaacattcaggtactaggctgcaaggaattggaatttggaactatctacattgaaactaatcaaaaagagtaagcactgaatggtttttaaatataaatatgcatttgattttaacataatatcttagaagatttggtgcagagacctgtggtatttattaaaaccaattcaagaataataagagatatttcttgaaaggggatagagaggtattatacttagcattcattacaaaagcagtttgttagatttagatgagaaatgaatacttaatacctttataatttgttttatgcaaatattggagagctagaagacttttaagcatttttattctgaatttaaataggaatgcctattttaaaaatctggacaagttctacctttcccacctaaaagttgttttctaatatccttgtggtttttcttcatattgttttaaataatgttttaatttttaaattatttcttccactgaataaaaaggaagctttgtctttttctcttgggaagaaaaatcacctgtcctcaagtttttaaaagaacatatgtaaatatcactttttgtagatggaattgttgtgttttatagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtatgtattgcttacactcttttccactctgaaaggtttcaattccaactgtatactttttctgttggtcagatgtggtataatctctagttaaaacctccctgtcttcttttcagcttttttctttcaacaaccagactattagttaagtttgggttttgtgagaacaacataaaaagatgaatctcctaaatcttcagatgaagaacaggagacctaaaattccatgtcaagatttctttttaaagataatttgcttctcctaatagtatgtattttgcagaggtctccatcatcattatgatttaacggatgtggaaactcagattcagaggtttagataagttgcctacgtttgcaaagttgggaagttgtggttcaaacttaggtccttttctgaatcatggtctttctattctgctaccacctgaaagaaggaagggagtagaaatgatagagatatggggataaagaggtgtggctttgaggattccaaaagagagaaagtgatgcgcagaaagtgagagaaaatagtcaatagacactgattaatttttgcaagtctttctattgagaggctttgatcctttataatacatatttttaattggttatcatacatggtatcattggtcttcttacattctaagagttggtagagatacatatctgaaggagccagataataactgagtgcagattcctggtgtgtcctttgacacaagcccactttttacatgaggcgtatacatgcattctgtatcttacacacacacacaaaaactgctacttctcatttttctttgtggccttcattagataagatcatataaactcatgccataaagacatgaattcgattttgaaagtagtaatggttccacatcagggatccagtagggagggttagagacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatacaattttttaaaaaacactatgttgagaaaacataaaacatctttgtgccgtacatgactcttgagccactcatttttaaacactgccttaaattctcaaagctgtgccctaaatagaggactagacagtaagactcaagccgtggttaacaaagcagcattatctcacttcctggaaatgtgatgtacatttcctaataaacctcataagcatttttgattccaaatggtgctactaaaagtttcggagaacttaatttactctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagtgggttgtataaatccacctccttgactagagaggaaatttagagcaatacatcatgactgctacttaagtgatgctcaatgaatgtcagtattaaattattctggtcagttttgcttgtttgtttgtttgtgtgttaggtcagattgaagttatcatggatcgaagactcatgcaagatgataatcgtggccttgagcaaggtatccaggataacaagattacagctaatctatttcgaatactactagaaaaaagaagtgctgttaatacggtatgaaaaaataactagcatgatctgatattgattgttctttgtcacccaaaacttgaaattatgactttccacttttaaaattttaaaaatcatttccaatattgagatttctttatagtagatgtggcccacattcacagaaagagaacttcagttataaatatcgtgtaagatttgcacttaggtctttttattttttatgtttgcttattatgtagataaaaaataatgacaggaaatcactttgggtaaatattcctgaaattattttgaaagacataagaattgaaaaattgagctaaataaaagttaaagaatagaacttagtcatatacttaggagattaaatttggtaaactttatttgaaatcttagtaaaatttatttgaaatcttagtgtacttattctagtcttagactcttcagttgaaaatgtatttatatgtaggttttctatgaggtttactcctcaaagcaaaaatctagtactctgtgttgaatggtctggcaaaagcccagctggacctgaatgacctgacgatatgcttgttcaggcaaagttatcttcagagttctccgtaagttattgatccacccaccttggatagccctgagcatgggctttttctttttgctctattctcctttctgcacctgaccattgcaagtcctttctgctcttttcagccagtgatcgtacctttcactttatagagagaacagccattagacagggctctctgttccagttatctaacatctactcccacccttcccatctctcctcctgttacatttaaaagacactttacagtccatcatcctaggcaggtcccaccacttgtccttggaacttactctcttcacccacctcagcatccttttactgttcattctctccctctctctttctcccttgctcctcatatccaacacttcctgggagattctttctgttagcttttgaacactctgttttcttctattaaaagtagaaatggaatacagccttccttcagactcttatttccatttcctgtaagctgctatcctcttctctcctacccaattgagtcagagtttatgagatgagtttatttcatcacttccttctcacaatccatttgtttcagtctggctttagcctccatcatattctgaaagagctctttccgatgtcagtagatccagtgcatattgactttcgtcatcttacttcacctttcagcagtatttggcactggccattgtcactctctaaaatactgccttgccagggcttctatggagctatgcagtttggttttcctcctacctgtctggcagttctttatctctctaatagttctctactcagccattaaatcttagagctctcaaagcatgtcccctggccttctccttttcttattttttatgctatcccttggcaatctcttctactcctctggttttgtttgcatcttccacacaggtagaagccactaatacatatctccaacttaggcttgtgtctgacctcctgatttatctatctaattgcttcctgatattctctgtttagaaggacacctcaagtttgacatatccaaaacactcataatctctcttctctcccaaacctggcccattttcagtgttccccccagtcaacagccaccgccatccatacaactccaagacagacatgagttctgcctgatagacacttctccccatcagccttttctcacagagtaattgccatcacctatctatctcattgcctgaatatttcaaatttataatcttctttacttccaccaccctaatctaaagtgacttcctgtatttcctgggtctagcctatacacatccaccctgttctctttctgccgtatgtctgttcttaacccagaaggcagaatggtttttttttttgttttttttcaaagccacatctaactttattgcttcctgttgaaccctctgatatcttctcattgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgcttacttcatcagctgcttctggaccaggttaaaagcccttcccctatgctgcctccaaactgtgcatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatttctgcctattaccttgtcttcatatgcatgttgcattcctcctactagattccagggacttgttgccttcattttcatttgtccttatatttggtagacattctttaaacaaaatactagttgattgaatgaaatagcaacagctaattaaagcaaaaattcttccagtatttagaatattttagaaaaaagaattagtatccactttagatgtcaagagccataccattcttgagactcatattttaaatcaatcactgacaagatagcttagttttaaggactaaatctgcataggaaaatcattgtctgagtgctgacagctactgtcttttgctcctcctgaaaaagtttctcgcttatatgactttatattgacactaatctataaaacttctgttaactgcaataataaaaattttcacatcaaatctataaagctttgacttagaagtgaaataatttgtttattcccattcagaactccttggatagtaattgatttaaatttaatttaatgtttttatgttgattaaatttttcttttactcaagtatagattctgggtcttcaattaatggtttcttttaaataagaaatgaactagagaagagaaaatacattttaatgtctagtgaaaataattaaaaagacacttaattgatgaaagttaataccatgtaacttgaattttctagaaagagttcttaatttcaactcagactcaaatatctaaaataatgatggagggaagtgaagtagggggatactccctgaataggaagagattttaatgggaagccctgagcatgacagagcctcatggaaataatcccgagctgactaagtggaagtaagtcctgtcctcagagaattctgcagagagtcagtaaaaacaaggacttggatgatatccactgtgtaatatgtgcaggtgtccagtgaggactgtggctgcacgaggttgaccatcatttatgctaatcatcctcaaagccaatagaaatggaaaataggattcatctctttggcattgccagggtttgaatgtgtcccccaaaagttcatgtgttgaaaacttggctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagcagaaaatggactaaaaacaggcattgacggctttaggatttgtttctttgacggtttatccttacccctttcctgctactggttggttaatgaggcactgagctaggaaccctgtaagtgttcaagtgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgaggttgcttttttattatgaattttttattaaagagttggcttaaaaacaaaaaaaaaaaaacattttaataccatacagacctaccaaaatgtgtgatctacaaatctgccccacagtcttcagctacagatacttacctccaaatgttatgattcaatgtattattcttcattttctctcctccttcctctttgtcttttttactccacccttcctctctagtgttcttctttcatttatttatattgcatttgcttattaaattaatagatttacttcaacagacatttattaagttcccaccatgtttcaagtcaaactgaataaacaagggtaacttaaaaaatggtctcttactatctcaccatgatttaacaggatcgtttaactcaaagtgagcttaataaagggcaccaagaagtctggcaagaagttctgactcatggactaagggctggaacccagtgaggaagagctgtactttgtgtggtttggatcagaaggtgctagaaactttctttaatgtcagacaggctgcagagagaaagctacacttatacagtctgaaaccttccaaccaacaagaaattaaataaggtttatagtactagattagttaagtacaaggctggggtattcatttataacttaaacacataaaatttcctgtagaaaacatgtttttaaaactttgggtttatcatatgatttacagtggaaaggttacctttgtagagattaatttaaatattgatggttcaacagttaatatcttgttgagcctcttgttgctgtaaatatgataagaaagtacatgaatggcagaactctgggtgagactttgccactccaacctggccagcctccagcagtgttattttttcatggtgctcttagggtagtgaaccacaactcttctataaacttccttatctttctaaggacagtaaactacacagtttttaaattcttgaagtccttaatatccatgacattgtttccttttagaagactcccatcaaaatgtctttgaaactgaatcttgtttttctaatgcaaaggtagttaaaaggtaaagtttatcttttgattctaaagggagctctgttttctctataagattggatgtctggggtggcacttcccggcacagggtcatggagcagtgtgcggctaactccatgaaattcacctggggaggcttttcagctttgcattttcaggaccccacctctcaagattgtgtagatttgggataggacccaagaatctatgttgattagaggtgccccaactcattctgttgtgtggttaatttggggaaacaccaacggttaggaagaactaatttggtttggaggattggtatatatgcacgttattgcttctggagtatagaagattaatcaggaagtgttctggctactcactggagtggtgaggaattactccaagagtgtggaacaaagccagagctttctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctaccaacattagtagattatttaatgtttgaacatacagaagtgttgcttttaaccatataccatagcaaaaactaaagcattttaaattatatggaataatcatatactatgtaagtgtgtgataactattcagtaacatatttaacacttctacttttggaataaaaatagtgaaacaattggcaatgatttaccaagttgaaagaaaacaatcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtatgtctcaaaatatatcttataaaaaattactgtttattatgtacttgttttaagggggtaaggaaaggagaaaaaaataatgtatgctttactatgctttgaggaattattaacagggcttcacctttagccaaaagcttcatgcctttcatttgactattgctgtatattttagagtatatcctgatactaatttactcttaagttctgtatggcgagcaggtcaggaaataccattagtaggtgggcaatctgggccttaagtttagcactagtgacttttcccattcatttctccttgttagacaatatctctcagaagctagagaaatagtacttagttatttctatatcagaggctttgtattttcgtacctttctcttgagaatcactgcaactcagtttcccattagaaaaccaactgtttagaagaaatattagaggaaaagcatggggaagttttattaggtatgaaatttaatttagttagactgcagttatatacatacctgtttttaacatcaaaaagattgcatttggaaagaataagaattagacatttgacattgttcttatgtgttgcaaagctgttttgatattgcaaattgacatagatttagctggaaatagtaagtggttatggattctgtggaaaatatctcatggtaaatggcctaagtatgaaaagaagaggatgctcatgtttaaagacaatataagaggtgagaaatgtttaatgtagaacaaagaactaaagcaataaagtaaggataaatgcctataatttggatattagagatttacaactttatgtctaagatataggagaaaaaatataatttttttttctttatagatttttagttgagacaattttgaaagcaaaggtcagataaacaggggaaaaatagcaatagtatattgtacatgctatacctgtcacttgggagaggcctaagttcaaaagtatttttttcccaaggcagtggttttggcaccttgcctaaataatgttttaacaaagagccataaatcctctagagacaagacaaagaagaaagcaccttcaggcttccaaaaggtaggaaaatgtgggaggataaatttatgggaagagtgaagtctgctcctagatgctctggcactgctgtctcttagctaattagcaagccttgtaaaggggcctgtctttagactagaaaaggcagagaggaagggatgaagacctcttgtatttgtaaattgctgtcctgccatcaagcaggcagaagaagggacagaatggccccctggtttttttccttcttcagctcaataatcctcagttttttgagagagaagtattttggtttccttcagagataaggaacttatgcttggctatgcaggcaaacatatatgacttataataatgactacaagcaaatgctcgaggcgtgtgtgcgtgtgtgtgtattgaaaggctttttaaaatcattatcagtgaacttgcaggatttatttcctacccactacatgtcagttactgccataaaacacacaaatgcccctgcccttctagagcttagattctaatgggaggagaaaaacaagaaaaagtaagagaaatatgtaatatgttagatggtgttaagtgttatgaaggagtaaaaagggaacagccattcaaaggaggtaacacaattttgattaaggtgtgtagagagggcctcacagaggtgataatggagtaaaaatctgaagaaggtcagagaataagagactcctgcagatttctgggggtagagtgctccaggaaaagagcaagtgtgaaggccctgaggccggagagatatgtggccagaacagaagctccatgagagctatgcttgtcctttattcatggctatatccccgtgaagaagagtgtctgcacataggatctcaaaaactattttgaatcagtgaattgtgtagatgttttttctaggattctgctgtggttttttgtaggtctacattttggctccccgaggtgtcgtgtcataaattcatgagctaaaagaaacagaaagaatagagtggagggcatcaaatactctgggcttgaggttaccaccacccagcatagatggtagaggacatcagcgacctgaagaacccagaggcttctggggaggatgggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcctggcctctacttactgcagccacctggcttcccgttgctcttcgtgcctttggacaggtgggccaccctccctacctgtgggctgagtgactgctgactcagctaccatttataacatgaggctaatgtcacgtattgctgtgtcaggtcttttgctaaaaacagacgaaatcctattgtgaaagccttttgagaacaaaggcactctgtaaacataccttgttatcctaatgacacttactccaacttggttgcagattagggttttagcagagggaatagagagcaacttaacaacataaagatttgaccaagaagattaaaaactgaaatgttaataatgcctattgataactaccatgctggctcataatcagaactaaatacttggcagttttgcattatcatatcagttggtgccagttcctgtgttagcctttgactcttagcacatatttataacagttgtttaaaagcccactagtaatccaaaggaaggactggtccattcaaaaccacttctttaaagaattccctaacctgataatagaaggataatcattgaagggaactgttgtgggtattgattcaaagaaagctgtacttacaaaatgtccagtgtaattccatgcttatactaaaaaaaaagaccaaaatgactcaatgaataagtacagaagccagacctaagcattttggtttgggttcctgtttctgtgtgctggaagcttccaatgtgcaataatgggctgttcatttggagaatgcaactcatttttccccttgaaataatgtcaaaatagacataggttccaagcaagacctgaagtctgcattggcctgtatttaagtaagcatattcctaaccaccacagtatttcatgagaaatgtgtctgaaggccaccttagcatgataaggacgcatgtcttcctgcctgaccaactccttcagcaccatgatagagagtgcccttgcttggccctctgggccgctgtctaaaggtttctcaattctaaacctcagttggttttcttgactcctgggataaggggttatagattcgaagaacagtgagggaggcgagttgcaggctgcaggtatgacaacccactgaggtggttcagcagttccagctactagtcctcaaattcactgtgcccggatcacacaggggagattttaaacatagagacttttacagatttccagatctctgagattctgattctatagggctggggaggagagcctaggaatttgtaatttttaaaaatgtttctcatgaaattgctgagttatctccatttcctaaattaggaaagtgagagttagagctaagttaaatgataaaaataaaatcacccagtggtaaatggcagaatcaggcgttctgaatctcagtgctgtgtgtggcctcagagggtagcatttgacttttttagaattactaaatttgtttctaaaagtccaagctttcagggattgctctatattagtagatgagtttacattttatatagacatatcttgcttttagacagacatatcttgcttttctgctttatatcaatttttggaaaatgattatatgccgtatatttgtattcagatgaaaaggggaacaaacatctctggaagccctgcctcacagcatgctgcgtggccttgcccattccagccactatctacaaacttacccattagctttcctattctgttggcctgtctttcaactcttttccttgatcacacctttcccctacactatgaagatcttgagatactaaaaagaagcttctgtaaaggtttgaaacctagggaacatgaacaccactgaaatacactacatgcaaaagccttgtcatcaggaaaggaccattatttaagaagaagggagattgggtagagaagatgcagggaggatctcatgggaggacagatgatgagtcaggcttctgaagctggagctgctggttcagcctggaatagagggacaaagaggaagctggataagctcagcttcatggagccattctacttggaatactttagaaatgtgatatgtagttcagcttttttttttttttttagattatttccacagcttttatatttagacatatttattttatataaacatgatatatatatatatcttaactctttctctatgtaatttattttgatttgtgtttaactgtttcttgcaaatagttaaccatcatttcaatatcagcaccacttactgaataagattttctctctccacttgttcattctgcctcttcttttcttataaaaggcagtttgaggattttactttatttgtctttcttataagaattgattggtgctttattgatctccctagcttctggaaaggtgaaaattgtgagaaaaaaaaattcctttgttgtacgtatctcagaacagccatttaccttccctttctttctgtcattttatcttgttgatcaaaacaggatagctattattggacattttaatgagcaccctaaaaaatgaatttctactggttataataccatcttaggacttataatgaagcatgtaattttctaacctttccagctgccagaatgcactagggatgagtgttaggtattttcaaagaatctgagtgggttggagaaattttcccaccagatgtgtagccgtgccttaatctatgtgcaccttactaaccgtgtgaagagggtggggtcccatgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcttggtttctgaattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagcaagtcacttaactctctgagtgtcaggctactccttagtaacatggagatggtaataatactcaccttagagatgttctgaggattggagataattttagtgttagtaaagcacttagaacagcatgtggcacatagtaagccctatgagtgcttgacaagtaaaggttctcacctgtgatagttcagtcatgaacaacggcagttgtcactaataatgaggtaaaaacattgccagagtaaatcttgatgtcactttgacttattcctgatattttaggttggtacaaaagtaattgcagtttttgctattaaaagtaatggcaaagctacaattacttttgcaccaacttaatactttgttaataattcctcagatatttaaaaataacatatctaaaattgtctgtttgccaggcattgtgccaagtgctttacatgaactttatttaaagctctcacaacaaccctaagaaggtaggcaatattttcatcccatcttacagaataggaaagtaactgacctagagatatgatagataactgtcaagggcacacagccagtaatgtggtcctgggagcacgctcaggtgtgtctgagtccagatggcttctcagaaccttatactgtcttgcatgggaacaagaagggagagggagcactgaaaatgtgagggaatacactgtctatttttcttgtgtcttcagtaataataggacacctacagaggatatcccatccattggcgggagaagactaagggctaatccaggatcactggtggtcattgctatttgagtataagagagaatgctttgtgatagagattttctcgtatatttacatattttaatacaaacttatatatcacctcaactatttcaaaggttgttgtgcgataaaatgagttaattgatgaaaagcattctgtacaggatatggcacacagcaagtgctcaacaggtattagcaatgactgatattgtcactgcggttgaccctcagtcttcagagggactcttcacaggtccagcttagcttgctgaatttatagaggtttactcaaagtcacataaatggttcatggtagaaaaaatcattggtctgatccagctttctctaagcccagctttatctgatggcttcattctgcaaaccaaatcatctttccccatactccaccaagttgctggaagagcctcagaggcccagcttagtctatgagctgaatgttggttttatcccctgaattaagtttgcaatgggttttctctgtgcaactttagaatacgccagccttacttcagtaattcagcctcgaaagtgatctaatctgttttacaaagatagttacctaccacagtgcttggcacaatttcaaaaattgtaaattttcttccccacatcctcccattttatggggtccagatattactaatgcattaatgaatgtaaaagcagttcttccaaaatctgtttactctcctagagcatacagtgtgactgcttgaaggtatctgttttcctgcatgcatattcaagttaaattcacagtttccctactttgaaaaacagttttcttggaaataaaatgtctagacagactttgaaactgaaaaactgctgctttgcctcaggtatttttgcttgaaaactgatactttcatgaatatttgattttttaaaaacttggacaagatgattgctatttcagttcgtttttacaaaagtgatgtaattttagttttgagagaaagtataactttttctatcagtgaaagttaatttttatgacttttatctctatttttgtattgtcggtttaaatctcttgtagaattcaaatgtagaattccaaaggtgtttccctccccacattttttgtccccttctgttgctataaaggccttacatattcattattccaagagcaaatgtgttgcaggaattttagccatgcatgctatcaagtgatatgtaaggatggacccatgagttaaaatggacaaatgctttaggttagtagtgatatgtgcttttaaaagagcttaatgaagagggtttctaatctgttaatctgaatccagactttgttatgactttgatgtacgactctagacatataatttaggagttccctgagtctttagctacaaagttgtaatgtcaaataaaggaaatttatgctaagggcttcctgtgtgccagacatttggccagatctttgttaagctatttcatttcatttcatcttcattttatggaaaaggaaaacctggttttgctgaaacccacagctagtaaattgcagagcaaggatccagatctccagctgtctgactccccactcaggctctgaaccactcttactacacagctcgtgcactagcgcattctgccctacaaggcagtgtgaagctacttacatagtattttcaacaggttaatccacacagtgactccatgaaggaaataatacaagcattacctccattttacaggcaagaaaatagatatttaggaagaagaaattactatcctaaggtttcacagttggcacatgatagagtcctgtttcttattcttttggagatctaatgataccataaatgaagggttttcctatgtgttatttttatagtacatgggcagggtgttttaaatgtattgaaatgaattagaaatttttatcatatgatttaaaattgctgtgtgtatcatgtggtcttgtgatgactcagaattccttaaatgactcttctcttccttcaaacaaaatcttagcagtacccctacaaaatatcagtgtgaaacatcataacataggttattccagccaagactctgaggtgaggacagctttaaactgttcaggcacattaaaatcaaatcagtggtggagattctggcagctattcaggaaagatgtctctttagtacattaaaaaatcttatcccctagtgaggatgatcaggcgtttgggcatattcctgtctgtggccagagaacagaggaaagaatcagttttatcacaatgtcagtgctgagcagcacatgactcttttcaaaaactgtatgtttcttaatttttccagggatttttaattcatttatcataaacaccttccaactttaggaaacaaaatttattaagataattgtattttaaaatattcagaggcctaaaccattcatgacattgatacttaaatggatatgagaaattttattgcaagaaaaggtatactgaccctcttagctgacttgtcatgtttagtatttttatttttgcctgcctatcaacaatagcttctgcagtatcaatttaaatgatacatcaagctggtaaatgtgagctggcctaccaagtgaaagcataactaaatttaaatagctctgatataaaaataatgaatcagtacatcaaagattaagaatgcagttagcaaaaattaatgttcaataaagaagcatgtgtgacttttaagttagatggtatgtcattcaatgaccagataaggactaagttcaggtgcagtttattcaactgatgtgtgtgtttgaaaaataagacgaaaacataatgctttatttgaataaactttaataaaacaatatataatgtatggacataaggaaacctaagtcctcggggattataggggaaaccaaggcatgaggttacctaacaaggaaccttagaacataatcttacctggctcagtacaagtaggagagaatggtagcaggtgaatgggcagtgagcatggacctgaggagaaatgaatttgcctaactttcttgctaaataaatgtgcttttggatgctgacatcgagagagtggtgtgtgaagtaccataaatatttgctttattgtctgcgcggtgtgactgcattctgctcatttgcaggtgggcaatgggcactccaatgaggcagccttgatcctccacagaaaagggtttgattgtcggttctctagcaaaggcacagggctgttttgttctactactcagggaaaggtaagttgaaaaggttatttttgcttactgttagtgtgctttgaaatcctctttctgcaaaggatcttgacaataagatcatgtttcattgcttctttactgtctcagtttcatcagtctgcaaattagtttgaatctccccatctgaaaaatgcactttctcaaaacttcagcctcctttccttgttgacatcaaaaggcatagctggaatttatgcacatttgaaggcaatgctcttgttatttcctaggccttctatttccagcctacaaagtgccttgctcccagtcccccagttttctcctcccctgaaccacacatgctcacatatcatctagttcagcattggtaaacctaagtcctacagaggccaaggcaagtttataataactgaagcttatagaggtagccataaagaagcaactgggaaaattgagactgtaggctagtgggataatccacccacagcccaggaggcagctgtacgtagcgccaatcagttgttttcccttgggaaataaatgtaggtcttggtcttctgattaatgcagatttgcatatgagtcaacacaccgtgcaggccaaacagatcctcagtctgaacacagcttgctggctgcctattgtttatttctcttcaagttggtctttctggcagttccatcaagcctgtccttgaaaggaaacaaacctccaatctcctgcctctgtcactgaaagggccatgactcagagaaggcagctgggctgatttaggtacacaggcaggtctgcctcaccaggcagctcagctgacccagctttcctccaaaacctcataaataatgctgtagaccagactcaagtgattcagttccaaccctacaaattagcatgtgtgtggggtccaaaaagataagaaaaatgtggtaggagccctgaacctacttagatagattagcttctacatttcttttaccctaccctgcttggagctggtgccaagaaagcactgatatttttattacttttttattatactgtatttgcactctattgtattgttgatgatctaagtttacttggttctgagcattctgacattaaggccttgagtcataagggggttatacgatccagagagacagataacatggcagcggtgagggaaatactttccaaatgacctgtccacctctatagactgggactcaatgacataatgatccctccttgtagtgagcctgtgtgctctctcttaactctgttggaacaggaaaaagtggttgaggactaccattgttaggggtaagtattgactaaaagagaatgaggatgtttttaaagcttcttggccattggaggtcctttcttttattgaaaaagcccctgtgcatgataaaattctcaagcaatacaaaaaggaatgcagaatatgttgctcatgaccattactggtttcctgttcccttccaagcgtagtctgtatgttcaagcatgtatatatgtatatttaattcacccttttttctgtaaaagagaacttatatatgtatatttaataacatatatgtatatttaatccacccttttttcctcaaaagagaacttcaacatactgttttattccttctcatactaattttcacagaatatgtagttgtgctgctaatcttcaaagttgatctaaatatgtaaattttatcatttacttttcagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccat

SEQ ID NO: 1580 - DNA, 175902 bp, Homo sapiens
tattaggttggtgcaaaagtaattgcggtttttttgccattacctttaaaaaatcacagttgccattacctgcaaaaaccgcaaatacttttgcacctacctagtattttctatcagctgggtggttgccttctgtatttgtttgctagggatggcataacaaaatactaaggactggctaacttagacaacagaaatttattttctcagtctggaggctagaagtccaagatcaaagtgtcagcgggtttggtttctcctgaggcctctctccttggcttgcagatggctgccatcccaatctgtcctcacatggtcttttctctgtgtgcatgtatccctggtctctctctcttcttataaggacaccagtcagattggattagggccttactaacagcttcattttaacttaatcgtctttttaacttaatctcctctttaaagaccttatctctaaatactattacactctgaggtactgggggttgggacttcaacacgtgtattttaaagagaaacattcagcctataccactttccttccatggccacgtgattggtatgaccagtccctgcaacaatcactttgccccttttcccccaaatcctaaccattgctaacccacaccatctgtttggattcatctctcagtgactcagtggttttgtcctcatatagctttaccatcctagaacatatcccacatccgaagtgaccactttagagttgtcatctcatactcaagatcattatctccttctctctggttcaaatatatattattacagcacctaaaatacttactaattcctgctcatcaggtccaatcagcataatgttgtcaatgtagtggaccagtgtgatatttgatggtatgtcaagacaatcaatatctctgtggactatattaaggtgaattgacatacccccaagacaatactgtgaaggtatcctgttggccctaacatgagaaagccaactgcttctggtggttttacaaacagatatagagaaaacagcattagccacatcagtagctatataccaagtgccaagtgctatgttgatttgtttcagtaaaaataatacatttgagacagcagcagcaattggaatcacttcctgattaagtttatgagtccacagttattctactagatgtatcctgtactggtgaattaaatgagagtaagtatcaccactcctactccttttaagacttttatgatagcactgattcctgcaattcctgccagccatgcagtgttgtgtttagtgagctaagtggaagctctaagagctcctggagcttccatttagctctccctaataatagccctcattctatggctaaatcccaatgtggggatcctgtcagttgctaagtatgtctgttacaattattagattggtgcaaaagtaattgctgtttttgccattaaaattatgctgttaatacatattccaattacactgggaaagtagccacatagttggtatgtggactaacagtggtgatttctgtccccaggaattagcatcaactcagagccagtgtttagtaaacctcaaatgatctgtgtatttccttttcgccaatgcagtttcactagtaaatggccacatgtcgttttggggaaagcttgaaagaatttgccatgtgtactgtagccaaggtgcaagatccttcttaaagggaacacagattctctttcaaccaagggactatgggtctgtgaattgacttaggtctgagaactgagagactgtgactatccactgtggtgactcaagtcaggttttggctacctgacttagatctttttacctgttataaatatcaagcaataatctatttcaactgcctatctattttgttctcagagcagctccgtaagccaaggcagtctgatttcctgctgccctttaaggtacatgtgcgcccaccttgtctttgttggttatgtgctgcctggtttctgctattctgagatcgtgtcatccccattgaaatcagggagcccatctagatagtggcatcctctatagtcaaggttttcaagcaaggctagtctctttagacactggagggcaacctacttccactgataagagaaagagttggcgtgtttaagattgtcggtttcatctgggtccaacccatttcaagtattgagattctattattaaaaaataacaccattttacacgaaaaactcagaatatgtgtgaatttaatagcagttataattcagtaacatgaaaattaaaattttgtttgattctcagcataattcttgttgctacaataaaccagagcttttggaattctgcagaatatctctggttctcataccataactctgagagttaaaaaacctgtgcttgtcatttctctttataaccactcaaaagcacgcaaaagaatccatcccacaccagtctttctagtcatctttataaccatagcagtcaagtgtagcagccacttggggccccaaggcacaggcttcagttggcacttcatcaggatcaaccacaggtaattgcttaattgagatgcccagcatgtcatgaattacatttccctttggcaaggagctaaagctcaaaacctcaatcaaactgacctttaatcccatctttgcaggtctatttcttgggactactcccgggacagggaaggcttaataaaaagaattgttaactataatagaggattagagtaatgaaggattcactagcaagaagagaactttaaagaatatagcaacagcagctataaggagctaaccttataactaactcttgggttgagagacagagtgcccaatgaagaacctccccaattcctcccagggctaagatctagacgtttttggagagggcatgacctggctcactgaatggcagagaagtcaccattgggctacgtctgcaaagcttgtggaagatgtgccctctgcaacttgctgcaaatgcctctagggtgccagggaagttattcatggggtagtgtctcacctcctctacaaagctcctagagttgggcatgtgagaggaaattgctagttactgagcactataggaccttggcagtggagaaagccaggtatgctgcaaaagcttatcaatacacagaaatcaggaagcaaaatcctttttttctgtaatgtctcttcagcgccctctgctgataaagcttcagtcccagaaggcaaacgaaaaactgtttaaaaggctcagatccgtttttacagtgcagtcaaaaagggcgaatttggagctgagaggcaataaatcaataactggcagaagcatcacttctcagattacactcatggatttcgtagtcagatgtttctacatgtgcctggacggccctttgtcagtctcctttcccccaggttttaacaggctgtcaccaaaggaggaaatagtgagcccgaagagaatgtgcaagccctcttctcttgcatttcctccagcccgtcaccaagtactcttccaggcacgccaggcccgagtgtcctaggataggaaacctgagcaacaaagggaagtggggtgtaagctcaacccctgttggacgtgggggtgctggcgcctgaacgcccccgaaggcctcaactcccagaaagctgcctgccaggtcacaagagccctgtgaggtcttcctatcgccgggacactgggaggcaggcgcggggcgggtccgccgggcgacgcgctgtgattgggcgccgtggggcccgccccctcatctcggagcgtcgggagggggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcaggtaagcacctgggaagggggcgcggggctccgaggggccaggcgtgcgggcccctggttagcggctgctacccaacctcttcctcccgccgcggccccacacccgtgctgggcgaggccaggggctctgtagctctcggacggcaatgatcacctcctgggagccacctcgcccgggcgcgccaagttaacaaagtgctgggcggcgtgcggcggcggcggcggcatcatcccgctcaggaaagtggccatgttccggcattcgcacccggcctgttggggtggcttcgggcacctgctggcgggggaacgggcgcggcgtgaggcaccccccgccagcccggggcccgcgtatcccggtggggtcgttctcggctctcacagggttaagccgcccgcaccagcccagagcccctgagcgcacggagtcgcggaaatggatcaaaccgaacccacctaggcttttttttctttttcttccccgctgcctctgaagagagagaagtttatttcgtgttgcggcccttttagatgtgaatctctaggttgattttagtgtcgtcattcttcagctattacatctggtttgtttgtggcagacagggggaaccgagtggggaagcgcgtgttatactccggccgaaagctgtggggcgctcagtcctgcgtccagtggttaaattggtaaatgagttgggaagacgacccatccaaagtcttatttaaagttaccaaaaataagcaaagcggacacagtctgttccctttggaagggtatccaccgcgcggcatgtgcgagttcagtttcaagttacttgccaatataacccgtgcacttcagaaattgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggcacggagagattaattagcttgcccaagatcacacagctgcaagctgagatttgaacaggtagcctttgtagcccaggctcccagccactgagttgtcttgcctcttaggaatctgttgcctactgtttaggctgccatttgcttatggaaagatctgatgtaaaatatagagcagtgatcctcaacctttttggtaccagggactggtttcctggaagacagtttttccacagacaggggtggggatggggggagtcgggggtttcgggggatggtttggggatgaagctgttccacctcagatcatcaggcgttagattctcataaggaccatgcagcctagatccctggcatgcgcagttcacaataaggttcgtgctcctatgagaatctaatgctgctgctgatctgacaggaggtggagctcaggcggtaatgcttgctgacctgctatgccactcacctcctgctgtgtggcctggttcctaacaggtccatggccctggggttggttgccccctgtatagagcatgttgctctctggtaccttagcttatgactaaaggaacttttattttgaagccataatgaatatggtcctttttctgaaacatttactgctagagatttatacccttcccagaatgtctttgagctcatttcagagctaaacattataatgaaaaccattgtgtagtccagcatccagaacttgagttgattcttttttttttcactgcttctaacttattcttaataataccaaacatagcaaaaggaggttgcaatacatttgtttggcaagtttgggtattgaattcttgagttttagtagagccaagcaggtcggtcactatgtgtcattttttggtatctagtagaacggtttatttagataggtattgggttcctctaaattgcccatttagttggtttcagttgatacggaaccttcactaggctttaggtctatcttgtaaacaagatatttttaaagaccatcctagattgagagcaatctatttgttgtttttttggagagcgggggtttgttctttttctcttctctcacaactctggtgttttccaccatttggctggactctggggcaagagtgggctggccgagggtgctccagtttctctcaccccggaacagctgcctgcctctaagatattctttggaagtctatcctgaagcactccgaagccttgcttctgcttctgggaggaattccttggaggactagaggcaacagggggcctaatctgttgaaacttgtgtgtatatttcagggttaataaatctcagctaagaaaattaataaaaattccactgtgaatgagaggttggtcagagactaatgtcttgaaaatgctttatgataacttggaagaatttgagcagatggaaaggagaaactttgttaaggtctccctgaaattagtcatcacttcttacaagcagatttcacaaggtgcttactatctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaagtgaagttaaaactttatctttttgcctatgtaacatttatcaagtgagaaagtgagaatgcctttaaataagcatttgattgaaagccattagaaggtgagaacttgtatacctttttttttttttctttgggatagggttttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgctcccagttgccttttgtgttttttttttttaacttactgtaatacacatacagaaatgtgcttacatactttacatcagtagtacttaagagtccagcatagtagatgttattaatgaaagttgactcatggcaatacatataactaggactttgattccccagtttttttcttgctttcataaatctgtaaatcttacttaagaatgacatataaggaaaatatgatctccttccccttccttgagtgcagtctatttataaacaatagcacttggtgctggggtttgttcacgtttgtatgagggagattgtcttattttctgggatataatgcggagatctgtgctttttgggaagtgatggaacgttgatagtgcatccagcatttaggaatgcaagaacaaacattagagccttttgaggatggtgtcctctaactcctcttcagtccaacagccctgtgggtctcttcctgatcagcatttttcactaagacccaaacttatttcctgtaaaccaactgggccagatactcatgactgtctgtggtctgaagatagtagtttatgttttgttttttgttttttttaaattgaattgggtgtgttgttcccagatgaacactgttatcagggcctaaacaaatatttttgtcagggagatgtcacaattgtattattggaaggggattttctctcttagcttttaatttgcattaagaggtgtctgggctgtgggcaaaatagtggctaaaatgaccacttttatttgtttttgagtcagctattgctttttgtgataactgaaaactttagtcttttttgaaggactgaagtgttgagagtttcctggaatgagtggttcactagctgttgctgatcacctggtttattcttagctttttttgcattcaggagtcttagttttcccttgttctccaacttctgtaatctttaagaaaatgaaaggatatttagcagctctgatgacctgtatttgctggattgtaaaggccttattgcattttttatcccttctgtcttggtaaaagttcctgatagcagcagcttttataaaagtttgagcagaactaaggcaaggaggaagaactctaaaatagtgatttttgcttctcagttgttattagtaggttaatcaggagaggaagtaggacattttaactaaaatgggtttctgtttcagttatcaagccaagctgctatttttaagtttgaaaccatttttaaattcagacaggtttgaggattaattgtactgaaatggagctcacatctagtgctttagtgagtatagctaaatgtgcctataatagggaggaagtaaatcatttggtttgatgaactctgtcacttgaggtcatatcatagcttttctgaaagagtgccctgtttaaggtaattatattttatgcagacaggtggatagtaggtatctagtatatatcttttttttttttgagacggagtctcactatgttggcagactggagtgcagtggtgcaatctcagctcactgcaatctccacctcccgggttcaagcgattctcctgcctcagcctcccgagtagctgggattacaggcacaagccaccatgcccagctaatttttgtatttttagtagagacggggtttcaccatgttggccaggatggtctcgatctcctgatctcgtgatctgcccgccttgacctcccaacatgttgggattacaggcgtgagcctctgcgcctggttggtatctcttaaatatcttaatgttaaatttctaaatctaacatactgttttctaaagaagagaaagtactttagtttaaaactggacatactctaccatttgctgcctctatccaggctttgtaacctctttgctgttgacattttgggccagagaattctttcgtgttaagggctgtcctgtgcgttgtagggtgtctagcagcatccttgctgtctacccgatatctgccaacatcactgttctctctctgtacccctagttgtaggaaccaacaatgtctccagacactgctctcaatatcctctgggagtgggaatcatccctgttgaaactgtgttggctgtggcctcttctttatacccagtacatgtcgttagcacttctgtgttttaggaaggattgatcaaaaggccgaagctcaaaaagccaattagcattttttgatgggtgaactctattctttctcaggatgcctgaaattcacttacacatttaggattctagattgtagtatgttacaaaaaatttcaaggatagattatgttcataggtaagttgaaggaaaaaatggaagattcttataatggaacgtaaaaaaattcttttccaattggacgtgtgtattctgagaaaaacattagggtcaggtcattgtaaatagatcatcttttactttcttccagctgaattacaggttggcacttatccagatttattcctcttagcataggaagataagatatattgattaataaggtagtataaaaattgtctgcaaaaatgttttgaaatgtctgcagttttctcaggcagactgtttacttttcagtgtattgtttttatttctgttaattttgatgattctggttacaacattttaaatatcttcttgagatgagaaaaagcagggaaagaaactggaaaataaggagagtggatagagactttcctcctgatcatttcattttgtcctctaaatagcattttttacgaaagtggggtggaggtgggaggttagggaaagaatgaagttcttgacaaataatcttccttcttttgtctccaaggcctctggttttgaactctgctgagtcagctaactatgagtgaaatctgtctgccacctgtctttatagggccatgtgctaagaatggtttttacatttttaagtggtttaataatgtttcatgacatagccatggtcattcatctaccaattgtctctgaccactttcacacaacagtggcatagtttagtagttaagacagaaactggctcacaaaacctaaaatatttactctctggcccttttcagagtttgccaatccctagtttaaactatatttctctattgttaatattggaggcaaatagtattgttagatctgttaaagtagatgtgagttaattaaagacaaacaaaattctcgtaaattggttattagataagcattggtcaaactttgtgtttttagagagtggtttaaaacttgtgttatctacatgtttcatagatttccaggtatccttggggaactttgatgctagagcatcgacatgcttgatgagtttgtttctcttctttcacctgaaggttttgcactgtaggactgctctgggaaggaaggttctgggccatgaactaggcaaaattgatccatagcttcaagactgaaaaccatgactttatgactttttggatctgctgtaattcacagatgggcttaattctgagcccagtctgattgcttgggttagttagtcctgagaagggagagctcaggtataggtatcttcttcataagctgtaaatagaagatggaactcagccggtctctgggatcctgagcgttgctcagcttggaggcagggtactttcaggttgtcagcagaggtactggcctgctcttctgcttatcaaagagcagttcttgctaattttcatcattttcttcacttttaaagattatatgtcactttctttgctgtgttgctgtgacacaggctaacaccccatttgtgtcctcacagattttagtatcatctttaaattgcagtatactgagtccgaacaaaatgggggtaatgcgtctcatcgagtagtattaaggttagtgttaagtagagttttttaagtatttgtttttttgcatttaaaaatgtatgcatttgtgtatttttcacatgtaaatggatttaccactggcctcctttgcaggtggtgcctttggaagtccagagaaattaaatgctttttccaagagcagagaagactctaaatttgaccctgtcctatgttcttgctggtgcacttcattggcttcagtgaggagtccggagagctgggactttaccaatgattttttttttcttttaaacatgtaaaaggtataaatgcacatagaaataattcaaatgacatagaaaggtacacattgacaatagaatccctctcccttttttccccatctttagtccactcttctctgagtcccacttctgaccatttctttatgttccatgtgtggttccttctttaaatatatgcatatacctctgttttgatttttgtttcaattttgagctattgtttccctttataagagatgaagaatttaactcaataccccctactcttcccagtttttaaaaaagttttgtattcaatttctgtttgatatacattaacagctttcaatgatgtaattgcatttgttttcttgattcatcaactttaggcctaaagtgactccccactctgtcagtcaaggaatttggtacttctcagccttctcccactcaatttctcttccttctcatttctcaccctccctcagccatcagtttttttacatcaacataccttatatcatctacatttcattctgtgactgaatgtgttatgtactctgactataggttggttacaaaaattgaaaaccagtaaacaaggatacggaattttaggtaggaggaataagttcaagagatctattgtacaacatactgattataattaataataaagcatgtagttttgaaaattgcaaagagtagattttaagtgttctcaccacaaaaaagaataaataagtgatgtaatgcatatgttaattagcttgatttagcattctacaatgtatgcatttttcaaaatgatatacttgataaatatatacaatttttatttgtcagttagagctcgtttggaggttccagcaggggagtgcagctccttgtatacccttgaccgaagacccgtcctccatcagggatggtcatcctctacgactgagcatgcagcttcaggaggggctcacatagagtggtgagggaggaaggggacacccgcctagccagccagatcagccgaatcaaccctggcgatcaatggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgatatgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggtttttttttttttttttggtcgttcacaattactgtttcctcaaactgccatgcttcttctagaactgatagtgctttgtttcctttgtgatgagaagcctttcccttcagggtgaggacttcggggctgaagatgtactttgcagcagttcccttctgtttcttcataccacagatgtagaggaatgtggcatttatgggtcctggccttggtggtaacattttacctgtagagcatcggaacattgaagactgagaatgtgaatcattcttagaatcattttctacataaagtcctgaattggtgtttttagaatccagtgaagcagtcattcttttaacagtcaccagcattccagaaaagtcatgaaaaattcaggcacagaattgtagagtaggctgggtccttccaggtcaggtaatttttagtctttgatttttcagataagggcaccgagtcacacataaactagacctcagcaatttgcccagtcacaggatacctgggacatgcatcctgacttataattcactggccttccactgtactatacccatatccaacatatatttgaaaatttactgggttaggtaatatggaaattgtggtagacatatgttacttgttttgaaagaactttttagttatttagggaaacaaaactgccgtttgtgaaactattagagccagttaagtgctattattcattagaagttaaagaggttagaatgttgcctggcatatagtaagtgctcagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggctttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacagaacataaattgtgtgtgtgtgtgtgtgtgtgtgtgtgtgtgtgtgtctgtgtgtgtagggaggatgggcagcccggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataattgttttaaacaaaagagatttgagaagaactccagaaatttgtatccttaactcatctttgataaccaatggtatgatatttagaagtttgctattaatgtatttttatgtattatgttatgtcttactactgcatttgttgcttctgtgtctcaccttgcccttgtagaccagttgttacagatggatttttataaagaaaggcaataggaaagaatttgtaaaactttagagtctgtagtgcttgtataaagagtagtttggaaattcagaatttataataattcagatgagacttgcctaaatacctgtcccctgtcaataagaaatagaagggacttattcaggagatgattagtataaataaggttgaaggggggttgattatctacttaatacaaccctgccttcagaggctttccaaaactatttctgtatgaaaaacgatctcagacatgtcagttgcatttattttaataggccaacactgtttaggttgattactgacaattattttctttttgttttgaaattgtttgtcaaaattacttgtttaaaattataagatgttgacagaacttttgttagcatatcctaacatgcaatacatggcattaattcatggtaaatgtgtttaggtagtgtgaatggatagtgcctagtaaccttgtgtacaaagataagcatttgtcaaacatgtaagacagattaccaacatagaccagcaaccattgcctatatgatgtgttaacaacatgaccctgtttagctagctgagaattgttaaggcctgaaagcatatcacatgaaccttcatgcaagttcttgggtgggatacactgttgacagattctgtcagagtgctaagcataagaatataaattaaaaataagttttagaagtaaagtcggtgtggtttttaaaaaaaaatcctgcaaagaatagtgttccatagaacagattgggaagtgctgaattaaagaaagagttctgttagtcaacagttaatatgtttagtgccacttaattgcagttattaaatggatttgtaagtaataaaactgcattttattaaaattttataatctacacattttgccctagttatacacccttcttccactcacttttaagtggttatctgttttgcatagtctcattttatgtaatagcttgatgtctaaaatgttgcctcaacaggaggtagtttctgtgcagccatattgggctggtgcagatagggccatatggttctaatctaaacatacatctggaaactcatagggtggagctggtgctgtctcctggaacctgtagaaaacgtcagcaactggagtcctgaccacatttttggaggagggtggtgagggaatgagatgctattatttgaggtcagggcttggatcctgtgtagtgattctggcagctactaagttggtggcccagctgcagtagtcatgagtcccttgagtgctctgccagaacaagggatgttgggcttggagtcccagcttttcccttcacagtcatttggcactcttacctgcatctgagcagcctctgttactgtcatacctaggcaggtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacagccccagttcacactctttttggcctcagcactacacatcttaaggggtggagtgggcgcttggagggttacctgtcattttatcaagcccaaaagccttcctgttaagttccagagatctgactaaaggcagggtttttctgtagagattgaatagtggttgactgaccagggactgcagcaataacgatgacacccctgctggaaatacagactctcttttaccaaatcgcagttcctatatttagctttaatgcggcgcttcttaactggggatgtgtgagaatcgcctggtgagccattttaaattataaaaggcagatctctgcgcttttctaggtaatcccatttgttcccattgcttgaaattcatatttattctggccactcaagtttatatatttagccctgacttctctcttgagttccagacttgcatgttcactgacaccaccattcagctatctaatagtttcagaatataacatttgcccttctgtctcctccccagtaactggcttgtgggcctgttcctctaaaatgccacccataatcctcccccttgccctagcaaaaaactcaatgccaattttttttcctttcctgcccctcccattcctaactcatctttcttgtcattctttcatgttccttcccttcctgtccaagctaccatggcttttacctggcaaactgcagtcttttactccatatgccctactgtggctccagaatggcttaaaattttttaattgattgattctaaaactcagtctaagataaagatgttgatgctgctttttctgaaaattactttgaaccataaagggtgactctgtcttttcttaactcctttattcaaagttaggtgtagagccttgttagaccaaattatgcccctggaagacagtttatgaggttgcacggcctcaccctccattgcttgggctcacagctccttagggtcatggctctccagctctgatgatggagatttgggcaagaatttctctaaaaaggactaagcataagaatataagctttatttttgtagggccaactatttgctaagtatattagtttcttattgctgctatcaccacaaacttagtggcgtaaaacaagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttcctcttttccttatgattacattgggcctactcagatattctagggttttcttcccatctgcaaagccttaaaattaattacatcagtgaaattccttttgtcatgtaaggcaaggtattcacagatttcagggattattaggacagggatatctttgactaaacattattctgcttactgcaccaggcgctatttaaatttacttgcatatactaactaatcctcataacaaccctatgagttaggtattattctccccattttacagatgaggaaactgcagcacagagaagttatgtaactttgaacttgcccagagttacatagccagtaagtagtggtgccagaattcaaattttggttggcttcagagtctgttcttaattatgacacatactatctggaggtgcatattgtagtacccttcaaagtgatttttcaaaagccatacttttactatgtagcagcagctgcaataatactttcttcactgcttacttgttggcaggtcctgtgctaaattctttcacagccagtccaagcaatggatattagtatctgcattttgcccatagaaactgaggcccaggattaagttacttccccaagatcacatggccaataagtgcggaaactagtattggaagccagatagcctgaacaggagccaatgcttagccattaagctgaattgcttccacctttatctggtgaaggatgtcattaaagataaaggtaatctttgctcttacatggtgggcacatttgatgacataatcagagtccagaaagaacttgatgtgttggagtgatatgttgaatctaacacaattagatttgaaggaaaaaaaaaacataaatgaaaggtggtatagatcctaagtttcagatacatgcatacactttggggtaaagttttgtttcttttgaatgctgctatcggtgggtatattataaacatatatatcttctacagctcttataactagaaacttgatttggttgagtgcagatcttatatcactaccatgataggaaatagtccagaattatcttggggttctttttccaaacttccttcactccccacaagaggtgaaaataatagtctcttgagccaggttagtgatggtagtgaaaatggaaaacttttgattggactgtacagaatccataatctttgctctagaaagggagccacatattgtattctattcaccaggtcatggttgtcatcctgtggccaacgtgggtcccattctatgttatttcccaaacagcccatgaaaaccaccctattaattagctctttccttcccattcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagcaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcagtccttactgactgtggtgtacaatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgccttttaattccatctgggctcccagttgattggatggtgactaccacatttagggcacatcttctccacttagtccactcacacaccgtctcctctggaaacactctcacagatacacctggggcagctcaataattctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcacaggagggtggaagcacagagtttgacttttttagatgtatatagcatataataaatattaagttcaaccttacgaaattggtgatatttgactatgttttacctatgagaatggcattttcgtatagtttgatctaatagaacatgttacattactgagaatgagttgcttttagaagtggaacttgattgagcaatattgagagggtttaatcaaaagggcaaagaacaaagccttggagcagttgagataaatgggattgttgctcggcagagggttggcctttgaagcagggagaaggaaaggcacacagttttccaggaaggcaggagaagatacacagattcagccatgctggaaggatcacagtgaggccaataccagcgggtagtgtcctatttgaggcaaataattatgtaataaatttacggatttagctgtagatacacattgattgattttgttcataggactgagtggtaactgagcctgttctaccttgtggtagactctaaatttgttctctcaaaggtatttgatatgtgattttttgcttggtttttctctttcactaaaagcggagtaaatcaaatatcatgacctccttccccactcctgagcggtgcaatgctgtggcctccctgtagaactgattagcaaatcaaagaataaagtagttttctcataagtgattttcttgccctacagaaaattgtctttttcaatgttactataagtattctttgacttctcagcataattgaagcattatctatgatttctgtttctttaatgcagactacaagtgcatccttttaaggtcattccactcttctctgtcacatgtacagaatttgcttatgagggtgttcatttcaagaatttcacctgtttggagggagactttattccaccgcataatataattttaaaaatgatgttctttagaccattgtgtgcatatatccctaggccataattttctccatgtacttaattcagtacagaattccaggtactgatcattaatgatatctttaaagctaaatgagattgaaagtcatctttaatggctgtaggatccttttttcatgaactaactcctctagctaatgtttattttgaataatactcttatccatggattatgggaccaaagccataataaaaatattcccaggaagggttgtcttcttattcagtgtgtacttgttgagctataggcagttttgctgtgtatatggctctaaaatgatcttttcctcaaagtacagaaagatctggagaaatgtgggcactcatgtattaagtttgtagtattataatattgtaagtataagataaaatgtggtatttttttttttttgagacggagtctcgctttatcgcctatgttggagtgcagtgatgcgatcttggttcactgcaacctctgcttcccaggttcaagcaattcttctgcgtcagccttccgagtatctgggactacaggtgcatgccaccacacccagctaatttttatttttttattatttacctatttttttttttgagaccaagtttcgctcttgttgccgagcctggggtgcaatggtgcgatcttggctcaccacaacctccgcctcccgggttcaagtggctctcctgcctcagccttccaagtagctgggattataggcgcctgccaccatgtccagctaattttgtatttttagtagagacggggtttctccatgttggctaggctagtctcaaactcccgaactcaggtgatccgcccgcttcggactcccaaagtgctgggattacaggcgtgagccaccgcgctcagccgctaatttttgtatttttagtagagatggggtttcaccatgttggccaggctggtctggagctcctgaccaggtgatccacccatctcagcctaccaaagtgctgggattacaggcatgagccaccgtgcccggacaaaatgtggtatctttaaaagctctgtggtgatggcattttagattaaggtaatgttttattttatgaagatgtgtagctgtactgctggcgagatgaatcaacatgttctaatactgcttgtaataagagtaacttgatttaccattacctgctgtggtaaatttgtatcttcagtattggaattattcaacagaatctatcagaagggatttcaaaagctgcagtctgtggtgttgtgataagtgaagaaaagcatttcccctatttcagacagcctttgatagcatatgtatttaggaaaatatatacagattcatcaactgtacctgactcaaatatttttagcttctttgggttgaactttgggttatgccaagggatcccctttcgtcttttcatggagaatcacttgtaaccaatgttgatgtgcacttacaaagaagggtgtaaaggtttataggacgatactactcgacagctctgaggatctggaatctacatggttcaactagcttctctatttgagccctgaactagtgttgcactcatctcccatttcctttgctttgccatttccagttgtaaagtgatgtgtgctccctctcttgcctttcactggtgcagtggggcttgtctttcaggatgggacctgtgctaaaactttttcttgtctctgtgtatgctgataaacaggctttagagttctatcttgtggtgacttatcaccccaccccatcttagagatgacaattgcctttaaaggactatagttttaatgtgtagaggggctctttctgttatgtgcttctaagtagagaggcctgtgagagcatctttcaggtctgagaaggtacatggctgtcttgtgctcctttcttctctagcatcaggctgtagatattcacccctagtgttgtattgcccccaaccactgccacccccagtgatttgctgctaattttggctactttttttttttttttaattccaaaatctgttgcagtctcttcggacttctgccaattctggcatagtttgctcaaatgattggccttttcttggtagatctcagtctcttaacttctccctttccccttgttgaactgaccaataacctgtgagtataaaccttatatcttgtgtgttatatggtctttcatattttttcctaaagcatatcatgtcatacatactatttttaaactgccttttcaccacttctgaaaatacctttccttactttatcttctgaaaatacctttccttacatttctattttaaaacaatttatatttctaaattttcagtggctgacatcccttccatgataatgaatctatcgtttgaccagtcccctacttttgggcgtttggatattttctatccttttctcttttctcttcttccttctttcctttctgctttcctgttatttcctggtaatgagtatccagagttgtttgttcaccatgcatgtagttttttaaaaccttaatgtgggttttttgaggcttttgctagttataacatcaccttgtgtgttcaaagacaggggcccgtatcttatgcatgtcttcctagcatacatgcctgacacagtggccattcactaaagaattattgttgagtttcagaaatatgagggccatttgacaaataaatgagtaccttctatgtacttggaacccaggatataggggtgaacaaggtaaagattgtccctgctctcataaggtgaggtattattttgtataacgaggtttatgttacagagatggcaaccctcttaatgtgaggatcaatgaaaaaaatttaagacacacagtatagcaaaagcagactgaatgacttcgggtatggttacttgggagatgttcatgcttatggctgaattgactaattgatttttccatagatgatatttcttatttaggattatccactagtgttaagggattgagatggaatgatctttttcaagttcatacttttttgacccttgtgagtaactccagtcaattatacttaaattaaaaatttcatacctgaatataatatgctgttgtacagtgattccagggacccaaagatattttaggactgagtttggggggaacagaaatatttcccaaaatatttttggtctttctgttgcacgtcttaaaatatgattaagcaaagattgcagccgcggagaagattttctgctgtaaattggtgtttcaaccctgccagctgttcatgctttctgcgatcccacttataaaagtggaaagtgaagggtgagtggctgccctcgtaggcaaccacataatttaaaaaaaaaaatgtgtatgcctcagcagatctatattagtatttcatatagctgcctttttcttttttattgtagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcaggtaatgtatacattcgttaataatcactggcctttttttttttttgttctttttaagatttgacctgatgtctgttctgacttggtaagttgcttaaactctttggattctagtttctctttttgtaaagtattttgattagtcacatgaacattaatgttctgtttagtgataaaattccataattctatttctctcagtttatcttactattttatacttacgtgaatacagtctttttgtatgcttttcaggtcttattttctgtaatagttgaaaacctttaaaggtttaaattttgccagagatttttttttaccttcctttggagaatacaagaaaatccatgttcttattatatatcagttgtacattatagattttgtacaaagtaaggttagacttttttttttttttcttaatatccttttgcaagagggaagggaaatattctagagctgtactttccagtatggaagcccctgtctgcgtgtggctactgagcacttgaaatgtgactaatgtggcttgatatgtgctgtaagtgtaatgtacacacacagtgtttcaaacttagtgtgcaagatatcttaattcatttatatattgattatgagttaagataatattttggatatactggattaatgaaattttaaaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcctcgttttcgaatatgtactttccactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatctgggctggacagaaaggagttgcagagcaaccatggaagtcaggcagagcaagtcaggagggtactgggagagctgcaggactgaaggaagaaacagacactgctaacacatcctcctgcccagcttgtttccaaagatttgtcagcttatccttgagaagattttattttatttattaaactcatatattccatagggagataaatattattggcttaaaatactttgtattgactttcatataatttgtttggcctttaaattttttttataacttatatttggatgtgatttttgcagtctagttttaacataatttaaattttacaaaaggttgtttggttgtgttgtcacatttaatattatagagactatgaagaacaaaagtaaagttttagtttttttcccaccgttttttcctttgcatcccaacattattagccagaaggaatgctgcattgaaaagctagaaaacaataggatacataaaagctaaatctcaattttaaaatttttctcaatttttagatgattatgcctggttgaccctgttgtagttttacttctaggataagataggtagatataacatatgctacatggcagaatagctatagatagatatatttttgttcaggcatagatttttaatatacatgagatttactataaaataaagatagcacaaagtaaaatatcattttcagaactgtttttgaaaatgctgaaatatctggtcataatcaaatttcatcagaaatttttttcatggttctttttctataaatttctattaaattgttttggaagtaaagtaggagaagaaggaatagaatgaacttttttttttattagaagcggatgggagggattatttgtcagggtagttttgtagcacaaatagcatttcaagcctttgaatggtgatggaatattttctactctaaactcctcaatgtctacagaaatagttttattttataaaatacatatgcagagtatagcagtgaataattttgagcaaatatttaccaacattaaattaataattgttaaactttaattttttttcttttacatttttagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggtaaaatttgcacttcaaaaagacaggaggttattaagtttctttaggcctagagtcttttaatgagaatctggtagaggccacttctcaaatttttgagacattattctctgacttttaacattaatatattccttttatgtgtcattatgttttagtgttctcattttatcagtttatgtgccattcaaggatagtatctgtgcagtatgaaatggtaataaacaaaaaagaagggcttgcctttggggacaaaacagtatatagttttaagagactgcttgttcattttagtaactttttaaaaaatattgcataggaaaattatttcatgtctatgaggtctacttttagaaaaggcagaatactcatgggaaagtttgaatctttaaaataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgaccccgccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttctttgcttccagcattcatttatcttctacttacattttttccccattagtttattggcagatattcctatttttctattttgaagacaacaaaatatgttactttaggtctggacacatgatttagtgaagcattttttttgtgcgtgtgtgctgcttttggatgtgagaggtagtctgcaagcttggatattgaaatgcttggatttctagactacagtgcaatatttagtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctgtgtgtccttgggcacattgatttgtgtatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgtatctttgattactagactcacactcagtgaggtgaggtgctcccacttaatgtaggatctagatggcttatggcactgcagattttttttctctataaatctcataatcacttgactattcaattattgagtgaaatggtggcagagccacttgtaatatctaagttgttctcccttctctttctgccaatcatgtttagtttaattcttgttacttaattgggagagtgatgtgattccatagtgtaatcttccttgtaggcttataaatatacttcaaagtgtgtcttgtgagtcttcctcatatgaagcccacttcttcccttttcttgattttttaaaagacctttattcttttcctttttctgcaacttttaattctcaccaatctcatttcttgttattccatacatgggcacttaactgtaataataaaatccatggtttactgggcagaatgccaaatgttttacaaacatttagtgcatacgcatgaaggttagtgccatgattcacgatgaaggtgttaccaggttacatagctaacaaggggcaccagaatactttcctgacaatttacctggatctcccactaaagtaaattctagcggcaaagaacatatgcctcctattaaacacactctcctcatggcctagctgaacacttggcatatagaataattgccaaataaataagacctctttgacctttctcaaagcccctccaccacatactcatactgcacacacacgcctccacgcttgcaggtcttcgcagatgtaaacatttacagcacttttacttggtctcctcactagaatgttagctcattaagggctggaactttgttttattcactgctgtgttgggaatgcctagaatcataactggcacatggtactgagtcattagagtttggttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaagtattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactgcaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttcatcggtggattttcgtctattgggaatagaaatatttgaaatagatttttaaaaattttctatatttagttccccaactttgtgaatttatgttgctgtgtttttctatatatagatatttttctttttggactgagttggtaatatctctcaagaaaaggtaaatttcaaaatatgtttgtattttaataaaattccaaattatgttacagtctgaaaagatctaacaattgtcataaaatatttaagtgttttacatgagtaaaaactgaattggaaaagaattgtgaagtaaatgctgataactttgtactgttatgcttttgaaagttttgaatcatagaccatgaaattaaatgttagttgattgatacatgttcatgttgtatttaataagctgattaaaacacaattacagcacctctgtatctataatcttaattctttgcttcccactagttaaactgctgaaatatttggttaattttacttcaaagaagtcacagtgtgtggagagaagataaggtatactaaatgaaagattggacagcatattgttagttaagcaatttgtgaaatgaacattagaaaataatcccccttgtggtatgactctaaaatagtaggaagacctaggcccaagagttacactggaaaataattttcttttgtacatttgcaattcttttgtagaactttttattgactcagagggtgattaggactttttgcttttttgtgtgtgtaaaattaagaaacagatgtttgcatttagtattatgataattatgtatcctctaaaaaagtttgtaaaaaaagaataaaaacatgaggaaatcagtgtaatatttccaaatatttctattcaaatattttcaagtatagttagaatttgaaaatagttctggtcagtcatagttggctaatatctctattaggggtgtccaatcttttggcttccctgggccacattggaagaaaaattgtcttgggccacacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcggaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagttaatttaattataaattctcagaggttggtgaattgaagctcaggattgcctgattgtaaaatctgtgttttttccatttacctctttttattgcctcttaagatactttatttagttcaaattattctatttcttttcttcttgtgttgtaggcattagctaatttaacacatttatctggactttgggttattaatagggttgtcagatttagcaaacaaaaatatagaatgctcagttaaacttgaattttcaataacaatgaatagtttgtgtgtgtgtgtttgtagtttgtgtgtgtgtgtttgtgtgtcccaaatatcacatgcagcatgcttatactaaacatttatttgttgtttatctgaaattcagattcaacttggctgtgcattttatctgacaaccttaattgttaagaaaattgtagcacttgagttaaatggcgctgtatggctatttagaattctgtttttagagatctctaaaatatgtgtattgagattctgttttagaggaagaatagatggtttggtctctcattggactttattctttgaggagcacatatgttaagcagctgctgagaaatttagatgatcattaaatagctcttctttctcctcagtttcagttacctttgtctgtctttcaagcctgggtgcttcaaaactctccagtgccctggtaatacaaataattactaacacttagggaattattatgttctgtgcactattctaggcattttacatatatcacatccattactcctttcagcaacttcatgacagagtctgtaattaccctcccttcatagatgtgggagaagtggcaggagagagcataagtgatctgttcatggcagggctaggtttgaaatcaagtgatctttttccagaaccagtacttgtaacagtttttaacatattgcgttttttggataattcttctgaaaccacaggctgagcatataggagggaagtcttttaagtatttccaagccaaatgtcaactactttagtattattaaccataaaaaagatttttttcagctatcttgcaaaagtggacatctcactgcactatctcctatccttcttttccttctgatttatcttaattgaaatgaatgtctctgtccctaaatactatattagtacatgagatagtgagtgattttcctgattgccacattttctacaattagaaagtgatttacaagcaatattttccagcttttgttttgttttgttttgttttttgagatggagtcttgctctgttgcccaggctggagtgcagtggtgcaatctcagttcactgcaacttctgcctcccaggttcaagcaattctcctgcctcagccacctgagtagctgggattacaggcacacgccacagtgcctagctatttttttgtatttttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatattttagacagttttctcattatttcaaataaccaagctctgtttggggaagacttactatgcctgaagtattgtcagtcagtgttagatgctcatagatgggatcattaatgagggaggggaggagctttagcacagatttagaaattatcttggagattgatcacacaattgcagctatgagaaaaagtatgcaggtcttctaaggggcacttagaaaagcaatataataaggggtcacagttgtacattgtacgtatagggctgcaggatgaacaaaacgcctgctgtcctaacaataatgcaaataggttcctctggtgtggggtaaaatttccagtgacagcatcttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttcaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctctatttggaactaccaccctttttctctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtatgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtggaacaaacctgcaaatatacctcttgaatctaaaattaaaaaaaagaaaataaattattagatgaaaggatatttctgtttttaatgaactttattttaaaatttgagaatatttatcacattgaaatggaaaaaaaatcttgaggcttaagttgcatgtgttgtttattaccaatgtattatttatctggatataattattttttattcaaaaacttttcatgttttcctgaagattggtgcttatttaacttttgagtggaattaatatacttaaaaaatcgttattaataaaaataaaaagaaaagaaaaaatcattattatagcaatcaaaaccatagcagtgtaacagtgctttgtggagcggggtgccttcttagggatgggtgttttaatcatcttagggctcacagatcctcttaaaatataagtattttggaaacttaaagataatggacaatgattattaggtatagcatcagaacagagagtgaacatattaaagctaatatggttgtattattttatctttagtttcatttctagctgaagtaataaatttgcatttgtacttttttcctagtccttttggctatacctttcattcatcttattaagtacttattgaactcttgctcttatatgtttgcagtagatactagattaagtttgagtggtatgtgtgctcaggcctgcttctaaaatttgcaggaactggggcaaagtacacagaggcccacataccctgtgtttaaacatttaagttataaatcaaagaaataaattactaaagaaaaataggtcttctcctcttgcctggagaaatagctcagtgatctagaagaccaaatgtaggtttagattgctgttgctctagttccccactggaatatggtggtgtgtatggggagagccagcctgtggggcaggccagctgccttctcctcccaggcctggccctgtcccaaaccaggaaggaccttgattgaagcggtcctggtgccaggtctacacccctacaaactacagcctcttggccactgtttaggctagagagggtcggtcccatttgttagggttaagtgccctgatggggagagacttataagaatcccagtaggcttccagtctggggctgtttagacagatttctggaccctggtactcagaagggcagggcaggctctgggtcagtttgtcctgtggatttatccaattgaaaggggtgtagtcagaagaatagggaggtccttctagagtccagggctcagggccaggtaactcttgcccacatcctcatggtggtacttagtgtatatgcccttgaaccaaataaaactaaatgttcctgaagagcatcagaactccacataatctctagatttccaacctatggctgagagctcaaaattttaaaaataaattgtgatttgtgaacagttactaggtgcttaattgttcatgaacattgaatgtagacaatagagtttccagctttattggctttttttattttagaacttaaaaaaaaatagtggtatcgaatttgggtttatgcctgctttgtggaacttgtaattatgcactctttgttttaaatatttccccacttatttaaaatagctattagcttttttatgggtggtaatagtgttagaatggaaaagaataaattgaaaggtattcttaatgctgttctagccctcgttcaattttcagggatattccaacagaaagaaaaaaagctgtgaattgaccacttaagtaaatcagtttgcaactcagtgtcctaagattattaaatctagaggtaggaatataattttatgtcatgaaaattcatcccctaccactttttataaaatactatatttctggttggtctcatgttaatatacaattgtagtttttacagtaatttagaaaacgaaagaaccaattcagtgtaaaaggaaatacttgattactctgttgtataagagcaataaaagctaatttactgttatattactcagtactgaaagctgcaagaggctatctttcagttcattcttcattaattatgctgtatggtggtgatatcagtatgagttttatggaacgctttcaggttgacctctctgagcttgtattttggctcatgtgaatgtctttaccatattttcctcatgattgttgaggggtgaatgaagtgttgaaggcaaaatggactaatcaatcactgtgattcctctgtgaaaactcccatgataaactcttttttgaaatggccttagttcattcatcacagattataactgttgaaaataaatagttgtgcttaacaaaaaacatacaaaaaaacttttacttatcaatcttcataaagactaacccttaaaaatttgccttttatgctagattactggagttttattatcaaattaatttggaggcatttcactatttatagttctttagctagtagccagataattaggaattagtttgaacctttaaatttaggtaaaagatatcatgtgatatcttaaagacgataattctaatagaaccatttcatttacatggtccttgttgcacgtgtataataaaagcacggtacagaaatagatttacttacgtacatttgaatttagctcagttttgcaatatgtaggtagatatagtatattcagttaaatattatgttgatatttgataaaataaattcttcccacattgcaatctttatttcttggatggtaatgacgctgatttgttctagggctgaataagtttgctagggctgccatagcaaagtaccagactaagtggcttaaacaacagaaatttgtttttttcacagttcgaggctagaagtccaagatcaaggtgttggcagggttgatttcttttgaggtcatctctccttggcttgttgatggctgtcttctccttgtgtctttgcatggtcttccttgtgtatctgtgttctaatctccttttgttataagtacatcaatagtcatgtaggattagggcgtatcttcatgacctcattttaccttaattacctctttaaagacctgtctccaaatacagtcacattctgaggtggtgagacttcagcatatgacacagatctgtccataacaagggcatagagtgaattcagtgcaaactgaaattttgggtaaccaatatatgttttaagatgtggagcagtttatataagtgttttaattgtatactttacaaattgggtgttcagaatattttttatttcccctttacctaatttaattgtacagatgtgggaaagggcagttaaagactgatgatgatatcagttctgagcacttgatgttttttaacttggtagtgttggtatggtcatcagggagttagggcatctgggttggttggactttctgggctattccctgggaatccagaggtggatcctggctcagtgctctgggggcagtgttccaggttagtactttggtgaagctaggtgggattctttgcagaccaccatttcatgaaatatctttgaggttttaaaaatagacacagttttttttagttaaatgtggaaaaattgaagtatccaggaggtgttctttggtaccaaatcaggttaaaagtgccccagatcaagaaagtcctataaagactatttgacattatatttctatttggcctatagcttcatacgtgccacattgtaggtgctcagtaaataattgtaggatggatgagtagatttcaattaaagcaagaggaataaataagtcatagctgcagtgctcttttcaaaagctcatattcacattgtcagaatagttttgtcttctctgccctggcaggcttttattttttatttatttatttattttttgccagcaaatatagtatacatattaatttaactatatacagataagaaacagccatttggaccctcttactctttaattctctcacatgtaagtttggaaacaatagaccaatagttcagcttggatatacaggaacttctccttatacgattttttagatgggaacgggttattttttagggggtctgctttgcctgccaccagtagacagaattggtggctgtgtacgtttttgcttggccgttttagtagtctgccttgtggtgctatgtttgcacctgttggtgttaaaaatgtttcttatagccaaattgcaactatctttagataaaatttccaggatatttggaaagtagaggaaaaaacaggagaagcaaactgtcaacatctacagttctctttttgaaaaattttacctatatgcattcgcatttgttgtttgattagtgttactttgtgcttctaaggaattgaataatgaacagcttttgggaacaaatgcctgtattttgcagaattctacctctcagtgttcatatttatggtgtaattaccttattggtctgctgaaagcttttaggtatagtttatacttgcaatctcttttttcttagtttaacttatttaatgggtgaagaattttagatgtggcatgagaggataaaatttggatcccctattaggataacagtactgccaacttgtaaacagtgtttagatttttaaaattcaaaaaaaattccttagagataaaaaattgaattagatactataattattaaaatataaataactgctttttggccttaggtcatctatcttatttttctcatttctatctgaatttgtgcagttttcagagtgttttcattgttttaatattagtgggtttctgagtcccatgacaactaaaatggagtttcattaattgaaaacacctgttaaatttaaaaatatgtctatgaatgaaaattctaacgatgtccaaagtaatgcaatggaatgtgactgagttgaaatcagccatacgaattagacctttgtggtatatttgtgtcttgatttaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacatggtgaaaccttgtctctactaaaaatacaaaaaaattagccaggtggtgctcacgcctgtaattccaactactcaggaggctcaggcacgacaatgcttggacccagaaggcagagggttgtagtgagccaatatagtgccactgcactccagcctgggtaacagtgcaagactctgccttgggggaaaaaaatcctatgttacaactttgtcccacaaatggaattactaggtcaaagtggcttaatagtttaaaagttttttttaagtatataattaaagtgacacctgtatagtttgtttcaatgtatatttcaatcttccatatagaaagtatcaatttatttgctttttagtcagcaatataatttttgaagttgttggccaatttgatggttgaaaagtttaattttaattttaatttttgattggtaacagtgttgcatattttctcatacaggttaaggtttttgtgacttgcttattgtactttttcttactgatttgtaggagtatttatacatatactccttaactcatatttttcctcagatttttattttcatcttttagtgtttgatatacaaaattttaacatatttatctactcaaatctgttattctgttttcttcagatattgcttttgctgtcatgttttaaaaagttttctccaatctagaggtcaaataaatagtgctttttttcttcctaatttcattttttaccattcactttttaaaaaactgattaaaaaaaatacgttacgatgggaggttttctgatctccatgtatcccctggagttaagaattatcttataatgaattgttttctttaatttatttaatgtcacttatacagcgcttactgtattagtccctgttctaagcactttacaaattgtaactaataatcttctaaacaattctgtgaaataggtacaattgttatcattgttttacacataaggacactgagtcgtccaggatcacagggcagcctggcattccatgtagtccaggctgtccacctccagaggctgtcttctttgcacactgcgccatcctgccttcctaagattgaattagtccatccttttctagtgatttgaagtgcaatctttattatatttaaatatgcattagtttctgggcattttgacttgtttcatggacttttctgtttgactgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaattttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaattgtgcataagcaaggcaaaatttatttcctcatgtaatcaatcacctgggaactcattcccatttttgaaacaagtgtttatggcagaactgactgtacttattttttgctactgttcccctatcagcttttattttttgggtattttatgttttttttttttttttttccattcttgcctgatctttgttggcttctgtattagctcattcattcattcaacagacacttcccgaacgtctactatgggacagggactgcaaggtgggcactcctagactaagatttatttttcttcattgtaaactgtatgtatcatcattgataccatcttttctcttttttataattaatattgttatactaccactcttttgttgttcgtttgcttgagtttgctgtcctttttacttgaaggacagtcagcttggtggttctaaaggctgggaactggaaccagtccgcctaggttcaaattctgccaagtcccatctactgtgtggctttgagcaagttatttaacttctctatacctcagtttcttcatttgtcaaatgaggataatattgaaaccaattttatttggtttttgtgaggattgaattaattcagacaacatgcttagcacaatgcctggcacattttaaaaccccaataaacattagtgcttttttaacttttatttgagactttgagtatttctcctggataccatatgtaatttttaatgctgaagtcttctataatgggagacttttcttttagtttttgtttttttttgaaacagggtcccactctgttctcaggctggagtgcagtggtatgatcacagctcactgcagtctcaacctcctgggctcaggtgatcctcccacttcagctttccagtagctgggactacaggcgcacaccaccacggtggctcatttttgtattttttgtagagatgagattttgccatgttgcgcaggctggtcttgaacccttgggcccaagtgatccacctgcctcagcctcccaaagtgctgggattacaggcatcagccactgtgctcagtccgtataatgggaagattttaactgtaatttttttttctcttctctcttaaagctttcttatataatgcttcattgaaggtaactttttccccatgctcacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcatttttaatttgttgtatttactgtgttttgggagatttttcccaagagtcttccctgccactccctcggttcagtactctggtattgagtcttttctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtactagttattactggctgaccagcatccacttcacctgatttccttttgggaagtggtctctcacccaaggaagtcagctcctcttccttgttgcctagcccagacaagtcagctgtgacctgagctcagttaatcagcatattatttcccagggctttgaatctttagagagcgaagtgagggctgacagatggagggagggaagcagacacagaagaatgtttactggtcattcctcacagcaccttgcatttgcaagactcttcctgtaataagatccctgtgttccctgcagcatgatttctcattttcctccagccctttgttaagcctggacttttagcctgtcttcagttctgtgtgttcaagacagtatccagcatcagtttgtattgcttgcaaaccagaaagctagctgataggaacttacaacgtctccttagttcctctgttggagaattacatcctgcaagattatatgagaatcagggatcagcagttggggaaggtgtcctggttgtaaataggacagagtgagagaagagaggagctggggctatgagaagatctggaaaaggagtgccccatctatgaaaggttttctgtttctttggtgtagctgctgagcctggggctggctttctccctctagctttgtttttgtgtggcctgtaagccaggtaggagatgtgtgtctgaatgtgctgcttcacagagtccagccacctcagaaggaaactgggtctgctgctggctgcttgtggtcaggtgaggccagccatgcttggctctctcccagcatggcttcattaaggagactgcctctgcagcagtcacagtgcatgggcagagagacttctgcagagggggactcacacaagtgccatgagggcgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagtacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactcagatttgtctcactcagattccttctgagtgagaacagcttttttggcattggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattctgagcttgtactaagtggcattactaatagatttttttgtgtgacttctagtgtaatgcttatgcagtggcttttctctttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattattattcaactctataagcttttaaaagtgaaaatctagttaactaaagagagatctacgtaaacaacatctatattttctgtttttttgtgtgatctgaaataatttaatcaattataatcatagtacctactggtaatacatatccagtggatttaaaagaagctgccttccattaaataatcagtgtattgttttctatgcttgttttattttgaaaatgactggtggtgtaattttttaaaactttttaggcttcacatttgaatattttttggctaaatgcagttaaatactgcatgatgtttataatacatcaaaatgtgaacccttattgagagtcaggcagctgaaacattagccttagcatttcctttgactagcacacagcatgttacatattcattgttcctctctgggctctgagatattggaacagcttttatattgcatctgctcttgctattgagaccagtgttgagtggagaaacccacgaattattagaacctaagaacagtttatatattcaccaaagtcttgaccagtttctctttgtggatcttttagtgtgaaaaggggctccaaatgtgtgctgagatgaaggtaccatcagttagtatagattttttatcttcaccaaattggtgggtttcattgctttagcaagaatgcaaactctttatttatataatctttgtactatcttcttacaatttttcccctaggtttatatttaagtgaaccttccactgtcttctcaactatctctgcttgcttcttgaaatcagagaaatatttgatgttacatttttaaataagaatccaaacttaactaatgtgcatcttgggttttctaagaaattggactattaatcttcctaaacagactaattcattatacgttttatacaggttggattttatggtatttaactgaaggttgctgtaaaatttatagagcaatgggaagttacagtgtgtcttgtgatattcagagtcatttgcagatttggattgagtttagaatctaaagatatttagcatttcatcaaagcactgaaagcaatgcaccagggtctaaaataactttagttctaatagttgaagcagtggtttacgtttattttagaaagcatatgttctatccctaccttttcaattccagttcgtcttgagtgagacggctatccttccacctctcattcccttcaaccactggcatctatttatgtcatggagacctgtaaaagccatgagggacttctcaggtgctctgcccatcccttggatactttctcaagcctcagagaggatttttttgcagcattgacatcgatcactccattctcctcgaaattctgtcctcttttggctttgaagtgaccttgagctctttcactttcgggtctattctggcactgctgaccattcatttttcatcacctctctgatttcctcttctgcttacttccccaatgttcctgttctcgcctgttggggaacactgcttagttttcttcattttgcatgcttttccacactgttgttttaattaccaggcatttggactacttccagatctaaagatccaacctggacttcttgttctctagttagtggcaatagtaagagataagcactcgtttaattattcagccaatcctgtagcattctcttgagttaaggttctttatcatcttcattctcctgttgaggaatctgaagcagaggtgttaaggaaagtgcctaaggtcacccagctagtaagtgtggaaataggacccaagccaggcagtcttgccccagaaatagtgggcaaataatcttcacctctgtggtgctctgcctttccacctccctttcctgtgacatccagttagtccctaaactctgtgacttctgcctcttcagtgtctccagactctgacccctgcttttcgtctccattgctcttgtctcgtactattgtgaaaacctccaaatggcctttccatttccagctgtgccacttctaagtgtctgccatttcatcaacagagttagttttctaatatgtgagtcccaccatgtttgctttaaaatgctttgtggtgcttcagtctcaaaaggcacaggccactatcctttgcctgacacatactgactttttctgtctgattcctcccgacttgctcatccttatctccagtcacttcctgcttcacactctactcaggcattctgagccacgggtgtcctcagacacatgccgttttgtgcttcttaggaatttgcctgtgttcagcttggatttttatttttttccttttgtgcagtggataatttcagtcttactcatttttaacactcagctgaaatattacctcatctctgaaaccttcccttatttacttctaccattcattcagcaaatatttattgtgttatgctccagaaatgtaggaggtaagcaagactgacctggtcccagccctcagaaaacagcagggaagacatgtaattaaacacagtataataataaagggttttcttctatagaggcaagaagggggtcttggaaggcctcctgaagcaaatgatattcaagcttaaacctgaatgatgactagaactagccagtcaagaagtgggtgtcagagggcagagaaggaattttaggttgtgagaagagaatggtgattatgggccagggattaacaagggcatgtttgaacatctgaaagatgtttattagacagcagcagttggggagggtgggcagcgagggtgtgtgtgtagaagctgggtaaatcttggccatcagggagatacatatcaaaacttctagaagatactgtttccaacccttttagaatggctaaaataaaaaagatgacaacgtcaaaagttggcaagaatgtgtagcaacagaaactcatatgttgcgggtgggaatgcaaaatgggggcgactttctgaaaagcctccaaagagttttccaaacttaaaatatataccatgtgatctgggggctccactcctagcaatttacccaagagaaatgaaaaaatgttcacaaaaagacttgtacagacattttcatacaggctttttcctagtaacttcaaactgcaagcagtttaaatgtccttcagcaggtgatggattaaaaaattgttgtatattcatacaacagaatacctagcagtaaaaaaatgataaattactgaaatacacagtaatatggatgagtctcacaaatgttcagcagaagaagagagacagaagagtaaatattgtttgatttccattttatgaattctgagaggagactcaactgatctattgtgatagaaatggaatgtcagagtgttttttgggggcagggtgagtgggcgagcatggattggaacggggcatgagggaactctctgaattggtggaagtagtctatattattttggatagtgattacagttgtcacaattcatgagactgaaaatatgtgtattgtatattgttatatctcaattaaaatattttagaaaatgtaatacaatataaacatacaatacaataaatacaataatataatacaatacagtaaacataatgatatatgtctctcttgatatggaaagatgctcatggtataatgttaagtaaattaacttggttaaaaactctggctcccataaccctttgtgcatatatatcaaggtagtgagtttttaaattttattctttaacgtctttcacatttttcaacttattttgaatgagtattttatgaataaagtattgtttactatacagtgaaagatttaaagtacatcccctgcttattaaaactttgcagaaattattgaaccatatgagaaatttatttttatttctattaaattaaattaattaattaattttagagacagggtctttgtcactcaggctggagtgcagtggtactatcatagctcactgcaacctcaaactccgggctcaagtgatactctacctcagactcctgagtagctaggatctacaggtgcaggccaccatgcctagccaatttttataattttgtagagataggttttactatatttcacaggctggtcctcaaacccctggcctgaggtgatcctcctgcattggtctcccaaagcacagggattataggtgtgagccactgcacttggtcccaagacatttttaaataaattttcatgactatttttaagctacagttctgttacttttttttgtttgttttgttttgagacagatctttactctgttgcctaggctgagtgcagtattgcagtcttggctcactgccacctctgcctcccaggttcaagcagttctcgtgcctcagcctcccgagtagctgggattacaggcatgtgccgccacacccagctaatttttgtattttttgtggagatggggtttcgccatgttggccaggctggtcttgaactcctgacctcaagtgatctggcagccttggcttcccaaagtgctgagattacagatgtgaaccaccgcgtctggcctcagttttgttagttttcagtgcttaggagacacaggttatagcatttatagttcagaaaaaaatttagtttaatttactttttaatatatgccccaatatatacaaaggatacacaatgaaaagtaaggtactcagccactcctgtctccttgtcattttgctcttttcacaggaggtaactactatgaccaggctcttatttattttatggatgtatgggaaaacatatgcacatgtacataaaggcataggcatatatattatacaatgatagcatgccatgcacattgtgctggttttttttttttttttttgagtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacctgttgaacagtaattcccgttcctcttgctcctggcaaccactgttctgttttctgtctctacaagtttgactactctattaggtgccttatgtacgtagaatcatataatttttgtccttttctgtctgccttacttcattcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatccattcatcctttgatggacatttgggtggtttctacgttttggccactgtgaataatgctgctgtgaatatgagtgtgcagatatctgtccaggtcccttctttccatctccagaaatggaactgctggatcacataataattctatgtttaatttttttttaatcactgtcatttaggtgtatttttttggcagagtaaaacatttaaatattttacatagacataaatatgagcatgataagcattgacatgaaaatggcagtaattctgtatgtgtgcttcttgtatttttgttatatttttatgtcatgcttttttgcaaaatacattataaacatttatgaatttcactagttttctgtgatatcgtttttaatggctgaataatgttctgtcactgtatggatgagttaacttgactaatctcttacttttggagatctaggtaattttttaacttttatctttgaaaacatctgtttgtatccatgatctctatttataatctaattttatacaaaggtaacaaagagctggggggagagggtgggtacagcagtttcatttgactgacaatataatcaacatttagctgtatgattttgtcctctttgttgcctaaaacattattctctagggctttccccaaattgttttagaacaagcaagttgacatgctttttctatagggtatactgcctgggaataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtgctttttaaacatgtatcttggagaatcttttagtaaagtctgttatgtgaatgggacttgttatttaactactcccgattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttttatgagccagttatttctgaaatatctgcattgtatcttttgccttttttttttttttgcattatcagtacccatttcttacaattttatgctaataggaacaatcagtgttaaatgatgaacaaaactgatgtgattcctgcgctcatggtacttacagcctgttggaatagaaagatagtagacatacaaatatgcaattaaattttgttgtaaatgttatggaagaaaagttagattttctgtaagataacagttcaggctggatttgggtggaatgtggtggccagtaacagcccctaatgaacctgtaagaaccaatgaggcaaatatttgaagggaaaacattccaggcagatagacagcatggacagctagctgaaagaagggcatgtggctggattgcaatgaggaagaaatgatgagagatgactgatttgccctctgttcctcatacactaatctgtatagatatgtgtcaacaatgttcaaaagtatacagtgagtttctcctatcattatataaggggctttaaaacaaatctttttccctgcctactagatattctccaggaaaggaatatgaatcagacaatctgattagcagaatgtctttaggatataagttgattcattgggagcttctgtgtttttgaatttttcatttaaaatttttttaaaatttaagaatgaaatactgtatgtcatcttgtattatttcctgtttctccagatgtgtcattagaaattcagctggttttctcatgtgaaattaatttgtgattctttgaagcttgctaaatgatgcattgtttgctactaagttgtctgtaacaatttccccattagggagaaaagctctttgagtgtgtccttctgtgtgtgaccaaattccaaatgtctgatgattctacataggggaaaaagtgacactcagagaaaatgatttgcagcttgttgtgctttgcagtaaattctgcattttaggtaaaatgcggaatgacagatatgctcagcttagttttgatcagtaattttcttaagctttctgtatcaaatttctcatcattgaaatagaaacatggtggtattttaatgtcttttaccattagttacaagtcaactcagtgtaaaaagtgaaagacaagtattgttaattttgaaaattagttcctggtttcttagtttctggatttgttagataaacatatacctttgtttcccttacttacccaatatcctttcactttggcctttaggtttcatgtttattaggaaatatcatgaagtgtacatgtaaaatagacagagaatgtcttggtagaaattaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctaagtaaatttttttatagatacgggtatttctcattacttttaaaaaattgttagtcttgaatgtacagctacaatccatcttcatcttatttttatcatcactaacaacagtggctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttttggggactatttcttgtttttctttcactcatcagatgcttccttaagtgcttatcatgtatgttctagaattcagggcaaatttgtgtccttctgatgtttttgggttttgttgttgttaatggcaagtgtttttgctcaacacagtaaatattttatatcagaccaaatcttcctgcttgtaagaatcttctggtttattatctgtttttctattcttgtggatggattagagggtaataccctaggaaaaacaggcagttcaatgaaataggagtactcactaacctgattattctaccaggtatcatactattacaatatggtccatattaaaataatgttgtctcttttcttccatgggatgttttgttctatcttataaaagaaactatgctaagaggaactaaaagctatgtgctttctggcctactattatgatgtcatttatatatgatatgatatatttgcctatttttgacctagtcatgcaatttttctgaaaaacctgtatgagcatagtattttgaaatatgaatcccttggcttccatgacataatatcttggcattttcttatgagctggttttaagtcactctgattgagtcttaaaaagaaaaaatataactcattctttctccactaaatcaatggctgttttattgtatttttatatttttaattgatgcaaatatttgtacatatttatggggtataggtgatattttgttacatgcatggaatgtgtaatgatcaagtcagggttggggcgtccatcaccttgagtatcatttctaagtgttgggaacatttccagtcctcttttagctgttttgaaacatacagtacattgttgttaactatagtcaccctactctgctgtcgaacattagaacttactccttttatctaactgcatgtttgtacccattaaacaacttctcttaacccctcttcccaatcgctaccctaagtcaaatactcttcccagcctctggtgtctgtccttctactctccacttctgtgagatcaactttttttttttttagctcccaaatatgagtgagaacataggatatttgtctttctgtgcctggcttattttgcttaatagaatgacctccagtttcattcatgttgctacaaatgatatgatttcataggtttttatgactaaatagtattccattgtttatatatataccacattttctttttccattcatctaaatcaacacttaggttgattccgatctttggtgttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttcaacttcctattctgactcactgatgtgtttatttctaagtcacagttatggtagctttttaatggcttacaccaactggaaggacagattgctctttattactcttctctagactgtttcaggctaaattcagatttattatttttgtcatttaacatttcttatctccatttctcttatattttccttcagcttgatctttgactctccttttgcttgttttttgttaacttctcatcattccctattttctcttttgttaatagttctttgaaacttaactttttaattggccccttttcttaaacttactcttctttttcacttaactccttttggatgtcacactgtcatcaaaaagccctgtccaaatttgtatgcattactacaaagtgacttcctttctcaacgcaattgcactgtttgtgtattaatactaccattccgttagacacctggaattaaaactgtaagtcatatttgcattaatcttttcatctatcttcagtcattttctaattaccattgatactttttcatgtgatgtctcccgtcttcctcctcctccatatttcataattactactaccatgttctagatcatatcatctcatacctagataattgaaacttcattctgactgacctttctctttctattttattttgcaaatatctgtgagcttcttctaatataaaaactgtaggtaaatactaatattaaactgatggccttattcattaattcctcatttatgtaataaatatttgaatgaccattatctgccaagcaagcttctgagtgccggacgtgccaacgtgaacaaaacacattctagtccatgctctcttggagcttacattctaatggtgggtagaggtcgggagggaaagagtggagatctgacaatgaacaaggtaattttggtttctgataaagactgtgatggatagatagaatggggggtacagtgggagtgttagtttagcttgggtgcacatgaagacatctctgagctgagctatgagggcagttgagaccagccagactgggaaagatagggtagaagaaaatagataaatgctggaaaacattttaataagtgggaagtttttcatgcctcctcaaaattaatagacagaatagtctttaacctttaagtacagataagaattcagtctttgatgaaagtagcatcccaggcatcatggaggagaaatggattattaacaaatggagctgggaaaattagttactgtatatactgtaattcttggctggttgactttcttgaagaccattgatgcctgtgggacaggaattatgttgtaaattaaaactaatatagatgaaaaaagttctatcattggagtaaattttttccacttaatttttagttttcttaatctgcagtttttttctctattcaacatcagcgaagagtttatttttgatttatatctgaacttatgtctgaaattttccaaaagatctatttattgatatattgaaataatgaagtcaagtttccgtatttgataattagataataaatctcatactgtcctgacatctcaggctgcgaagcataacgcataaggggcaggtttggtccatagcctctagactgtggctaaatcaggcaatcaccagaaagataagaaaaagaactaattgtatgcataggtctattgacagtaaaggtgggaccggtagccttgaatttagttgtgttcttaaagaagggcgttttttagaaatttccagcttcttcattgtagattcttgatttgggcctttgagaatctgaagtttgattggatattgtgtttctttagacattctaatgagtcatcatattctccatgtgaaattatattagttggtgatccccatggcaacataaatttatttctttaatttttgcagggaatttattatttgattgttttttagaaattacgtccattatccactctgttactggttatatgatcatgcatatgtttgaattacatgttgtgttaatgttgtggcttctatcatatgctttgtaggaaaatagttattcatcctctgtgcctctggtctgcttcaactaaatttggcttgagagttggctgttagctgtaggcatccagtgatgtatgtcctttttaaagctgctttgcttctttctgaaattttaccccattttccaaaccatcttgttgcaggctggcaagtctgtggcacttaagatagatacttgctcaatttttttttcttttttctttttctttttttttttgacacaatgtctcactctgtctcccaggctggagtgcagtggcgtaatcatagctcactgcagcctcaaactcacaggctcaagcaatcctcccacctcagccttccaagtagctgggactacaggcatgcaccaccacacctggctaactttttaattttattttgtaaatatgggatctccttatgttgcccaggctggtctagaattccttacctcaagcaatcctcctgtcttggcttcccagagtgcatgaactacagggctgagccactgtgccagaccttgcttaaattcttgacttttatgcttccttgggcactatttcaaatttttaatagttaatgattttttttttcttctcaggggaaagtatcttctcaaaacaattttattaggattagggatcttgttacctggtatggtattatggcaaaggaatacccaatagacaagtaatgaagctgttagagcctttcactcaataatgaaaaataaactgtatagcctatatttcaactgaatctggggcaaagtactttatgatgttatctgtattcccagagtcatgtggtatttactagctttacccttgttattttttagggtagtttgcatgatcaacttatcagtgtcagaaggactaaagtaaatattgattttttgataaaagtatattgaaataaataatgtgcttaaagtgacagccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacgtctctaccaaaaatacaaaattagccaggcatggtggcgcatgcctgtaatcccggttactcgggaggctgaggcaggagaatcgcttgaacctgggaggcggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggcaggggttacctgagacaccgggtgctatcatgaggtcttgaagttgaaattcattcactggtttaaacacattttttgacaactagtatacatactggttatatttaaaggctgttcttaatgtttatgcttgtttagtttttcatttgaacttttcttaacatttattaatgtagactcttgttattttctctctagtttaatagaaaatggtcagcttgaaattgtgacaggtggctgggttatgcctgatgaagctactccacattattttgccttaattgatcaactaattgaaggacatcagtggctggaaaataatataggtatgtattggtatattctttatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatacggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaaatggtcttgggggaaagggaattgtggagagcagggtcagctgcacctaaaggcatgagaatgggtcctccatatgagtggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgttttttattgaagttatttttagatatttccttattttaaaaaattgtcccttagagataaaattcttaatccctattttttctttactttttattttgagataattgcaaatttgaagaaatgtataagaatactgcaaaatattctcataaacccttcacccagatttaccagttgttaacattttgacacatttacttaattttttctgtttccgtgttgttgtagtggtgctggtatttcttattatcagaaccatttggaagcatgttgcaggtatcatgcccgtgtagaaaatagttagcatagcaggtctgctatctttagaaaggccttgcttgcaagattggcccttggttagtgtctgggaacatggatatcctaacgataagagtggctcactgtttttaatctgtttgtacaaacaaaatagtttgtgctaaacaattgctttccttctgggagtctgaattcttagtatgtgctgaacagagggtgcctacatgaccagcccccaacattggacactgagtctgtaatgagtttcctggtcaacagcacttcacacatactgtcacagtttcgtgctggagcatttaaacacatcctgtatgactccatggggagaggacgcttagaagcttgcacctggtttcctctggacttactctgtatgctttttccttttgcagatttttttttctcatttcactgtaataaattataggtgtgagtacgacaatatgttgagacctgtgatttttcttaacaaatcaccaaacctgaaggtggtcttggggaccctctctacacaatgccctttttcttaaatacttgatatgctaacccaagaatattcacttcataaacctccgttatgaatgttttttatgtttttattgaagtgtaatttacatgcagtggaatatataaatcttaaatgtagaggtcagtgagttttaacaatgtacatacccatttaatctatacatttattacccaaggtctctcatcccctcatctttccacttgcagccaactgctctttgatttctgtcattgtccatgagttttgtttgaagaagaatttattagtatatgaactcacataatattattttgggtcttgtgtcttttgcccagtgtaattttttcttacaactttattgagatatatttcacataaattcatagatttgtgcaaccatcaccacagtctatttttagaacttttttcaacatcccccaaagaaaccttatacccagtagtagtcactccccttcctagcttcacccttccctgccccagtctcaggctatcactagtctttctgtatatatggattggactattctggacatttcacatagatggaagcatgtaatgtatggcctttggtgattggattcttggcataatattttcaaggctcatcatgtattatagcatatatcagtgcttcattcctttttatagctgaataatattctgttgtatggatataccagatttgtttatcccttattcagttgatgggcacttaggttgtattttgcttttggctgctgtgaataatgctgttatacacatttgtttaaaagtttttgtgtgactctacctttcttcctaggagtagaattgctgagttatatggtaaaaatgtttagcattttgagaaactgtcaaacttttccaaaagagcggtatcgttctaccttcccaccagcaatgtgtgaggtttctattttctccgtatcttcaccaacatttgttactgtctctcttttttattgtagtcattctaatatgtgtgaaatggtaatctcattgtgattttgatttgcattttcctaaagactagtggtactaagaatcttttcatgtgtatatcagctgcgtatagatcttttaaggataaatgtctattctaattattttcctatttttcagtagagttatttatctttttattattgacttagaattttttttatatattgtggttaaaagttctttgttggatagtgatttacaaatttattttctcattctgtggttttttcactttcttgaaggtgtcttttagtgcacaagttttaattttgaggaagtttttcttctgttgcttgtgcttttgatgccatagtaagaaactgttgtttaatcctgaattataaagatgtactactgtctttaaactagttttatggttttagctcttacatttatgtcagtgattaaattaactaaatattatatttagttaatattatatagttaatatataatagttaatataactattaatataattgttatattaactaaaatattaatttttagttaatatttgtatatgatgtgaggtagagtttcatatttattttttttgcatgttgatacccagttattccaatgccacttattggaaaagatgattctttcctcactgaattgtcctggcacacttgttaacagttagttaaccataattatgagagtttattcctggactctcagttctgtttccttgacttatatttatgccagtaccgtactgtcttgattactatagcttgtataagcttgacattgggaagtctgagttctgcaacttccgttctttttttaaacttgttttttccatgtgaattttaggccagtttatcaatttctgcaaaaatatcagctagaattttgctagtggttgtattaaatctgtaggtcaatctgggggaatattgccgttttaacaatgtcacatcttctgatatagcaacatgggatggctttccatttaagtagatcatcgttaatttctttcaacagtgttttatagctttcagtgtaaaagtcctgtactttttttgttaaatatgttcctaggcattttgtttgttttactgccattataaatgggattgttttcttaatttcattttaggattattcattgctagtatgtagaaatacaattgatttttgttagtgatcttatatcctgtcaccagcatgaagtttttgggattcattcttgttgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaattagagttctgattgttccacatttttgccagtgtttgctgtgtgagtcttttttcttagaaccatgctagtgggtatatagtgatatttcactgttattttaacatgcatttctatgatgactaatgatgctgagtatgttttgttgtgcttattggccagtggtataccctattttcaagtttctaagtcttttacccattctttttatttgaattgttgctatatatatatatatatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgtgttcccctctctgtgtccatgtgttctcattgttcgactcccacttatgagtgagaacatgcggtgtttggttttctgttcctgtgttagtttgctgagaatgatggtttccagcttcattcatatccctgcaaagacatgaactcatcctttttatggctgcataatattccatggtgtatatgtgccatattttctttatccagtttatcattgatgggcatttgggttggttccaagtctttgctactgtgaatagtgctgcaataaacatacatgtgcatgtgtctttatggttgaatgatttataatcctttgggtatatacccagtaatgggattgctgtgtcaaatggtatttctggttctaggtacttgaggaatcaccacaccgtcttccacaatggttgatttatactcccaccaacaatgtaaaagcattcctatttctccacatcctgtcccgcatctgttgtttcctcactttttaatgatcgcttttctaactggggtgagatggtatctcattgtggttttgatttgtatttctctaatgaccagtgatgatgagctttttttcacgtttgttggctgcataaatgtcttcttttgagaagtgtctgttcatatctttcgcccactttttggtgatatcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattcgtttgtttttagtggtatctttttcatttctcttaatcatttaataccagtatataagaaaatttttcatatgcatgtgtatatgtgtggtctaaagttgtataaatcctatctttttattataaatattttatataatttcttattagttataaatatgtaataaaatcataaaatgaaaattatctttttaaatacttatagtatttagactatatgtctgtttagtattttattgcatagataacatctcttatagtaatgacatagggtagtggtctttcttgttccagatttttaatagaaattgtttagctgttctgtattaagtatcatattatatagtatttttatggtaggtgctatttatagtgtttagaaaattattttcttcttagtatttttcacttaacagtgaatacgtaatattactggttttcttatagccgtctatcaatactgtatggtttttctcatgtttccgtggatgtgacagcagtttgttcagttaaaaagtcattgacttcctggaataaatcccttttggttttggtactattgaatttaatttatttagtggttttatgattttatatccattttcatgagtaagattagttttcttttttaatgtactacatttgtattttttttattggtttgtgatacttaataaaatgaattaggtagtactgaattcttccttgtattacgtgacagcttatgtacattagaaataatttattgctcagatcctaggcttagaggggtcttttattggaggtagattttttgataatgttaaaaatttctccaaagttattaatatccaatttacatctaaaatgtaaattgtattatttttgttagaaacccagccttcttatcaacattttaattacttggagtataaagtaagaattgtatatagtattctttgttttaaacagtattttattaaataacatgcagtcagtgtgggaaaataggaaaaaataatatactagcagaaagtaaggagaaatccttctgtaccctttagagataacctgttttgtgatatataacattatagcattctggactttttcatatgtatatttaaacacagtataagtttttttccacaaggataggatagtattttaaaacaaatttattagagatagtaaagtgtttaaagctatcttctctacaacttttgtatctatcttctttatagttttctgtagggcatttttatttgactgttagtctgtgttatttattttttaaagagcaggttaaaattttttaagctaaaaggtattttgtgtttcttcatactaccttatctttattttcctctttctttgctccttttgtctgttttttgtttctttttctctcaaggagttggcaacaggtgcatgtgcacacatacatacattttggctcatttgttctttttctacaacgtgaaggtgagtggcagcgaggcctcttgtgagagagcatacccatccatctcactcatcctgtggagtcagcataggcaaactgctgaaatggagttggagctcatttctgcagtccaggcagaggacaatggcaatgtggcagggtcagtctgagaatgtatgttcctcctacctcaaggtgccttggagaagatcagtgctggccttcgatgtgctcaggggatgtacttatgactcttagcatgtgatatgaggtatctcactacttcactctttcctccatcccaaatagtgaacacacttaacaacacttacaacatcataaaactgttcagttttagaggtataattgtcaaaagcacaatgtgaacaaatgcagcttaaagattgaattggctttattaagcaattcatgaacagggcaacatcccatctaaaaaataatattctgatgagcaaagcagagaagactggctttataggcagcaaaaggctgcaaaagcagaaataggaaacaaaaagtaggttggttatttcaaagttacttcccttacagggttacaacagaggagacttcgttatcatgctggctcaagtagaccaggccccttctgattgtggatcagattgcttcaaatctcctggtttttgttgttgttttttaaactggtacatattcaagttcagtttgattatgtggcacctagcacaagtgactgtattctggtttgatgtggtcttttggggtgtactgcagctgctcagcctaatacagtggccttccataaattttatttaacatagacctctatgaatttaattagtaggcttttgagcatcagagtgagactcactacatgttccataaagctgagaaaagccaggttcagggagattttcccttggcccagttactttctttttaaatataaggaacatatctgaggatatgacatttctttgtattgtagctttggctgcatcttatgaattagtgtccttggttttgttttcttttttttttatttttaagttttttttaaaatttattttagtattattattatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcactctatctcccaggctggagcacactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattacaaatatatttcctgattcctcttaaactatagtattaaatatacttagaataatccagttttattaggtactattcgtattactaatgttctaatttttaaacctattaggtttgccaaaaattgactgatgttaattcttcttaatgttttccatactttgttcttgtattttgaacagtttttacttttatacttttacttttgataatcttgttcttgcatgaaggcatgaaatctttttgatgagctttccagttttattagcaaatgtgccctctttataaaattttggatttttcttatattgtactttttcctaagtttgccccttaccctccttttaaaaagtattgccaagaaaaaccctagcaggacactaggttcctttttaagtctatccctagttctccactcctttcatatcaaagttttaaaaaatatagtttacactttctcttttctacattatttagtctcagggactctttattccattgcagctaggttgctacccctctggatccaacggttttgatgtggaaaagattaccagtgatgttataattgttaaattgaatggacactataaactctttgacatcactgcagtgtttgatactgatttttatctttttttgtaagcttattctgtccttgttatttggacaatacatactccttttttaattttataacttaattttgatataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatataataaagttatcaaatcaggaatgttaacagtgatacagtaggacagtgtagtccacaggctgtattcagattttgtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatgtgatgtcccattgtcctcactgcatcatatcaggaggcatgtgatgtctctgtcctagtactggtaatactgggaacaactagttaaggtttgtctgctaagtttctccactgtgttaaatttttgccctttctaattaatatgtgggagatacattgggaataaatattctatacctcagccatctctcatgtttatgttttagtgtccattgatgattttctaattccttctataattgctagttggcattctactaaagagaagagctttccttcttattttctgtttatttatttatatcagtatgggctcatggttaatattcactgggttataatgcattatttattttcacacctcagttgtcccagatttggccattagaagcctctttggtcttttcctgagttattttaatatgcccccatgatttcttgactgtctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcctcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagatcctgacttttccttattgtcctttactggctccccatgtctatgttcttctttagtgttgtttacaaagttctagttctctttgttgtcttgtgtgttactttgtgttacacttatttgaatgacagcctctgcaaactagagtcaagatctaatttaactcgtttttgtaactgtggggtctttcatcatcttaggtaaggtgcttaaaaggtgtttgaatgaaaaaaaatacacacagcaatattacttatgtcagtttataagttgtaagtagacactttatttgagaatcccaaataattaaaacatcagatttttataatgctagatgaacaatcttattctaaccagtacatttattatctttttcatttttatttttttacattttatcctctgtgaaattgagatatatctttagtcagtagttcacattattggtgtgagccagctatgagaaatcactggcacctttgtaggtagagtgaaagcaccagcatcataatgacttaagatttaatgaaatatggtatagttattttggcctgttctgccactgtatcataagatgatttggggcttttgtaatgtgtaaaagacagactaaaaaagtccttaatgttggtgttgggaaatgtaagttgaaataggtacgttacttttctttatcatgtaatagttccagagttatccagctccacagatcacaggactgtgatatccttccaggaagggccctggtcctgtttattctctacctctagttaatggcagtggctttataataggtaaaagatgttaatggctaaaagatggcagtatttatttgaactctaactgattaatttcagtgagcatcctctgcctatgtggataggcagtggcacaatcctcccttcatgatatcttgctgggaatacttggcagaggataatgctgggtagatccttggtctgatatctctaggagactatacaatgacaatgagtctgaatgtgttgtgacttctttttatttcatatatcaattaaaaaaattaacacttatcatctttatccacaggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagaggagaaaagatctaggcctcttgggaggcctttgcctttctcaacccctatttaattcagaccaccttattttctatttatttatcgagcctttattatgggccatgtattatgttacctctgctttatattcattctcatttaatctttttaatattattctttttttatggtgaagcaatggaggcttagatatgagaagccatttgccaaaagtcatataggtcatgcatagagagcagagatttgaatgtagttctgtgtagttcctgaagcccaggctcctaacctctgtcattgtgttctcagtaaactttcatctgaaagaaatattttgtttataaaacagtgtttgagaaattactgcattacattatacttgttttcttgtgtaatctagaccccttaagtgtttcagaaaaatcatttgtaaatttagaccgtaactttcttatatgtactcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaacagattttataaatgcaggtttgtgtgttggctctttattttagatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcaggtatgaaaatgcgtatttcataagacaacatcttgaataaagtagccacttagctgctagttgctgaagggttgaacaaatgggctttattagccaacattatccttgtttgaagtattcattcaaaccagatctaaagcaacttaaaaatgccagagccttgactatgccggttatgtgttacattttaatggaaagtgaacaatactagatcaatatacaatggataacctataatacactattattaccatctcctttgccctcattataaaagccttctactgtgtttgattgatttcatatacttttgttgaataaaacttctggtccctattgtacaaattggtaagaaaagcaattcaactgcaaaaacacatttattgaaatggagcacataaagagtgtaattatctgttcccttaataacaatttcaataatagtgaatgcttcccagctctggtgtatacacatctttgcatcattctgatgtttttgacttacagtaaactttaattaggaatatttatacttaaatacatttaaataaaaatcaaaggtatgaatcatttctttagaagaaaattgtgctaatgatggaagcatctcattaaaccaacttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtgaaatgagatctttttaccttcaatgagtccttagaatcacaaagattttctttgtgagcctctcactgtggcagacatgaaggtgttttagcatggcagccttcttaaagtcatggagcccttctatcaaaatgtgactttaatagttatttagaaaaactgcccaaggttagggattgacttgatttcattttcttggttcctacagccatgagaaccactgaggaattctgaacaacctgctttctagctagggttgggttaagtaggcataagagaataagccagtatattgtgtggtggaaggtgtaataaaaaggaagggttgagtgtgggggcaccctggcctgtgtaggtgggcaaatagctgtttatatttacaggtatttacactactctctgctcaggtgaccagggatggggaagttcttaaaagtgaacaagatgtttcagctggggagtcccagtgcattcatagtattgtgagccctttgttctttttttggggggtgctactgagactacctgaggcacattattgaggaaaaaaaggcttttttataatccttttgctatgtcatctaacctttcaacaattgcccctcaggatgataccttgtgctcatttagttccagtggttttgaaagtgatttccaggcacctgggggcatactgttgaatgagtctatataatacttagagattttttctttttaaacttcttggccgggcgcagtggcccatgcctgtaatcctagcactttgggaggccgaggcaggcggattttctgagctcaggagtttgagaccagcctgggcaacatggtaaaaccccatttctatggcggcgtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgatcctcctgcctcgccctcccaaagtgctgggattacaggtatgagccaccatgcctagccctgttcaatttgttaacgtcccaaagaaaatgaaatttaaccataatgtacagatggcatcttttgatatgtccagctcagcaggttcttctactttgcaagtaaagaaatatcattctttgtcaagttcatttttggtcaagtactatatattttaagttggctttttctattgaccgtcacgtgatttgatgtttcggggattttatttttcttggttacagttaagttgacatttcttacctggtaaaataaatcaggagcaaattgcatctgtatgttttcaaatgtgatgttgggtcaattgatttgttattggttccatatatttaccatattaccatttaccaattaccattggaccatatatttagtgagtgtcttcttcctgccaggcgttacaggctggttacttggctttcccagtgttgacactttctggacaggcttgagagttaggatagatgtgaagtgttaaaggcatgccattaacgtttgtgatttcttttctttatatgtgctttacacatatgtatacaagatactctatatctaatagtaaacccttttttatgctggctgcctaggaaatctagttggagctcaattatatcttatatctatgatttatatatttgattatttttactcatttttttttggtagccttctttctatgtggtcaatctcattcttcatgtgttttttatcgtaagtaacctaaaagtgttttggcaaatgtggaatgttagtaaattactagtaaagataaagtaatgtgctaatgtcagaaaactaagcattatatgttacataaggacgctgtggttatattttactcaccaaggtattatgttactgctaaaattttatatttgcaaagcaatttcagagattacaaatgtaaaaaggaccatatgagatttaaatttagttaaatgtttataatttttataagatgcttcattctgtcattggtgttctttgagatactttcgtaagtttttatattgtgaattagaatttacttttggatgatccttgaagtgaaaattataaaaatacttgtcgtttaatcactgatttcttaagctttgtctttgtaaatattgtgaactgctttgggttcatccacttgtataatttcattttcacaagccctttgtcttagtttgtattctcagactttcttaaatgatgccctaattcagtgatttccaaaggacattctgcagaatactataatagaatatgaaatacaaaagctattccatcaagctattggttagagtccagagaagtagaaaccaaaataactaattcaactcctaatccttatctgatggtcagtattgaaaaggacactgtgacaaatactcagattattggtggcaggtgacaagtgtgtggatttttttttctttagaagaggaaatatgactctataaaatgttacagattaacatttattcccttttggttttgttcaaagtacacttttttctatgtttaatcagataattttagattagagaaaggaatattaagacaaagcaaacttcaaagtctgtatatgtgggaagtccttattgtcttactagataaatcattttaacacctgggctatctggtattcaatctctgtggctgggctttaggaagtccttggtaccccacttattatatgccaagttggtacatgaccatatttctccaaagataatccattggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaaggtaaggagaaaatatttatgattccgtatttgaaattgaacctttattattaaatgagactataaacagaaatccttagcttctttgtcctacatcacagtgcttcttagaatatataattcttgtgtaaaatataatccattaggaagaaaattattatatgctatagttccatatctaaagttgtcccgttcctaacactccttgaggattaaagaggaatttacttttatgtgattgaaaatatgtacctaccaagttgtgatatttagtcttcagggacttactgtttttgttgtgcttgttttgttttgttttgtttttttaccaacattgaaagtctgttatttctctctgacagctgcatccttgtgatttagtagcatgactggcagatgcagatgaacatgtcatgaattttgcaaacaaatgtcctatgtccagagaatacactaacatttttttttaagtgagaagacttctaaaattaatcgtttgcctatggttcttactctttttttttttcttatggaaaatttaaaatgtactgtaaagttctgaaaatagcaaaaattgttccccttctccccatatccatggctcagctgcagcattcttcaactcaagaccactcttgtttcagccatgccacactgctgtctcactcctccccataggattatattgaagccaatctcaggtttcatatagtttcacctgtaaatatttcagtatgtatctctaaattataaaagttctgtttaaaaatataacgataataccattatcacacctaaaaaactaacaataatttcatgatacatatctggacagattcaaattttcctcatctcataaaaaacaattcttttaacacatgctttgtttgagtcaaaattcaagcaataatcatatattgcatttgatcaagtttttaattacaaaattgattttttattgatacataattatatatatttatgggacacctatgaattttgatacatgcggagaatgtataatgatcaaatcagggtatttaggatatctaccacttcaaacttttatcatttgtttgtgttgggacaacaggcttttaaagtcttttttttttttttctttttaaatgtgtcttagagactctacataagaagattaattattcagcatgtttattatttcacatattgacatgtaaaagtagaacatctgtgaaaatactatagaaaggaagtgatattactgtttaggaaatttgaaagctgatggtgaactatagtttagtaagaattcaagtttattaaataaacctaagtaatatcaaatagataaataaacctaataaaatatcaagtttattcaggattgttacagctgaatttttatcagattatgaactcggatcctaggggtatgtttaaattatccgtgtattttcctgagagatgatgctcatacatgaatatgtgatcagaggaagggatatatatatgagtatcttatctgtaattacatcttactaggaagtgattttggttcatagaagcatctggtctcctgtctgactgaaaaaattagaccctgattttagtattctacctatttcatcctttgcctactagaacagttttttaaaagtcatttaaaaaattgaagtgccacatacatagaagaagtggacaaaccataagtgtgcatagaattttgcaagtttaaaagtctccatgtaaccatcatccagattaaggcttagaacttttattgtccctcagatctctttccagtcatcaccaactgccgcaaaagcaaccactactttcacatctgtcaccatgattactgttgcctgttcttgaattttatacgatggggaccatacacatgtactttgtgtctggctttttcttttcacattatgtttgcgagagtcatccattctgttgcaggtagcagtagttcattcctttttagtactgtgtagtatctctagtattcattttttgatgaatataccacagtttattcattgtattgttattgggtatttgggattgttcccagtttttgtctatcacaaataagtctgctttgaatattttgtccatgttttggttacttgttatgagtttacatgggtataaaatgggatgtaattttttggccattgagtatgcacatgttcagctttagtatatattgccaaactgttccaaaatagatgcatcaattgtgttgtacaagaggttcagttgttccacaccctttctcagtttgtattgtcaggatttttgttttccatttttatccttttgatagatgggatggttttattttttatttctcctgtggttaatgaggttgagtctcttttcatatgtttattgccatttgagtatcctcttttgtgaagtacctatttaagtcttttgatgattttttaattaaattggggttgtctttttcttactgtttatagctctttggtacattttgaattctatcttttttcatataaaagttatgcaaatgttgtctcctactatgtagcctgcattttcactttctcatgctgtcttttgatgaacagaaatttttaattttaattaatcaaatataactatttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtctacactctctattcacttttattggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacgtggtgtattttgtgtattaatgcaattgatttttgcattttagccttgtatccagtaactttgttaaatttatttattatttttagttatttgtggattctttatggatttcctatatatgagtaatggcatatatatgtcttcctttccaaagctttaaatctttccatctactttcttaccatgtacaatggctgtgtcctctagtataatgttgagtaggcgtggtgaaagcagacataattttctaagagagaaaacattcgttagtcataatgtttgctgtagaattttgtagattccctttatcagattatggaattttccttatattcctcatttacagagtgttttttcatgaccagatactaaattttattattttcttcttctaggacattgctttgtgttaggcctttatgtcttgtgcaatgattgaaccagtaccccaagatgaaaatttggtagagtatagggtccaccttaatgcattttctttctctccaacatttttatcccttaagttctggctgctttagttctttaatgtcttcaaagctttttctttctacagtttatctagttatatctgtttcttgtgggatacttaaagttactttgtctgaactggaagcataaatttaatattttcttttaatgaactggagaacaaaagtaaataactgagttcagatggctgaaaaattgacgtggaatagccaagacagtcattttgccatttgatcatcatttaacaatttttgtaatttttcttatgtgttgtcctgatagaattcttacatttaagattaaagttgttgccttttaatgtaaaaaccatgtgaatatttttatttggttattcttaaaggtgtcctaaatatttactttttatgagctaccaagagactttctagagaaatttactttaaataattactttaaaaaatactctagcacaggtactgagttatttttctacccttaaagattgaattaagtttttgagaaagcctactaggctacttatctaaactgctctgggacattgccaagaaggaagtatttttatcttggctcataccaaaaactaattgaaatattttcaaagggtatactttattgttaatactaattctgtagcatgctatagatttctaaactttgaagttcaaaatggtttttattgtctaaataaaatcctttgttttatgtttgaggaaagtgagactcagaaatatttagatcgtagactattttgtcactcttattatttatactttcctgagctcatctgtatctgctggatatgaagttaatgccatatttccttctattcgtgactcatttcttttatggttacacacacacacgcgtgcacacacacacacacacaaacacacacagtcttcttcctagtaatgcttgtgagtaataatactcttagtgttagctaaaacatattgagtgcgtattatttgctgtaaattgcttaaagtactttatttaacttatttagttatctgaacattttctggtaggtcctatgattgttcccattgtagatgaggaaattgaggcacaaatagattaacttgcccaagatcactctctgtttggtgaagccaagatacattggctacaccaaattgaatacagttgaaaattgcttatctttaatataaacataaggatttagaaataatcatctattttgctgtaaaaatatattgcaccacaactagattacagtcacttatatttgccttatcagtatcattgttgtaaatgttccagtcgcaattttgtctttgcagtgaataagtgatagctaaatttataccattattggccagtcatggttgtaagtttttttttgtttgtttttgagatggagtctcgctctgtcacccaggctggaatgcagtggcgtgatctctgctcactgcaaggtcggcctcctgggttcacgccattctcctgcctcagcctcccgagtagctgggactacaggtgcctgccaccacacccagctaatttttttttgtatttttagtagagacggggtttactgtgttagccaggatggtctccatctcctgacctcatgatccacccgcctcagcttcccaaagtgctaggattacaggcgtgagccaccacacccggccagttgtaagcttttttcttagagccctattcactgtaacgtggatagacagagaagttatgtaatatgctcaaaacacatgtcagataagtggtagagatggaattcaaagctatgctattgctaccttgaatcaaaatgacttgcaatatctgtgtgtgtgtgtgtgtgtgtgtgtgtgtgtgtgtgtgtatgtgtgtaggaaacaacaaaatccgcatctttcttttaaaaggaacacattccctgttaaataatctgtttatttttgacaggactgccttttaatatctgtttacaagatttggtatcgtgtttctttttgtctttgatttgtagaatagtttgaactcataaaaacgaatttcttactgctgatttaaatcattagtcagaaagaccggtgtgtttaagcagccagacttgccattcttagcactccttggatttaacttctactcagtgttacctactggtagagtaagttcatttttttaaaatgacctgctgttcttaaagtcccttctccttcacaagaactcaactgggggaaaacggagatagaggagggtatgatatatgaaataccttatggctaacagaattattcttctagactttatggctaataaaactgttattgtagacttctggaacactttaatatgtcttttatttttgctgctgccctcatctttcatttatgtggattaatccatgcccaaatcattgtacactttgaaattctagagatatgtaggagttttcatattcactgatttgtagatctaaatagctctccttttaactgctgaagtgtataagttttcccttagtttaatttgggccttaatgtaagtaaaaaaaaagtcactattattttcttccctgcttctgatttttataaaatctgagctatgtattcatcttaacttggaaacacatgttaaatatttattattaactttccctaacagtgtaagaagtaaataattttaagatagaatgaataattgaagtgcatttttttaaaactagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaaggtacttttacctttctatagctacatgtattttttcactttatattatcataatctttttgtagagttttacgtaatatacatcattcatgtagtacattatgtagtgttaagctctaattaagcacttagtgtaattgtgaaattttaatgcaatcagaaatacgtctccaaactacaatcaaattattacatgggtttttgttctggaagaaaaaatagtttatttaaattagatttttaaggagttgtattctacattttgtatttttctaattaatttacctgtgttatttgcacaccatattaatattcagtgacaccatcatgagtgtctgcaggctggtaatctgataggcttctcattggaaacataggtgagcatcaaagaaggaaatagggcctcccagcagccaaacgtgagcttcaaagttcacagtccaaaactaatgtattttgtatgtgggagaactttagactaggcttcatctcagttcttacatacttatttgaagcacatttctataggcacagtcatctgcatagaagaacaacatttgaaaaaatgatgactgatgggtcagatagtgattgaaaatgtaaatggatacagagaagacagaaaagtctgtagaagacataaaaacactaaactgacactatccaggagaactttcaatcactgatagaatgttctatagtgataggttctatttctgcactgtccaaaatatagtcattaggtacatgtgactattgagcacttgaaatgtgcccatttaattttaattaatttaaatgtcaatagccatgtgtggctatggctaccatattggagagcatggtcctaagtaactaacggaggctggttgttgataaagttaaaactactccagaggctcccaaagttttctctatgtatagaccagtaaagtaattcattttcatgatgaatcttgatgtttgagttagattgtacttaccgtcttttatatactagtggacattggttacattttggaaaggctttttattaaaaattatgaatttaagagttgtatttttatatggtagttttttattgttaatattgtgctgctattaaatactatttcaaaagcctaaccttttactgttactcgtaatatgccagaaaaatgtctcattttaaaaaattattttcattattatagatacatattagttgtacatatttatggagtacatgtgatattttgatataagcatacagtatataatcaaatcgtaatttgtatattcatcatttatgtgtttcaaaataactaaaagtagaattggaatgtttcttacaaagaaataactgcttgaggtaatggaatatatcttattaaatttaaaataatgtttacatattatagtgactatccattcttaccctacagaatatcaaccagttatctcttatactattctaaacttttctgttataaagtgggttatattctcaataatgtagagatcgttttggaccactgaattagtgatttttaagtgccaaaaagaatattggtttatcttaatttattgaacatattcaaggcattgtggttactgctagtaatatatttggaaaatcctgctgcattaaaacaaaccaaaaaaccatacaatagttatgactttccaaatgtatttatttatacataagtttgtctgaaaatagtaatatttcatctctctgctcatttgcaaaatgtggataaaatataaaagtatagggaagacaatatttcccaaatcttctttttaacattttagggtgtctggatatgcatatgtactccttttaaaaccaggaatatttgccatggatatacgttaacatagatacacaatttagttaattcaagcttagtgattgttacttcatgatttttggaaggattagaatttaaaagtggagattgtttactctcctttgattatttctacagtttagagaaatgcatcattttacaaacaaagtatttctagtgtctcctcttttctgaatcttgataacattttcaagttgccttgattctgtctgcattgtccttaaaacatgtttcgtgtatagaaccttcttatactttttacttcatcaagccatgtctccttttaaataagtttttaagaaaaacttatcttgagccatatcctctgatgaaaaaacataaaaggtggaaattatagcccccatgttcttcttagactgaaggttttttcctttaaaatatactacaaaggacattttttttttaagagacagagtcttgctctgttgcccaggctggagtgtagtagtgtgatcctagttcactgcggcctcaaactcttgggctcaagtgatcctcccacctcagcctcctgagtagttaggactataggtgcatgtcactacacctggctaagatagagtctctctatgttgtccaggctggtcttgaactcctgggttcaagtgattttcctgccttggtctcccaagatgctaggattacaggcataagccaccatgcccagccgacatactgtttatcatctttcagtttgtattgttaaattctctgtatttgttatatgttatcattcaaaactgaaactaaccctttcccctgaactattcttgggccattattttctgcctctcctctcctctgagtgtcccgctcaccgaccatgcctttctttctcatttctcttaatgtgtatatgtgagagtaaatgatattctggtgatgttcatggtctatgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttctttttttttttttaagaggcatattgacataataagctgagaagcatagccaggaaggaaaaagacctataaaccttatcatatgtggatgatataagccattgggaatgagaaaggatgacctgggtgttggtatcaaagccatctttaactcattgaagggctctcagatgggcaagggagtagaagctaagttatttctatattaaagactttgaaacaatgagtataggcatggtctgagataacagaggacttggcaaacagagcttcctaataagggggaagaaatcttaccttttgtagtagggagttctctatcctcacgccagcctttggatgaccattcattcattaggatcagtgcagggggcattcctagattggggaaggagttttgactattttatttactgtagtttagactattcttcctgatactgtttatcagcagtgttgtgctttgataacattttaaagtcatttaaaatatactgtgattttcttaaagaatagattttaaaagtgaatatccttagtactactccttgatgagaaaagcgtatacaacacataaaatcaatgttaaaaaattgactcacgacttatattactaattgtagtaaatgttaattaaatttttagttacaatattttgactggctttctagaaattgggggaaaaagatattcttgggttttcattagttgatttcagtccttaaaaaatgcattcaaagtagtatcttgaatatcttctccattttttaatggcaaatatatatgacacccacctgtcgaggttgatctggggttaaagtagaaaaccctcattagatgataaagatggtatttctcccacagaaaccatttttgaaagtaaggtcagatcctccttttttccttcttacctgctcctggcctgcttggtttgttgagagtttaaaagtgagactgcttagaatcagaccagggtagagctcctaagaggacatagaaaagtcattttcctacaccgcccacttgctatctctggctgtcatatcgaaagagatttgcttataggtcattgagctttggctacagaagattttttgtatcttgacctgtctggaagagctatcattggttcctccatatgttttgtgttgcttttagcttataaaaacttccccgtgtagaattgcgtgttagagaaaaaaaggtagtaagtctcaaactgtacttggcatttgtaaatttgctatgttagtacttcacagttcattgaaaagtcataaacaattaccaagtcattagcacagacattttaaggaggaaatttcaaaacataagttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatggcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagacaaactatatagtggcagacatgctaacatctccttaatacaacaaccataacagcaaactaagaaactgtgattcccaagtgatttttcccgaaccgtattccgtattaataggataagtgtatgtttggaaattagaggccctgaaaaaaatcctgtattaatgaaatgttgaaacgtttagaattttgttttacccaatgtttcccaaatgtactgtgtttcattttgttttgttttaagcaaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaatttcagtgaccaaaaaatttaacagggataaagacaatttcattattcacatctgtcaaaaactcttgttctggttctcttgaacaagaacatgaaactaaattaaacaaaacatctattttaattcttggggtatgacttgtatacgaattgaattttcttgtgagctgaattatctcatgtttttattcattgttaaaacccttgttagagctttttctaaagtagcaaatcattgtttttttgatagaatgcttcaaagttattggggtgatcctactggatattattatttggtgcgatattcatagaaagtatacatagtttgattatgtttatgtgtttcaggtgtgtccagaaagctttcggttttaaatggattcttgtcagttatatcttctgatgtacttagttctaggggaaaaaagagcaggtttgtcatagattcattataggtttcactttgaatacaagatgaagatactggtggtttggctattagtaatgaaactgaaaatattgtatgcagatttttaaattgtttctcagactaataaaatttttgatttacagactttttcattcgttaatggttttggagaagataattggaaattctgcatttcttcttattttgaaggacaaactcacatacgactcttactctcctgataccttcctggagatggttagtaatttcatctatggtcatcataaaaatgtgtaattccattgttcttgcattagcaaagaggatgagaagcttaatgaaaaaagacattgaaatataattttttgtacattatttgaaagaatttttatcacttaatataaattacctgtatgttcatcttttctataaatatttcaaagtatgtgaaatatgtagggttttagaatactattaagatgttagtaaggcaactggggcattataactagttgttttgcttggctttaattagaaaccccttgatatttaactttttataagtccttaatctgttcctcctaaacttgaatttgaatggtcttctggtttcaggatgagtccatggagtgttaagtaaaattaaaaaattactgttcatttttataggatttgaaacaaaaatcacaagattctctgccacaaaaaaatataataaggctgagtgcggagccaaggtaaattcataatttcttacaaatgtttaccactttctggcttaatagtttttggttttatggttctggtttttagttagcgtatattttgaggcaatcaatttattaattaaaaaactcctaaaaaatggattttctttcatgactgtgttatgctcagtgccaatagctaacacagtgcttagtatattgactgctgaataaattattataacaatatttctcacagatataaggtatagcatgataaatatatagcttataaaacattttcttatctctataaaattttcagattatatcctttcttgattaacctttcatttaactaccttgttttcattaatccctgatcctatttttatatgaaagaagaaactttattattattggaagatcaaggtttctactgtaaattgtttattagataactgtcattttgctggtgaaacagccttgttttagcactattgatttatgctaaagtaaatgggaagggtgttcagtgaccttaaaccagggcatttaattggtggctacctaataattataaagaaatgcattatgttttattggtatttctttaaacagcaaggtatctgtttttaataaccaaatatttgttggtcatttcctagttgacccaggcacacagtggttattttttgtaatataacctttaactgtcagaatcaagatatttagtacctcctcttgccaattataggataaaacaataatttcaaagagtaattcattatttcaactaaatatattttattaaaattatttaaaaataaatggaatgaatgtaaaaagaatttatagttgctagtaaagttgagactttttgttaagcatagactaaagtcttagttgtctaaatttctttagtaagtagagacataaggtgtatacagcttattccttagaacgagataataagtttttttattttagtaatactaatgttctctgtaacacggcagaagccttaggagctttcagattgccaggtcatagttaggatgaaaggataatgacactgaaagaaatatttcttataaaattacaaaatgttttctttgtcttaaaataagttatgttttgatgcatttggggttatatgcctgttccttaaatattgtgttcctagtaaactctggcattagtaaatctatttggctttaggcatagttctctcatctattaacttttctttctttttatattttggtggaggaagatctttgtttttgctggttataagaataatatatgctgatataagtgatttgtgccccatctctgggtgctcttatgctgggtgcagtgaggcagggctggaaccataataggtcagaagaaaagatgttccctttagtttatctccttccttcactgtctttgccttagcaaacaataattgataattttgcctttctaatgccagaagaagaaagttaggaaatgtagtatattaatgaaagagaaaaatatttttaagctttcatattgaggagttttaactacaggtaaacataaatggaatttcgggggctattagtaaaatgattgctttttgatatttctttttaaatagtttttatttaaatagtatagggtttatcttcctattacttctttacagttctttttttatcaaatattgacttcctatttctgtaggttggtaaattaggaatacttctgattggcagattcttatttgtttttatgcttattatccattttataggttagggcttcttagattttaggttttaaaatctctattttacttgttagctgcaaattattttagttactgatctgtcagtaaaaatagatgaacaatgaaggaatgatagtggcctttaaaatggaagaatttgattgttttatttagcaggtactgaaagtaaaataattgcccttttcagtttttaaattggaagccttagaggtgtggctgtgagtctttgtcatattcttcatgagtcttctttaatgttgtaagggttggctttttttttagttataaacacagttcctgtttgagtaacaaattatctctctaaataaaccatgcattctcgatgggggagatattttttccaagagagtgaaaattggtttttggggatttgaagaaaatcttactctttttaatatataaagcacagatatagtacgtaacaggtaaacagtttgtgtgtggcattaaaattgtatgtgggtgattagtaaatgtctaaaaagagtccttagggaggtgataatgtaaaaaagattgagaaatactaacttaaacccatagaatataaataatacacgtaaatttgatcatgctgttggcaatattagttatagcaataaacctaacataactttgtaagtatttaaaaagtagtccaagatctgtttaaagtgacattagtacatgttgatatgcctaatttagttcacacagttatgtgagctatatcatgtgtggattcgtagtttttgtgtagaaaacagatacttcagaatatcaactaagatataaaaagaaaagccctcccataacgcattgccattggcttgtttaatggttctccctggatgacctcccagcaccaataatttaagttcctctgattttctccatacatgctttccttttggatgccagtcttgattaaaagtattgttatctttttagttatctaggttctgaaatcccagaacctactttgacctctaccttttattattccttaaatttcatcacttggagagtcttttttttctcatctgtgaaatgcatcttctcttttcctgttactttttggttctaagccatacttcgtgcctgaattacttcaacagcttcttacccttttgtcttcaatttcctatgccccttatttattacatgaagttatcagaggaatctagccaaaaacagagctctgagaaagtcacttctaaattcagcattctctaggtacttcttcttacctattgaggaaagtctgacctgatggtcaaatgttttagtagactattgcctaacaaactaatctaaaacttaatgtcttaaatacaatttattatatttcccacgtttttgtagaactgctggtcagttcttgcttggggtctctcataccattgcaggcaattggagattgggactggagttccccaaagatttgactgggctcagtgtgcaggagggctcatatacattgctgaaagttagtgctccctgttggctgagggttcagttggagctgttagctgccagtacttacacatggcctctccatatgacttgggcttctctaaccatagtggctggttccaagggggagtgttttaagattgaaagtctcaaaagtgagttttctgggtagaaacagcaagacttcttaagacctagctttggaagtcctagaaggccattttcattacattctattggtcaaggaagtcattaaggttagccaagattcaaggggagggaattactctccatttcctgatgtgaggagcatgtataggaagcagtgggaatgatggtagtcatcttcggagactagctatcacagttcacctataggctacctcagttcacatacctttcatgtacggagtaacctcacccacctcccaagatgtccaaagtctcatcccattatgctattagccccaaatttctacctagatcaggccaaaatgggtcactcatatggctggcagttaatgctggcttgtttcttccagtataattatttaaagttaatcacagtagattgtaaactccttgagagtaggaattatttctttatttctagcatcatgcctgtggtattatatgcaacatagcaagagtaattacagattcattgaaatacatttaaatattgactgaagagaatattaagcttcagacaccagatatgcatagaagaacatggttcacattctatgtgaaaatgtggtatcctggtatatattctcctcaggtggttctttggtctcatatttggaggttgggtgccagagtgcttctaagtaaactttaagaccgttacaaataaagataaaccataattcaataaagcttggaatttgtataactgtccatttaagattttagttttataccatgagacctgaaaaatttcagattgcatctcagcatcattgcattcttacagagttaacttcgttaagattggatattgggtgaatgttcagaatggatggatataaaagatagttccaaatagctgaatgaattggctttatcagattggtttttatatgtaagacttattgttatgatcaacatagcctgattctacattttgtatttttaatattgttattgtaaacaattcttctggcactaattatctattagtttaatgggattcaaggctagcttttttcttttcttatgttatcaatatatttttataccaagtaagaatgtgtcttagaaaatatctaatatctctaccagttgtttacacataagttttaaatgaagaagccaaactcgcaaccttatttttattgtttggaaatggaatttctaggaaaatagaattctgaccactcagattgtggcagcattatttgatagaggcatttggagcttaacggcggaagtgagattccatgacttgaaccaaggcggctctagtctgagaagtgagtctggtgaaagagctgttagtgtacagagggagcgcactttgtgctcaactgtggaggagatggaagtgttagctgcgataattagtccaggaactgtccttaatagctcatggattatgatggtttaagcttaaaccttgacacgtactagaaaactagtatatagaaatgtctttccattagttaacagaaaaatgagtgtaaaaagtcagtaagattaaaggttttctttcttgaaactggtcggctatattttttaattatcctaaagaattcaaggcaataatagaatacaggatttgacatcctggaccctctccagcttctgttattttgagaaaagctgagatatttttaccttttaaataaagctgttttgaacttttcttttggtgagggaattagtaactgatggtcctagagactcttaaacacataaaaactaagctattctgtattccagtctagtttagttgtatctaggcattaatagtacagtgtatttatgaattttattggatttgaaggatgagtttataaactgtcctctaggatgcttttctgtttaaatatatattgcttgtaaaaggtatttgtatgttttcacctatgttctgtctctgttatgtgttaactctgatttttttcaaggtataggttggctagttccctgattatccagaagcacttttcatcttgtctgtagtctactggagtgttttcagaaaggatgctttatccaaaagactgaatggaatatgttatattatgtaaataaccaaaagtttcttaaggaattcaaggtacctgcaagatgctacgttagttaattttatgttaaaaattatttgcattgactagtggttggtactagtgttggagcagtcatggcttggtagcaatacaaaataatcttatttggtgtttgccattccaattcagtcatcacaggattacattttgcctaatttttcaagaaaatataaaggtctcttggggaggaaatgaggagaaaaggctccacctttgttccagtccctcccacccttagcatttctatgtattttatgacatcaggaatgatgagtattaattcctgacatactgtttcaacctcacattgactgaaattaaataacatctattatattaaaaaaatagttgacacttccagtttacgtgatggctgactagagaccatgagactgactcttagtttcccattaaagctcatatgaaaatgtagaagatgatgaacagttgtaggaataccaaaaccttggcttgacagtcagtgtattatcacaatctaagatgtccacaaactacaaagctgatagaactggtctgaaaaatgcaattacttgctgattaatgataagcagttagaaataaaagcaacctgcatgtcttttaaagcaagtatggagaatgattccttttccttttcataatgtctacccccaaggctttcaaattctggtattatatcaactagaaaagtgaacaaatatttttctattggaagagtgctacttttgaggctattaggaagttaggtagcttttcttttttttctcttcttcctccctgcctaaggtctctgttgaccatcttcatttaattgaccaagtagatcaactgacactcttcattccttttcagtgcccatggtaatgtggccttgtagctaacaggctgttagctagcaggccaatgtacttccctccctccagtctttcagttgtgtgattatcatgaatcagttatttattcctaaacaagttgttgttatttttttctcataaaccattttattacgctgttgaattacataaaaacccttttttatgaagttgaggactttggaaatattcagcaaaggtgagtcactgataaatgttggcgagatgactgcaaaagatttgggaagaaatcataaaaatatagaagccggctgcactcagattttcttaacatttttgagtttaagttcttgctatactttagagaaacctaagcttggaaccacagaagattatcacatgtttggttatgcagaaaatatgaaaactccaattactggttccatagtcaaaggatttgcatattttgaatatgatacatgtatatatttcatggtaaagtaaaatattaagaataacacatacatatcataatgatcttctactttaacttttattttcagctcaactttaactctttctgttaatagatctattgccagccttgatcacattgatgaaagggcttccactgtgtccatattttgcaatcaatttggagactaaatctgccagaaataaagtaggcaggaacaaggaaacttaacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagactcagaagtgtagcttacttattaaaatgatttattacagagaccagatgaaaatttttttaaaaaaagaggacctggaactctcaaaaagttttgagttataatctctgagaaatatgaaacaaggtgaaacactgaaacaaaaagatgacaaaaaatgaaaatgaaaatatttggaagaggagaggagtgagataaggagagattgttggaggggcaataacagaccatcttcactagtgatgctgaagagtaaagctgacactgaaagagggtatggatgtgaaaaaaaagtccatgagatacttttttaagaatgtagacaaaaggaagacaaatgccaacaatgagaaggaagatgatgatcggtatggaggacaagattccaacaaaagaattaaaaaactttaggaaaaaatacagcagaggcaatgatcaaagatataattgatgaaaagttttctgagctgaaaaggcctccctttatagatgaagagggataagtgctgggtaataaaaatgaaaaaagagccaccccgagtacaccatggtaacttagttcaactaaaaggaaaaaggacatattaaaaaagtgcccaggcagaaagactatattgtataatatagaacaaacgctagactgacttagacaggaagactatgaagttttgaaatcattttatactcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagtgtccatttagttttgatagaatttaacagcaccatggatctgcagcttcaggttatattaatgcctgaaataggtggagaggcaggagcatataggagatcctaaataatagtttttcttcaagaagatttaaaaaataccaacttctggtgagagtgatatttcgtattccattgccttcacttactatcagtgtactgttaactcctcaaacatctgtctctgctgagaaaagtctcctaagttctagacccactggccaagtggatagctctcttgggatggcccattagcagctccatttcaccgtgtttaaaacggaactcctcttccctgcttgaacctgttctgtggtcccaagctctttcaattttagagtgaccagatatgacagttttttcactattagcctctttcactctcaaaattagtttggacaataaattatggggctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgggtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatggtaataaccctgtgacagatgtccctgcctcacacatttgttggcggagtttaatacggttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagagaactatcaattcttggacactccattttttgttatattacctctacatctttactacctggggggttaaaaaaaacaaaaaagcaggccaggcgcagtggctcatgcctgtaatcccagcactttgggaggccaaggcgggcagatcacctgaggtcaggagtttgagaccagcctgaccaatatggagaaaccccatctctactaaaaatacaaaattagctgcgcatggtggcgcatgcctggaatcccagctacttgggaggctaaagcaggagaatcacttgaacccatgaggtggaggttgtggtgagccgaggttgcaccatggcactccagcctaggcaacaagagcaaaactccgtctcaaaaaaaaaaaaaagcgaaagaaccaaatcacaacaaaaaatctccaatcttggccgggcatggtgacttaccctataatcccagcactttgggaggccgaggtgggtggatcccctgaggtcaggagtttgagaccagcctggccaacatggtgaaaccctacctctacagaaaatacaaaaattagccgggagtggtagcatgcacctgtaatccctgctacttgggagactgaggcaggagaattgcttgaaccggggaggtggaggttacagtgagtcaagattgcgccactgcactccagccagggcaacagagtgagactgttgtctcaaaaaaaaaaaaaaaaaacaacctcagacttcacctctagatgcacccgaatgtgcacacacacagacatgcacatgcacacatacaccatttgcctgataaatttctgattgtcttttagaactcagcttagatgttacatcttacatcctctggaaacttggttgagatccttgaagctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggaaaaggacgtgcatttcagctttgtttatcatgtgaacaaatattttaaaagacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaataactaaaaattggaggtggagagagtgaaaattatgagaaaaagtcatgtaatcattaggcaattaaataatttatccatagtgatgaacccttatgggaaaagttttgatttagaatcatctcgcattcattgttttcttctttaaaggtgaagttttttgtacttgttggctttcctttgttacccaatatgacttcttgtatgtatagtgtttcattttgtattgcactgaactgcatacaacagaaaccttattacaatggcttctgaagaaagccttttattattcttatggacaagtttcaaggcaggtagttagggctcatgatgggttccatggtgccgtcaaaagtccaggctgcttttacctgttagctctaccactgttagcctgtggctcttgttcttgtgaactcaggatggttcctgcttctacatacagtacatctgtgtttcgtccagaaagagggatgagcaaaggaggaaggtcatggcagttgggataaactggggactcagtaactttgtcagaatttccacatactggaattctaattacatgtcattgtccagaactgtgccacatgtctgcatctagcatggggaagcaggttttttttgttgttcattttgattttgttttttaagctatgactgttgccatcctaaataaaattggctttctatcaataaaggagaaagagataatggttgttgggtaggaaggagcagcatctgcaaattagattcattaactagatcaaaaagcagctaccagattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaaatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtgccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagcaagcttcctaaaaagatgcattatagcagaaaccattttgattcttctaaatggcattgattgttactatcatccatacttgggtgcctcagcttttctttgttctgattcccatcatttcaaaaatctgttcaaaaatgtctgtctcttaagaaatctttgctagctgagcagtgcttttcacccttttgtaccacattctctaaacatgtaggtatttaggtgttgactttttttttctttgcgagaattcattccttgactttactgagtgttgtagcttcctaattatacttcaagcttccctcatcatctgaattcattttttcaaaagatttatcgttctattcttgcatctcctaaaataatgctttttgcatttcttgcatcaggcagtttaaagtttatgataggctacctaatacaatataattaaatatatatttttactgtcatttagaagttcgaagaaaagtgtttgtcattaggctattaccagtctcacacattgatttttaagtgatatgcagtgtgggatttgccttagtgctttaacagcataggattttaaatcattcttttcttcaatttcacatgaactttaaaagaatcttccttaccaggcccttataatttagtctgctatgattttgttcttaggtacaaaattcttttagattttatttgtgaaagtaattaaacagatagattgcatttaaagttatattttttatttttatttcttgaaaaataaaggcagagtagcttaatgttctgagaccacctgctaaattgcctggttagtctgtgttttaattgattttgtttatattttaagtcaaactttcttaattaactaattgcatggttctagtttattgtcagattattatacagtgaattcagtttgcaaagtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccatgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaactgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagattttttttccttctaaatgcagattaataaagcgtgcacaacaagaggaacaaggaaaaggattttagtgaaggtatcctgatcctgaaaaagtcagggagggcttcaagcccatcttggacttcagaacacctcacaactttgtggtaaaagaaacattttaaatagagcctttggacttatttatttcatccttattcagagagtagcgctttttttaaaatttttattttttttaggcaagacaattgtatgtgaaatcgcgttacttttcaaactgaaacatagggtttcagatttgttgtaggtacttaatatatactcaaaatattacaggtagttggttggcttgtgtgtttttctttgaaatgtgttcttttatcccttgtgacattgtgtttgcattcactgtgagtgatgttttctctagtgttttgtatctttaatcggttcattgggttgtatagtagggagtctttcctaggaccaatattgtttctaaaaatactttgaaagtagaaagtggtttgtgttttattgttttcatattttttaccagtcatatgatggcttactaatgtgaagagatgtagcactagtaaaaatttgttgttttctcctctattcacctggaaacctcacacaggatagatttcatttgtcaacacagatatagacagtgaatacaaacatctttgccatttctgtccttaacaacaaaacagtcttattttactttgttaactttttaaggtcctttttatttgtgaaaattaggttgtttatgtactatgtgttcttccaaagttacagagttatattcattggagaaatgaattttcttccagtagatgaaaattacattttgattgaacatcattccttatgcagtcacccataaatataatgtcttttgctgtcttttcagaaaatggctacagatgtgatttctgaattgacaaggaaatagaacatcttaatgttttaggtaaaacagatggtatttttgtttgaggcaaaactcagagaaagcaacttaattggtgacaagactcttggggtcagccaaattatatacaatttgtgtttgtttttgttgctttaatatcaaaagttttagaatacttggaatatttattcttttatttgactttactattttctgttgtgtactggaaatagttgtaaaatttttcaatcttttctttacaaaaattgtaagtccacatatttattctgcttcggttacatttatggtcttagaaatgctttttgcattgtgaaaagttcctgaaatttgtagttctacttttgagggttaacattttcatttgtagttttaagttgcatttgcaactacaaattctgtggacattgataccaactctgttctttccatgcctttgagctctaggcagatctcactgtcagatgcctggaatttccggagcacagtgttgtgaagggacccttgcatgagagtcagaggactgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcaatcatttggataaacaccaggaaaggaagttttgaggaagagactactgtggacaataaccaagtgtttccagtaactgggacataagataatctgtcttccaaaatatctccagtattccaaaatgaagacctattatgtagcaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactgaagggagacagcaggtcaccttccctgtctctgactccctgacggattgagtttgaatcctggctgtaccatttctatggctacataaccatgagtaggatacagaaccattctatgcttctgtaaaataggcttgtaaagtaactgctcagcactgttttaaggctaattaagtgctagctgttggtattattatcatcatagctgctaagattaccataacatctgaaaaactctgctacgagctaagtcatttacttaaatatagcaaaaatattcctttaatacagttttatatttgacttactgctttgtctgttagtattataaacaaacataactgtctgccccagtaatattttctaacatagagctttctagaatatttacttaataatatcatactttccttgccattcttagtttagaaactaaaagtttattagtaatattttgtggaattcttgcatttgaggagaataaggtatttgcagcaatcacttagttgccaacagcaattttaggtactgtggtcatactgttttgtgaaggacaactttatatttgcatttgatcacacatgcagcatgcttgtttaccttccttttgaatcttttccttggacaaatggctctccatgggatgataggctcataatattttgtccatgattttaagaatgatttctcctaaatatagagaaaggtgtgaaataaactttcatatattaggaagatagggtagcatttatgtactactatatccaagtaaaattctaatttttattgctgaaagagtgttctgtaccttagcgttgaatttttttttcttgtaagagcaggccatatttgttacttaaccagctagtagcttccagaaaccatcatttaaaatttttcccttgtgaatacaggagagagggcaaagggctagacccacttcatttaatctttgcttggtcccagttccaaggaccccaagctcttcttgcttgttactctttgcccacctccatcctgttttccaggactcaggattttcttttatatatccttggtggtatgaaactggaagttagtcctcattttcaacaggaatagtgtaacctggtatattagtttcctgttgctgctataataaattaccaacaaacttaattctactaaaaaatacacacaaatttattatcttatagttttgggggtcagaagttcaagaccattttcactggattaacaaaatattggtagggctggttccttctggcggctctgaggggagaatcatttctttgccttttccttttctagagatgacctgcattgcttggcctgtggccccttccttgtatatcccatccacttggttctgttgtcacatagtcttcttctctgttggatcgtccctctaataaggacccttgtaaatacattgggcccacctagacagccccgaatgagctccccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgccgtcctgctttgagccttcaccccttaagttctttctctgcctggcaactagaaataggtattaaaaaggaaaatttgaccatgttaaaccttttccatcaactgcacaaaaagctccaagctccttgtaatgactaaaagacaacccactccccactatgacttgagttttatctacttttctaacttcatataattgcattttagagatgcactttactgtgtagcgtctagtggtagtggcctgtatatcttgaaaataacattatttcccgtatatctgtgtctttattactgaaaaggatttccctgcttcctttgccctttaaaaaatttgtttgtttttgatgttgttattgttctgaatttttctaataaacacgtaacttcctgtagaatagtgtttacatccaaagctattaaaaggatttctagcatattcactgataaccctagaacctagaggaggtaactattaacaacagtttctttttagaattttatatatttttatatttcactgcttattctttgtatataattcagaatattcttttgtatttaataatgcaacaaacattttcttgtatttaaaaaattctttataaatatttaatggctattagtattctagtacgtaagtatacttttaattgttaatgtgttccctcaatttaatattatattgattagctaatataatgttttgaatagtattgtttagatatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaactccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcattttctaaggatatttttgctggatatagatttttaggctggcagtatttttttgtttcctcaccacctcaaatatataattccattttctcctggctttcttaattattttgatatgtcagctgatgatcttattgttgcttctttgaacagtgtaatcttatttttactggctgcttctcagattttgccttttcataggggatttaacatgacacaccaggtgtattttctccgtttggggatcacagagtttttttgtatctgtgggttagtccctttccttagttttgggaaattctcagctattcaggtaattatattgtgctattttctcttttatttccatctacacatatcctatttcacatattagatcttttcactgagttccctgtgtccctaacgttcttttctatattgcatattctttttttcaccacttccatttgtatgttttttattgacttctcttttgctgagttaaatatatttattctgctattgttaaagatatctttggagtttttaactgtaaatatttatccttttagaatttcatttgattattttgtaatgtgttaatttctatggtaaaattctctaccttgtcctctacttgattcatgtttttctctttccttggccatattaattataattttaaagtcatgtcagctaacttcaatatctgggtcatgtatagttctagtttctttttttcttggtgtttagtcacgtggctctgtcttttgtgatgcctcttaatttcatattgagtactagacaattgtgcataaaatttagagagactctagaaaatatcttcttctagatagatgttccaatcaaggactatgttaaattgagactgatttattcaacctgttgttcacctggctttctaagtaatttttcaactaatagcctgcttatattctgtaggccctatcccctggtgggttctggaatgtcatgagatgtctctgctctacttttcagaagctttctgttcaggttttaagcttccctttctgcgcagcctcagtatttggcacttgtcgtaatgaaaaaatcaactgtgtacctgaagcctcccaaagtctccacaaaatgctcttttgatctctttgttccccagtgatttcttccagactttccactaggttttgcatggaactcacagcctctcccttgctgagaattggcatgccccagagtgaaaatgactgcagaaggctggtcacttttctgaagttttttcctctcttcagcagtttttctgttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagttttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttacgaatgaattttgggagagttgtgcttttgcattattttagttttcttatttagaaagatatgtctctccattcatttttatgttctactaagtgacattttttcattttctgcgtatattatacattctgctcattttgtataaaattaattttctgttttgattggtctcctgaagattgttaatcttcctaacagccgtgtgtgtgtgtgtgtgtgtgtgtgtgtgtgtgtctgtgtctgtgtgtctgcatgcatacgtatgcatcccatgacatgctattacatacctttgtcttattgcctaccctgttatattgaacttaccagtttgtttctgtgcctctccctcctaaactgtaggtactttgttgactgggattatgtattcatattcataagtttataactacacataccatacagcatctttctctcctttctttgcttgctttttaacttagccataagccatgtggttactttgaatgtgtattctcaccactaccatgttatcagaattcttgtttcaagatatctgtattatcacctgttgttaatttcctttatttagatttatacatgccttacacaaaaaaaggatttatgacagctcattgacctgggtttgttaaatcgttcactgtactacccagtgtgatgatgtgccagggtccttggtcaggataccatgagagtcttgtaagggaaaggagagaagtgaattgttattgagattctttttttgtgcttggtctgagctaggtggttttctaaacattttataatttaacattaacaataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaattgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttctgttaacatgtaaattcatgtttccatattcagaatactgtataaagcttaatgtttttctttaggttatattccactaatgaggctacttagagaagatgaatgcattcttgtttgaaatgatttttttaatatgttgtcattgattaagagtcagacaaaatgagctctaatttttgctttattcttaactttctttgtaatattgaatgtgccatttgccccatctttacaaagggactaattatataatttatattttcgaagaattgaaaagcactttttaaggaattgaaataatcaaaatggaactgctctgataaaactataaagccccacatcagtagatactatttacaagtaataaattctcctagtggtatttttctgcactgatgattcattaactactgaacattattctgtgctaggtacctatagtaagcacatgaaattacagttatttttcatatgccttttggtgtttgcttaactgattttaaagtgcacttataaagaacttgaaaaaatatgtatttttttaatcttcattacacaatcataaaaatatgtaagttgcttttaaaatgtttcctcaaatatcgtttttgcttacttcatgcagtgaggtcatgagatgaactccttagtatatattgcaagtttttttctgttccagtgttccagtatataaattttctttcacaaatataatatacttgaaatgtaaatagcttattgcttatctgagcttcctgaggagagaggctctctggggatattggccttgctaaggagaaagttcttcacatttgaatttggatgcaactaagggaatctccacaggaaacttcagctgtcacaactgtcacaaagatccttatatgcctggcctgtgagtgaagtagttaagaagatgggtgtggaggtgaaattgcattataagccctattgtggcactttttacctgggcctgtcttggcaacattcctgctcttgttgaacctcagtttccttatatgtccagtgagaagaatgaaaggttgccccacaggggttgcccatgcaggtctgaggaccagcccaggcatgcaggatgcactctgaatgaaggtccctctgaccaaggggcatgttccttccactttgtactgcagccagtcctagaaggaagcctgtgtgctcccagtctgttgttcacattttagtgggcactgattagatttacctcaaagagaaaattcagtattccatagttgtcttttttaacatgatatgaattacttctatgaaaggtgaaggaatttttagtatactcatcctcagtagaatcttcaaggacagccacgtttacactgggattcttccataaagtgattcccagtttgataggagcatacagatgttctttcatttttgtccattcgtttttctccagccaaagtagattatcttctgccctctagtttgattggcaggtaacatatgaatgctttttcttcatgaggtgagagtttttccttgtatatggagaactgagataattgctcataaccctgaattatgggggcccaatgtcacagtgagaactaggaggctggacgtgacttggtgacagatgatacgtaagaagctaatgctgatgtggtggaaattggagaagaaaaaagcactgaccttacagctaaaattgaaattaaccctccccattctgaagatataaacataattcttttgttaatgtggatcaaatattgttaattttcagtaagtgagtatgatattatgatatactgaaacctattggtttcattcacaactagagggcctgaaaggactcatgtttggggatattggcagtataacaaatgtttgactaccaaatgtgatgacaatgaaaattaagttatttatgattgtatacttatttccaaaggaaatatctatatatgatcatcctttctctgtactctacttaaaatgtacatagataggagttcgtgtgtcagataaatttgttctgtgatgcacataaaaaacatgctgtgaatctctaatcatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgagtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctctgggaacatgggtttcagtagtaaatcactcatttctggggttctgctttgaacatctttggtacagagaatgagtgatccaccactgtttttcttccccattgcaccttagaaatataggacagtcccattggtaataatgaatcctggccgttgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccctcgccttgagaattgcttctgtgcgtaaaatgggattttatctaagtactaggaggattcgttgctctttgtaaatatgtttgtgactatgtggtttcatctgttcatctcttgtatacatatggaatctcagtgaacataagtaatacaagttaggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcaattaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcctctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatatagtttactaataaaaccatcatgtaaaaattaaatgttatgtgaaggatgtcataatatgctggtataaaatattggaaaaattgtgtcccaaatttcagttcatttatgtttttgttcataccaaaagttgcacgtagttgcaaatattgcctaaacttattttaatagtttgcattttcctttttctacctaatcccaatcaattttttttttcaccattacttactataaacatttggggccctgttacaagtggattcacttcaagtgaccttttttagaatcaactttctttaataataaagtcccattgtatataaaatatatgtgtgaattatgtgattttccatatatagccatacattcttagtggtctaaaatgaatattagatttttaactggaactcattgtgatgaaattgcaaacaaattgtgaattttttttattctgtgagattaggtaggaatcagggtattagttgtatggagctcattcttttaaacagatgaataaaaccgtatttatataagtctttttctggggtacagaaaagctttattacacatctatgaatatcttccatttgtaaagcattaattctttagaaagggcttctgaatcattatttaattaccctttgtactgtgtgatatttgttgtgatgaaattgcctgttctctgaaagttctcacagaatattcctgttaattcttctccatgagttgactctatgactgtccatgaactgaagtattatgaagggtttggaaaaaattagccagatgtagtagcatgcactacacctgctactcccagctactcaggagactgaggtgggaggattgcttgagcccaggaggttgagactgcagtgagctataatctccccactgcactccagcctgggtgacagagtgagacgctatctcaaaaatatatatgtatatgtatatgtatatgtatatctacatgtatatgtatatgtaagaagtaaaaatattttgagatcccaataatgaagcagctgtttttgcaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgaggtatgttgtagccatagaacttaaggaggcattgtaaaacaaacctagccagtatataatttgtgtatgtacagtagcccccatttagccatcatgttggtgtatgtgaggtgatgaaagttgtaaataccagagagtttaactggtgggtcaaatgacactaaaggaaaaatgatcctgtgttccctaaaatgttaatttctttgttagtatatatattgtatcttattatatgttgttcatatgtatattgtatatctttgtaaggatgcatactgtttattctaaggtaatgcagtaattattactcataaaattttgaatgttttgctctaagtgaatttaatgataattatgcatatcgaaagtgagataaataccacccttagtaactttggatagttttaggttttcattgcaaaggtgacataacacaccatggaagagaaatgccctaaaataattaagatgcttcttttgtgagatataattgtggaaaatctgtgctcaagttaataggtattttttgtgccaaagtttcttaaaataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgagacagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagagggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttattaaccgaaatatcataatattgcaaaaaaaattaataattaggaaatggcattgttgtaaagcccttacattcatggaaaatttccttctctaggcattctagagtacagccaaacaattgagaatgatcatacaggttcacatattggataaaaacattagtgcttttgataggcctaccaactttaggttattaggttctctggataaactgagacatgtatggtttacccataagatatcaaacatttatagaatattgttacacagccatgccttggtatctgtagaggactggtcccaggaccctctggggataacaaaatctatggatgctcaagtcctttatataaaatggcatagtacagatgatccctgacttacaatggctcaacctagatttttcaattttataatagcgtgaaagtaatgtgcattcagtagcaaccgtacttcaagtacccatacaactattctatttttcgctttcagtatagtatataataaattacataagctatttatatttagtataaaatatgatttgtgttaggtgattctgcccaactgtgggctaatttaagtgttctgagtacatgaaaggtagactaggctaagctatgattttggataggttaggtgtattaaacacctttttgacttacgatattttcaaattctaattggacataacccaatcatgagttgaggagcatctgcatttgcatataacctgcacacatcctcttgtgtattttaaatcatctctaaattacttgtaacatctgatacaatgtaaatgctatgtaaatagttattatactatagtttttatttgtattttttgttttttgtttttttttcaaacattttttatctgtaattggttgaaactgtggacatggaacctgtggatatggagggccaactggattctctttttaaaaaatatgatagtttgttggttttaccaaaaatataaatggtttgcctctcagtagataacatttatctttaataaattcccttccctatcttttaaagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaaggtatgttctgaatagttctaaaattcatagaatgcttatcatttttgctacaatgtgtgtagattaattaggcaaaaggggaaaaaagtcttaagtagagctgtatcaaatactcttgagtaaaaggaagcatgagctttttgcaccttcattgaccacttgctgctcacatgtatagtctgtgggtggcgctactccgtggtctgtgtgtcactggtccaccagataagtacagaaattatttttttaaattgtcatatacatagaaccagatgcaacatgcttaacatcttagtggtgagttgcttattattattttttttaatctttagcaaatgatgactaaagaagatggtaaacaccatgaagtaaatgtgcaattttcatggtatggaaccacaattaaaagagacaaaagtggtgcctacctcttcttacctgatggtaatgccaaggtaagtggtactgatgagatgacaaatggaataaacacttattgaaagagtattgaggaaaaagataagtgagtgtcattattttatcatctgttgatttattagggatagatgaacttttggttgcagtattatctatcaccttattgatacttagcaatttgtagtcgaaagttagataaatggttgggcgcagtggctcacacctgtaatcccagcattttgggaggccaaggagggtagattgcttgagctcaggagttcaagaccagcctgggcaacatggcaaaaccccttttctacaaaaaatacaaaaattaggcatggtggcctgcacctacagtcccagttactcaggaaggctgaggtgggaggatggcttgagcccggaaggcagttgcagtgagccaagatcacgccactgcactccagcctgggttgacggagcaagaccccgttagataaatagttttttagagttggaatttgttaagatgctacaatgaacaatgttcagttaggataaacaatgaacatgggaagaaactagattttacgtagagttagggagctttatatgtatgcattttatacagacacaaaacctctagccgtatgggaaaaatagattttccactggaccatttttctccttaactttcagccctttaaaaaacaaatctttctcactcttgactataaaggtagtaatacgcaaactctggcacattttgaaaatgccagaaactaaagaaaacattaaaatttaccaacaggtgcacaatcccatgaaaaccattgccaacatttggatgtatttcttattgtcttttattttatgcatatccttttctccccgttctcaagtcttgacttattgcatgtacatattttgtttttcatttgtgacagtgctcacaatctgatggtatgttttttaaaaatccaattttaatatatactgttgtgtttaagatgttgcttatattctttttctcccgattcttcactaccataacattgtaataagctttctttgtagcattcaaaaagaatgctacaatgcaattctgattaattgctgagaataactttctagaagagtcattttgtatcagtgtctgaagtcttttaaggacttttgctgtgtactgcttatcttccctctagaaagactaggtaaatgttcaatcccaccagcattttttgagattaactctaaaatcccactccaagcactgagaattggccatattacaagctttgcctataatagtaagttagtagaaaaatatttttctgttaagatttttgtggttactagtaaggttgaacgtttttgtaccttcatttatctttcatatttcttttgtgattttcctatttctattctttgactgtttttctgttggtgtgtcctgatgatctctgagcactctatatgtggtaaaattaatccttttccctatatgttgtaaaatttttcttattgtgtcatttagtttgttaattattttattgtatttctcatttatagtggttttaaatttttgtgtagtcatttcttttttttctgtagagtttcttcctttgcttttatacctttataggttttctatacctcaagatcagtgaaatgttatcctaattattgtcttgttagctagggacctatctcctgaaaaagttacttttgttccacaagttatgaaacctgctaactaaaatccaatactggattttaagggattgtgtaggctacagtaaggactctaggttttttgtttgtttttgtttttggttttttttttggctgtttggggtttttctttttttttttttttaagtcagtgaagaattaaagacaaactacaactcatatgaggcattccaggatgggcagtgagtcccaaatatgagctgtttcagtgttttctcattcaccagcttttgtcattggacattttattttgattgactgtatttatacttaaaaaagtagttgtgctatagaatttcatgcgtagataccaataactaatttatttaaaaccattttatctttaaatagctctaatgtcagatagaaagataaaacaattgtcatttttacagagagaaaataaaaaacatcagggaaagaggcagtctagtgcatcagaaaaaggcaagagcccagaactcatcatcccaggttctcatcccctccctcactttctagctatttggtaattaggtacaagaaatttgtaaaccattaagcattttaataactccagaaaattttccctagccaaagaggtaaatttggaagaaaattacacaattctgaaaaaaaaattttttttttttggagacggagtcttgcactttcacccaggctggaatgcagtggcgcgatctcagctcactgcaagctccgcctcctgggttcacgccattttcctgcctcagcctcccgagtagctgggactacaggcacccgccaccaagtctggctaattttttgtctttttagtagagacggggtttcaccatgttagccaggatggtctcgatctcctgaccttgtgatccgcccacctcggcctcccaaagtgctagggttacaaggcgtgagccacggcgcctggccgaaaatcttacactgtttaagtagttcatattgcaagcctaactttctatgctattgttgagctaaggtatctaatactttaaaaatataattactcataaatgttttaaatttgcttccatgtcacataagttatgtgctttattaccattttttaaaatttaaataaaaactaaactagtggtttccaagtagttttttcaagtttgtgaatttatattcagctagttctttcaagtaaaaggacagaatgttttatagtttagtaaaccgagctatgattaaactatgtttctgaatcctgctttcagtttgcttagatgactccctgtagtcatccttgccacctgtcccaaaccctgaacattagggggctgggaccatggttataataattatttacctgggaaaatgtaacttctgtagaatgattgctgtttctaataagtaactatatggacaaatagaaggattttagttagaaatttgtatagctgggaggaatgctttctagaccagtgaagttgtaaacatttttatttcctattttcagcatttttaaaaataaaaaacacgttcagtttttatcacatgcatattttgttaccttgtaagatctggtttacacttaaaattgcaaatatcaggtgatacgtattttctatttttgaaaccataataaacatattcttttaaaagtttggaagccaaaatatttttcttaaatatattattttcttttcagccttatgtttacacaacaccgccctttgtcagagtgacacatggaaggatttattcggaagtgacttgcttttttgaccatgttactcatagagtccgactataccacatacagggtaagaaaataggaatgcagttatgaaacatatgtattatggtttttgaattcttgcttttcttatgccattcttaaattaacagttggtttttgtagatgatgtttttctaaacttgacatttttaatatgatttaaaatatgaaacttaccctttgataataaaaaatggtaaaacgtttcaatccctacatatacatgttcctctgtatatcttctcttaattgttgccatattggtcttgagctcattaactggtaactttatttttaacacctgaaaacaatacagtgttttgattttatgaaatggaaattatattaaatacgactttcagttaatagaccacacacatatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatttaccatattatcaacactcttagaaaaagacctcataaaaatgccatttaaatttatctttgctgttagctaagttgaacaaattagaaaagaaaaaatactatttccctgaatcttcatacaggtaaaaaataaaggatttcacaaactaaagataaatgtataggtaggcacggtttcctttttaggtattgtgggaaagcaaagggatactatgttcagggaatctcttaaatcacagaagttcaattttctgatttcatagttaaatttaattttgcttttatttaacttttttattaacttcaaatttcattagtatttgctttttgttagaatttcaggtatggacaaactttctcatgcaacttctttaggtaataatatgataggtttttcagaataacccatgattcataggatgaatcaagaagtaaaagttctctggcaggtgggaaaaataatgctagacactaattttgtgtcctaaatgtgacttctgaagttatctgtgatcactttgctacctacaggaaaacctgtagttctgaaataatcttctattgagtttctcaaaacttctggtaagtcagaaactgtttttgatcatctgtttgtactcttgtgtaagccattatttaatacccctgagagctctaagttacatcttcaactttatagcattaccccacagaagatatgctgatctatttttaagtttgctttaaactattgttttttagtggaaaagtttttcctggagtacaacatggcacacactttggcacaaacttgtgtcatcaggtttgatttaccattgtttttcatcagttatatttagagatgggctatgtctcagaggaaatgctgtagcaactcttcctaaaattccaacttctcaatcaggtatatttgcataattgcttttgcttttatttaattatgtcactgtatcttctgggttttccttggattatccaggacctctagttctcacatcatagggcagtttgtgtagactagatggccctgttctgctgctagtggctgtagcttagtgcttgacttggaaattaataggctctgacttgcctatttacttatttgagcaaactacactcatcagaactaaatgcttgtcatttttcctttccccctctcttcctgtttccctctgggcagtgaactgtccagtggctaatagtgttaagcaggagcccgggccactgaggtttgactggctcctggccttccaaaggggctctcaatgtagcccatttctatttgctggtcttgcctctgcctcttttctcttttttattctttagttttctttctttctttccttccttttttttttttttttttttttttttgacagagtctcgctctatcgcccaggctggagtgcagtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctcgaactcttgacctcaggtaatccacccgccttgtcttcccaaagtgctggtattataggcatgagccactgcacctggcttgattttcttttttcatgtgtttcctttctagattatttgtcttctcttccttggtgttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggatcattttttttttcaacatgaaagcagttggtaggaaatagagataccagaatcacctgaaatgctttcttccaaactatataccttcccgtgtttgtatttgagctcctcttaacaaatctccctctgggaaaagataagcccggttgtggagagagtctttccttagtaatcttcatgactcacctgtctctcctgtttttcacataccattgcctgaacactcgggttgtctcaatcctggctgattgtggttttaatgaaatcactaatcaaggcccatgatagatatacgaagtcttcagggtatttggctctatcagcgttcacgctgcctgaaagggtgatcagtcttcagggatctgttatttagtgccaagtcttccttattaagaaatactggaaagttgtttaacattctaaactttggcctcctgtaaatcagacacctggatgattgatcaaaatgcatagacaaaatgtggcttttcattttagatgcaaaggaaacgtcagccaacttccatgctgttgtagattggcttttagctagtattgcataaaataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagcaacaaggaataaagaaacagaaaatgagttagtattaaagattgtctttgttgggtgtctatttttgttaaaccttacaaatccaatttaaaaactaaactaacgcatacctgacaaaatattcttacatttctcagtctctactttagttgttctttgacccttttctccccaaagtaactattgcccaaattaagcttcaggagaaaacaaaatcaagaacgacaagcaacatttccaaaattatataaactttttggtccttaatgattttgaaacagagttgagaggccgtatagttcaacctacttttgtttttggtttggtatttaacttttgtttctctatctgcattctctccagattctgaaaatgatcagaagtgcagttgaagggctctctctttcttaacatcttttaaactaataaaagaacactctgttttccttttcattatcgttcagacatcgcattcaaaaggtttctaaaaatactaaattagaagaaatcttgtgctcactagccttaaaagctctacaagatcagagcagttcagaatttctaatgaaggcgtggcacggtggctcacacctgtaattccagcactttgggaggccaaggcaggcggatcacaaggtcaggagatcaagaccatcctggctaacaaggtgaaagaaaccccgtctctactaaaaatacaaaaagttagctgggtttggtggcacgtgcctgtaatcccagctattcgggagactgaggcaggagaatcgcttcaacgcaggaggcggaggttgcaatgagccgaaatagcgccactgtactccaacctgggcaacagagcgagactctgtctcaaaaaaaaaaaaaagaaaaaaagaaaaaaaatttctaatgaaatatattgttttgcccatgtcaggtttaataaatccattttatagcacccataatttaatgaaatgcaatttatttcatttgtagaaaataacactcttctgggggaaaagttgagggaggtgggaattaatttttcttgcagtataatcatctttcatttaattgaagctttaaacattaccatataggctgctactttagcttttttggttaatctgtaattagaagatagaatataatacaaacagaagctcctgtatcctcttgtgttttatttaatactgcacctacaaggaaagtacataccttgcaataatataataccaataagtgacattgttaactgtggccttatttgtcttcagagctgtaattattggactttagtgtcctagtttctgatatcaacagctactttgaagaattaggtcactgtgggtaacgagtatgtcgtgtacatttcattggcgcaaggactgtgttctcctaggcaggtgtttgttagcgagttagtatgtatgtgtgtgtaaaccatgttttaacccttaggggaaacatcttaaatgcaatacttctgccctgttttccaccaacatattataaagtattatatgtaatggatcttactcaaagaaaacaagcagcctggaggtaaaatgtaatgaactgacatcaaaaagtatggaaggaaagactttcctttgactgaaatgactgattttcttgcatatttagcaatcgaacagagttgcttagtttttctctgagcaattttgaatatataaacataagtggatttataacctgactcttggcttttagagaatcaaaatgagcttcatctagttaaacatattaggggacttcaaaaagtttgtggacaaatggaattaaaagataaaaattaaaaatataaactatttctcaacataagcttcatcaagttcatgacgcttttgtaagcaatgaatccagctactcagtccatccctaaggaacagagggtcctggaaatttaaccatgtcatttcagtctacttatattattaagtaaaatgagtgcccattaaatatttttttaagattaggaaacaaaaagaagtcaggaggagccaaattagcactgtaagtgactgcctaatgattttccattcaaactgtcacaaaattgcccttgtttaatgagaggaatgagcaggagcattatggtggagaagaactctgatgaaactttcctgggtgtttttctgctaaggctttggctaatgttctcaaaacattctcataacaagcagatattactgttctttgggcctccagaaagtcaacacaccaaatgccttgagcatcccaaaaagctgttgccatgacttttactcttggccagtcttcttttgctttgattggaccatttccacctcttggtagccattgttttgattgtactttgtcttcagaatcatactggtaaagctgtattccatctcctgttacaattcttcaaagaaatgtttcaggatcttgatcccacttatttaaaatttccattgaaagccctgctcttgtctgcagctgatctggacgcaatggttttggcacccattgagtggaaagtttcctcaactttaatttttcagtcagaattgtataagctgctaattgttagttctcttcagttagagcaggagcaaacttaatttttttcttgaaaattggtgtagtcttcgtcttctacattgtcccatcccttcttaaaacaatttatctgttttgtaaagtgctgattttcttggaccattgtctccataaacttttcataaagcatcagtgatttcaccatacttccacctaagcttcaccataaatttgatgtttgttcttgtttaaattttagcataatttatattgctctgataggggctcttatcaaatccaagtctcacccttcttagtgctcaaactagatcctgttcagacatgttacaataagtaagtatgagtttattttgatgaaatccatgcatagttttttcatgatatgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcttctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgatcattccctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgtttgaccttgcacaggttactgccaacctggctttggttttatcatcctgaaatgttgacagtagtaaaatcagcttcagaggatgtttggagtattcaccgagtaaatatacaaggaaccttacccatagtgagtgttgtatctacttacaagagtgagtgagccagatgggttagatagtttactattataagacaaagcatggtcattaaggattgggggaattggggaggatttaatgaaggaagtgagtcactgagaggctaggtcttagagaatgtcacatgaaaggcagaaaggaggaaaagaatatcacaatgtgtgaaataaggttgtttagaaccccactataaggatttgaagaactctttgtcccttatatattttttaattgacttgaagtttttctttatacatttaaataattgcaaaggatgttattttggtgtattgtacatggtgacttttaaaaataagcatatccaatgggcagtggtactaaatcatgtgttttttaaaagcctgcactagctttttctttaactgtcggaaacttcacatcattattttctccttataattacattctatttctccacagaatgttatcttaatgtagtatttttgtggttcagagccttgttattggtcagtctttcattacttctctaaaacaaaaatcatgtgtgtgtgtgtgtgtgtgtgtgtgtatttatgtatacagttttaaaagtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggagttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtggacacagcacatgtttcagagagcaaggggttgggggtaaggccatagattaacagcatcccaaggcagaagaatttttcttagtacagcacaaaatggagtctcccatgtctacttctttctacacagacacagcaacaatctgatttctctttcctttccccacacgtcccccccttccactcgacaaaaccgccatcgtcatcatggcccgttctcaatgagctgctaggtacacctcccagacagggtggcggccgggcagaggggcccccccacttccctcccggatggggcggctggccgggccggggctgccccccacctccctcccggacggggcggctggctgggtgggggctgtcccccacctcctggagggggcggctgccgggcggaggggctcctcacttcccagacggggcggctgccgggcggaggggctcctcacttctcagatggggcggcagggcagagacgctcctcacctcccagacggggtggcggtcgggcacagacactcctcagttcccagatggggtcacggccgggcagaggcgctcctcacatcccagatggggcggcagggcagaggcgctccccacatctcagacgatgggtggcggggcagaggcgctccccatatctcagacgatgggtggccgggcagagacgctcctcacttcccagaggggatggcggctgggaagagacgctcctcacttcccagactgggcggccgggcagaggggctcctcacatcccagacgatgggcggccaggcagagacgctcctcgcttcccagacagggtggcggccgggcagaggctgcaatctcggcactttgggaggccaaggcaggcggctgggaggtggaggttgtagcgagccgagatcacgccactgcactccagcctgggcaacattgagcactgagtgagcgagactccatctgcaatcccggcacctcaggaggccgaggctagcagatcactcgtggttaggagctggagaccagcccggccaacacggcaaaaccccgtctccaccaaaaaaatccgaaaaccagtcaggcgtggaggcgtgcgcctgcaatcccaggcactcggcaggctgaagcaggagaatcaggcatggaggttgcagtgagccgagatggcagcactacagtccggcctctgctcggcatcagagggagacggtggagagagagggagagggagagggagactgtggggagggggagggggagggggagagggattgaaggagttttcttataggaatatcattcagtactttgaactcctgagttagatgccataagccacagactgatctatcgtcaaacattaattttaatcaattatttttaaagatctactgcctgacaacctgattaggtatgctttcaattttggtgaaagcaagcaattggaaaccatgtgttttgcagaaatatttgttgcttagtcattaaagtccagtcagacaccaatatgttgaactgtttttgttcagtacccactaaagaaggtgagagatatgctgctgcttgttttattttttttataagttgggagaagaaatagagtggtggaaaagaaacatctgtcatggaggcaggtcattatgaggaatcttttcctgcctaaaggtgccttagaaaggagcatgtttgggaaaacaggaagtaggtaagttcagagtaactgccagtgccacagatgtgcagatcaaatatcatgattagttcagccaacttctctcctctgtcctagaccagcccaagcctgggacacggggaaggcaccaaaaaactccggtgttgtgaggtattttattcacctcgtaggggagtgttttagttagaccttatttattttatctattttgaggttaaaactgatgtcggtattatgatccctccaaaacagagcttccaaaaaattctgttgtttcataacattagtactttaaaaaaaaaaccaaaaagcctttcagttttgttttatgtttttcatttattatgtcttcttcaagtatatcatagtttattggtataatctttacccaacatttgcaattcatatgatcaaaatgccatacctttcctattacagatttagtttttgacattttcatgagaattattgaaatgaaaggcataaagtaggtacactagtgcctaactcataagttattggtaagtaatagtagctgtttatctagtagtgttttatgaatggcacaaagcagtatatcatcattttcttaaatttgtgacttggaatgaaatttactaaaatttgtattcatgaaagcagatgttaacattttcacttgtggagaaataatcaatatgaacatttacagacccagaaatcggcagtgactcagacgataaattagatcttataatgaatggtaaattgagtgagtcaacatggaaaaaaagatcatccagtagtgggaattattaccatttttattttggtactttcagatataagtacagttttttttttaaatatggtcacgataatattttctttttagaaacatttagatgttgacttactcagtttgtcattgttgtgagaatttcatataagcatacttatcgaattaagcagtatatgttaattaataaccataagcttgagctttaagctaagttggataaagtttacaaaaacatcactaaagtaagtgcataatagcaaaggtatttttatatttttgatgattaaaatacaaaacaaaatgtttcccatattgaagagggaatattcaaaatcagaagccctagttttttctgatagctattattatcctacttctgcaacaaaatgatgattctgtcatcctctctgctcagacacagattggaggaaaggagatgagagcaacaattagatagataacaaggttccctttgcctgagagccagtatttttaagacactcagacatttctttgaatcttagatgggtgttttggagatttattttatgtgatttgatagctatgttaaatttcagttaaacttttatttgcagacttaaatatgccgcttaggattctcgccatcacttgtctttttcctaggtgaccgtgggccatttgctattgtccctcttgatctaatgagttgtcctaatcacattaggtgccactgataagatactggactttgctgggatatgagtgaggttcttttttgtcgtttttcccaagttgttgcctctcactcctataactggttgagtgtggtgagagtggtgtatggtttatgagtatattccttggaaaagtatactttgcatttcaaaatagctagaataaaatgatctggagaggtggagagggttgagctaactctgagattctgcaattcagggttgaattaggcggcttcagataaattgttgaaggatctgagagagttggtggtacagaggaagtaaaagcctgggattttccaaaggccgtcattagttgttgctcagagctatgactccagggtttccatttgcattttttggagtccttacaccctcatggatgtttcttttacctcatatttcaggcatggcgtgtgtcgggcttgccctccagtttttcttttaataataacaataataataattattgttattattatttttgcgatggagtcccactctgttgccccaggctggagtgcagtggcgcgatcttggcttgctgcaacctctgcctcctaggttcaagtgattctcctgccttagcctctgaagtagctgggattacaggtgcccaccaccacacctggctaatttttgtggggtttttttttagtaaagacagtgtttcgctatgttgggcaggctggtctcaaatcctgacttcacatgatccacccacctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacgtgcaccacacggtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcagctaggtacagtggggaggaactgctgtgcaatagagtatctgtctttaatattaaatatgtattactttcttggcttctaaggtgagtgtgccattttaaaagagagttttgggttgttttaaagagtttttggggtctggaagcctcttgtgctttatttcactcaaatagctcttgcaggatatcagatttcagttcagtgccctctgcccttaaaaacaaaaacaaaatctggaggtcttctctctactcgcttactacaaggcctctcccagcccttggtcccagagtaacttgagccttctccaatagttggtctgccagtgagacatgatgatgtagtagtttagtcctggttctgccagtcttgtccttgggcgagtgatttcttcctcagcttagggtcaggaagaaaggagtcattatatgtaaagcttgtagtaaacatatggtacatagtaagcatcaataactcttggctcctgtcattgcgacatagctgccacccttcactcagcatacgtttaccacccttcactcagtatacgtttattgtacatgtctacgtgctgggaacatgaagataaataagacatggtctctagccttagggaacttatattctaacatgcatgtaacatatatgtaaaatgaaagttcttattctctcatctttccagctacttaaactttatccatagcccagtttactttcctcccatgtcagctaacttctgcatgataaaggacaggctttcatatcttagctatttctgtctaacagtgattcagtacttaccatgtaccccaaatgttgttaagaactggaatgcaaagatggtgtgtaagacagtctgtatctgtgagaagctaacattctgtagggagattaaaaaaaaaaaaaatcctagctccgggtgtgagactggaatctacagcatctatagaacactctgatgtagtgggaccttctgaaggactctttttggcctttttattaccacttttcacctgtgaactggctctgttctaccttgcgttgcctatgcaaataaggataaacaaactccattctctcttccaagggggagagaattagcagcaagagggcacatatttctctttgttaaaacctgggaatggcatcactcctttctttccctagtgactaatcttgtaaagtgttaaagagaagtctaagtcccccagagggacttagaaagccctggccattcatgcccaggtggagccactttagtaaaaaaaatagcatttttgctgccatgtgatgcacaggtaaaacagaccactggatactgctggtttgcattcctgcttcctgggaagttctcccttccatttcatgagcctctttgggaaaggtacaaacttagggaattactgacacagaataggaacaattggcaatcctttcactctttcacatatactgatctttaaaaaaataataaattatcattgagaactcagggatacctccttgcttttatgaccattacaggttttgtttggcttgttcataataagcatattaagtttaatcttattttaaaagtctgtcctgatacaaactttaaattgatatcttgctgaattgtgaatggacataaaggctccttttaaagagctttaagtgtttgttgccacaacagggtctgagtataatactgaggttgagaaagatgattttctcaacagaaatactttattattgctagaggtagtgtgaaattatcattttttccttgaagcatgttcttttataaatgctttctggagatacatgaattaaaattaatgatgttctcttttgttaaggctttatttcatttcatgtattctgttgatctttgagacaatatctaatctagagagaagaaaacataaaatagtactaaaaacccaatgaattcttttagtgaattagagtttacttcttgtcatcagctaagctccctagtattacgtgaatactatcatgcttggtgctacattttgtgttttggatgtttttggttcatttgtagatgcttatcttttgttattaaaattccatatacatttcattttggctttacaaaactattttggttaatgtaagcatactgaaaagagggtttgcatttagagtgatgcatttcgtaggtcagagaagatactgttatttatcatcagctatatgtgtgatttctttttcaacttcccaatagtggtggagatatttgggtcatctatctttgcaggtccttgtaataattgtcatcaggaaatgtacatgtgtaggtaactggcaggggttagtggttcagactatggccattaaaaaaaaaaaaaggcattagctgggtgcagtggcacatgcctgtagtcccagctactcaggaggctgaagtgggaagattgcttgagcccaggagttcgaggccagcctgaacaacatagtgaggccctgtctctctcttttttttttttttttttttaaataacattccgcatttcctcacccatggagatggtactcataatagttttatgaatgtaggaagaaactgaagttagctccattcaagttggaagagcagtatataccggaaagaaattcagtgagcattctgaaaattctgatcctagaggcttcagcccatttaagtgttaatttatcactagattgttatttttattttagaatttccattgtacttttcagataaatctatggtgcctacactaacagcatttacattctttttttttttttttaacagaaatgtcttagcctctggaaggccattttattcactaacacatgctaggaggcttcagcaatatcctgctccattctagaaaacagcaatttgatccttttttcctcctcagtcattaacaagattatgcatttgcggtgagatgatccttcttgaacaagtagccagaaatcatttgttccagtttcttctcaaggtgctgaattaagtctcgtctcataaatcttgtggcttccttgatgatggattcaaaaaatcatttcttgacttctataggtccttgcagtccttcaagcaatttgaagagtttttcatattttcgtctaaagtgttgaatttccttcactaattgacattttatatcagcattaatttcttcttgacattttggaaaagggagtatttctgtgacttttaggtcatctccagagaaattgctggtaatgattcctcctacaggtgcatttctaccaggtttctgcatcagcccatctttgctgcaaccactgaagtcatcaaaccgagaatccaattggcttggtggaataccatctcctgccataagcttcttttccttggacatggcagagcctccaataaggctgtctcctgctctttgtttccttaacaacagggccatcttctgccttttctgagatgaaggagtctcagattccctgggacgtttaaacacattttcaggttctacagcaaccttctctgctttatcagtcattgtttccagaaggaccgatccagtatggcccaagggggatggaagggaaactgcctgctatggcgtgccctgccccagccaaatactgggaacactgggaacctgtgtggtgcgccggagtcctgaggagaagccttgtgttcagtaggatcacgggtgccagccccgacaatcatggggcctgcatttacactctttcccacaaacctcacagagttaaacttcctttctttaactctttgctgtcaccttctgctaagctctggggattctacttgtgtcctaggaaaaagtcttccttactcctttcctaccttatgcatttttccttttttcctttctgaacctcagaaagcgtcagctttattgaatagaatgatgtcactctttcttcttatgaccactttcctaattgctctctttagaaggtcctgtaatatctctctcgcaccgtttttaaaaaaaatttccataggttattggggtacaggtggtatttggttacattagtaagttctttagaggtgatttgtgaaattttggtgcacccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaaccatctcattagatctcctgtctcttttcctagcaataatacactgtcacttgaaccagcagaatgtaaactttactggctcataatttctggtctataaggagagaatggtgaaaaagtgggctagaatggctctttggggaatggtggtgcagatgagaagtggactggcctgtagctgggcagcccttttttcatttcatgtcctgtttctcctctagaactcagagaatcatttacatgttatacatcatctacatttttctcatcccagctgcttcattctttagatgaataatatgctcccctgaataagtgctatctaccttctgatagtttttaaaaagaaaagttaaattgtcatagcatttattatatgagagatgttaagacaagaagtagaaaacaagaaaatgtaactttggaaagagttctgtatagtatatttcaaaaaggtgaggcaagtaatttctttctattaatccatatatatttttttaaatttaggaatagaaggacagtctgtggaagtttccaatattgtggacatccgaaaagtatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcgggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgtatttttagcagagacacggtttcaccatgttggccaggctggtctcgaactcttggactcaagtgatctgcccacctcgccctttcaaagtgctgggattgtgggcatgagccactgtgcccggtctgtttttgtattagcccactctcacactgctatagcgaaatacccaagactgggtaatttataaaggaaagaggtttaattgactcacagttctgtatgactggaggggtagcctcaggaaacttacaatcgtagaggaaggggaagcagacaagtcttacatggctgcaggcaagagagagaaaagcccaggggaactgccatttataaaaccatcagatcttgtgagatctccctcactgtcaaaagaacaccatggggggaaccacccccatgatctagtctctgcccaccaggtctctctctcaacacctggggattacaattcaagatgagatttgggtggggatacaaagtctatattagttgtcctcataaggaattgatccatacctattaagtttgttccctatatattggtttaatgtatgatctaataatgggcccttgtaaatttcaggaaaactcttcctctatatgtgtgtgtgtgtataccattatacatacacagacacacatgtatacatatacataggtatatctattcagaaatgggcaggtatatatttaatcaaaattttcatgaaatgtttcaaattgtagtaaggaaattgatttatacaatcttatcaggttgtcaattctccaatttaatagagcacttttgattgttacctaaatctctgttttctgagtgtatgtgtttgataacatatctttgaaataccattaaaaccatgagcatgtttttaaaacaagtgttttagaaatttctggctgtgaatagaaataattttacaataaacactttgattttcaactgggggtgggtgaaaaagattttaataattttctcttctatgatttcctgcaaaagttaaatttaaactttttccaaaacataaaaattgcagcatacattctgaattagcatgttaattcgactacagccatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtagtacttgggcaaaactaggtatctagctccaccagtggggaatcggggtagcaacaacacgattgtggtagttttacattttttaaaataagtttacatttacaagttaattgggtttggaaaggagaaatagagaattcttttaaggtagctttacttttttttttttctttaaacattttacagttgtagctttatcagtttattaatttcccaaggctgccatacaaatggaatcacgtaaaacaacaaaactttattctttcacagttctggagactagatttctaacatcagggtgttggcagggccatattccctccaaaagctatagggaaataaccttccttgccctttcccagcttctagtggttgcctatgcttggcattccttggtttgtgtatgcatcactcccatctctacctcttttgtcatacagcgttctccctatgcctcttgtatctgtctgtctgtgtccaaatttctctcttcttgtaaagatgccagtcattaggttaggtcccaacataatccagaatgacctcatctatttctgcagaggctgtatttcaaaataagatcacattcatgggttgtgggtggacaggaatttgagagagggaggcattattcaacctagtacaaccagtaatttgagggagacattgcagggttgctgggaagattaaagatcacatttgtgaaatactccggaccatgcctttcgttaatgggcacttaatacatgttaactattacggtaactttgtacctcttcttttcttcacttttatatccaactttcatgagtttaaatgaggagatgacatttttatgtggtatcattaagattcactgataatagggttctgagcttagagtcagtcactgtgacccagatgggctttggggttaccgacagtctttctcaaaaagtagagtcatatttcaaacattcaggtactaggctgcaaggaattggaatttggaactatctacattgaaactaatcaaaaagagtaagcactgaatggtttttaaatataaatatgcatttgattttaacataatatcttagaagatttggtgcagagacctgtggtatttattaaaaccaattcaagaataataagagatatttcttgaaaggggatagagaggtattatacttagcattcattacaaaagcagtttgttagatttagatgagaaatgaatacttaatacctttataatttgttttatgcaaatattggagagctagaagacttttaagcatttttattctgaatttaaataggaatgcctattttaaaaatctggacaagttctacctttcccacctaaaagttgttttctaatatccttgtggtttttcttcatattgttttaaataatgttttaatttttaaattatttcttccactgaataaaaaggaagctttgtctttttctcttgggaagaaaaatcacctgtcctcaagtttttaaaagaacatatgtaaatatcactttttgtagatggaattgttgtgttttatagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtatgtattgcttacactcttttccactctgaaaggtttcaattccaactgtatactttttctgttggtcagatgtggtataatctctagttaaaacctccctgtcttcttttcagcttttttctttcaacaaccagactattagttaagtttgggttttgtgagaacaacataaaaagatgaatctcctaaatcttcagatgaagaacaggagacctaaaattccatgtcaagatttctttttaaagataatttgcttctcctaatagtatgtattttgcagaggtctccatcatcattatgatttaacggatgtggaaactcagattcagaggtttagataagttgcctacgtttgcaaagttgggaagttgtggttcaaacttaggtccttttctgaatcatggtctttctattctgctaccacctgaaagaaggaagggagtagaaatgatagagatatggggataaagaggtgtggctttgaggattccaaaagagagaaagtgatgcgcagaaagtgagagaaaatagtcaatagacactgattaatttttgcaagtctttctattgagaggctttgatcctttataatacatatttttaattggttatcatacatggtatcattggtcttcttacattctaagagttggtagagatacatatctgaaggagccagataataactgagtgcagattcctggtgtgtcctttgacacaagcccactttttacatgaggcgtatacatgcattctgtatcttacacacacacacaaaaactgctacttctcatttttctttgtggccttcattagataagatcatataaactcatgccataaagacatgaattcgattttgaaagtagtaatggttccacatcagggatccagtagggagggttagagacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatacaattttttaaaaaacactatgttgagaaaacataaaacatctttgtgccgtacatgactcttgagccactcatttttaaacactgccttaaattctcaaagctgtgccctaaatagaggactagacagtaagactcaagccgtggttaacaaagcagcattatctcacttcctggaaatgtgatgtacatttcctaataaacctcataagcatttttgattccaaatggtgctactaaaagtttcggagaacttaatttactctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagtgggttgtataaatccacctccttgactagagaggaaatttagagcaatacatcatgactgctacttaagtgatgctcaatgaatgtcagtattaaattattctggtcagttttgcttgtttgtttgtttgtgtgttaggtcagattgaagttatcatggatcgaagactcatgcaagatgataatcgtggccttgagcaaggtatccaggataacaagattacagctaatctatttcgaatactactagaaaaaagaagtgctgttaatacggtatgaaaaaataactagcatgatctgatattgattgttctttgtcacccaaaacttgaaattatgactttccacttttaaaattttaaaaatcatttccaatattgagatttctttatagtagatgtggcccacattcacagaaagagaacttcagttataaatatcgtgtaagatttgcacttaggtctttttattttttatgtttgcttattatgtagataaaaaataatgacaggaaatcactttgggtaaatattcctgaaattattttgaaagacataagaattgaaaaattgagctaaataaaagttaaagaatagaacttagtcatatacttaggagattaaatttggtaaactttatttgaaatcttagtaaaatttatttgaaatcttagtgtacttattctagtcttagactcttcagttgaaaatgtatttatatgtaggttttctatgaggtttactcctcaaagcaaaaatctagtactctgtgttgaatggtctggcaaaagcccagctggacctgaatgacctgacgatatgcttgttcaggcaaagttatcttcagagttctccgtaagttattgatccacccaccttggatagccctgagcatgggctttttctttttgctctattctcctttctgcacctgaccattgcaagtcctttctgctcttttcagccagtgatcgtacctttcactttatagagagaacagccattagacagggctctctgttccagttatctaacatctactcccacccttcccatctctcctcctgttacatttaaaagacactttacagtccatcatcctaggcaggtcccaccacttgtccttggaacttactctcttcacccacctcagcatccttttactgttcattctctccctctctctttctcccttgctcctcatatccaacacttcctgggagattctttctgttagcttttgaacactctgttttcttctattaaaagtagaaatggaatacagccttccttcagactcttatttccatttcctgtaagctgctatcctcttctctcctacccaattgagtcagagtttatgagatgagtttatttcatcacttccttctcacaatccatttgtttcagtctggctttagcctccatcatattctgaaagagctctttccgatgtcagtagatccagtgcatattgactttcgtcatcttacttcacctttcagcagtatttggcactggccattgtcactctctaaaatactgccttgccagggcttctatggagctatgcagtttggttttcctcctacctgtctggcagttctttatctctctaatagttctctactcagccattaaatcttagagctctcaaagcatgtcccctggccttctccttttcttattttttatgctatcccttggcaatctcttctactcctctggttttgtttgcatcttccacacaggtagaagccactaatacatatctccaacttaggcttgtgtctgacctcctgatttatctatctaattgcttcctgatattctctgtttagaaggacacctcaagtttgacatatccaaaacactcataatctctcttctctcccaaacctggcccattttcagtgttccccccagtcaacagccaccgccatccatacaactccaagacagacatgagttctgcctgatagacacttctccccatcagccttttctcacagagtaattgccatcacctatctatctcattgcctgaatatttcaaatttataatcttctttacttccaccaccctaatctaaagtgacttcctgtatttcctgggtctagcctatacacatccaccctgttctctttctgccgtatgtctgttcttaacccagaaggcagaatggtttttttttttgttttttttcaaagccacatctaactttattgcttcctgttgaaccctctgatatcttctcattgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgcttacttcatcagctgcttctggaccaggttaaaagcccttcccctatgctgcctccaaactgtgcatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatttctgcctattaccttgtcttcatatgcatgttgcattcctcctactagattccagggacttgttgccttcattttcatttgtccttatatttggtagacattctttaaacaaaatactagttgattgaatgaaatagcaacagctaattaaagcaaaaattcttccagtatttagaatattttagaaaaaagaattagtatccactttagatgtcaagagccataccattcttgagactcatattttaaatcaatcactgacaagatagcttagttttaaggactaaatctgcataggaaaatcattgtctgagtgctgacagctactgtcttttgctcctcctgaaaaagtttctcgcttatatgactttatattgacactaatctataaaacttctgttaactgcaataataaaaattttcacatcaaatctataaagctttgacttagaagtgaaataatttgtttattcccattcagaactccttggatagtaattgatttaaatttaatttaatgtttttatgttgattaaatttttcttttactcaagtatagattctgggtcttcaattaatggtttcttttaaataagaaatgaactagagaagagaaaatacattttaatgtctagtgaaaataattaaaaagacacttaattgatgaaagttaataccatgtaacttgaattttctagaaagagttcttaatttcaactcagactcaaatatctaaaataatgatggagggaagtgaagtagggggatactccctgaataggaagagattttaatgggaagccctgagcatgacagagcctcatggaaataatcccgagctgactaagtggaagtaagtcctgtcctcagagaattctgcagagagtcagtaaaaacaaggacttggatgatatccactgtgtaatatgtgcaggtgtccagtgaggactgtggctgcacgaggttgaccatcatttatgctaatcatcctcaaagccaatagaaatggaaaataggattcatctctttggcattgccagggtttgaatgtgtcccccaaaagttcatgtgttgaaaacttggctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagcagaaaatggactaaaaacaggcattgacggctttaggatttgtttctttgacggtttatccttacccctttcctgctactggttggttaatgaggcactgagctaggaaccctgtaagtgttcaagtgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgaggttgcttttttattatgaattttttattaaagagttggcttaaaaacaaaaaaaaaaaaacattttaataccatacagacctaccaaaatgtgtgatctacaaatctgccccacagtcttcagctacagatacttacctccaaatgttatgattcaatgtattattcttcattttctctcctccttcctctttgtcttttttactccacccttcctctctagtgttcttctttcatttatttatattgcatttgcttattaaattaatagatttacttcaacagacatttattaagttcccaccatgtttcaagtcaaactgaataaacaagggtaacttaaaaaatggtctcttactatctcaccatgatttaacaggatcgtttaactcaaagtgagcttaataaagggcaccaagaagtctggcaagaagttctgactcatggactaagggctggaacccagtgaggaagagctgtactttgtgtggtttggatcagaaggtgctagaaactttctttaatgtcagacaggctgcagagagaaagctacacttatacagtctgaaaccttccaaccaacaagaaattaaataaggtttatagtactagattagttaagtacaaggctggggtattcatttataacttaaacacataaaatttcctgtagaaaacatgtttttaaaactttgggtttatcatatgatttacagtggaaaggttacctttgtagagattaatttaaatattgatggttcaacagttaatatcttgttgagcctcttgttgctgtaaatatgataagaaagtacatgaatggcagaactctgggtgagactttgccactccaacctggccagcctccagcagtgttattttttcatggtgctcttagggtagtgaaccacaactcttctataaacttccttatctttctaaggacagtaaactacacagtttttaaattcttgaagtccttaatatccatgacattgtttccttttagaagactcccatcaaaatgtctttgaaactgaatcttgtttttctaatgcaaaggtagttaaaaggtaaagtttatcttttgattctaaagggagctctgttttctctataagattggatgtctggggtggcacttcccggcacagggtcatggagcagtgtgcggctaactccatgaaattcacctggggaggcttttcagctttgcattttcaggaccccacctctcaagattgtgtagatttgggataggacccaagaatctatgttgattagaggtgccccaactcattctgttgtgtggttaatttggggaaacaccaacggttaggaagaactaatttggtttggaggattggtatatatgcacgttattgcttctggagtatagaagattaatcaggaagtgttctggctactcactggagtggtgaggaattactccaagagtgtggaacaaagccagagctttctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctaccaacattagtagattatttaatgtttgaacatacagaagtgttgcttttaaccatataccatagcaaaaactaaagcattttaaattatatggaataatcatatactatgtaagtgtgtgataactattcagtaacatatttaacacttctacttttggaataaaaatagtgaaacaattggcaatgatttaccaagttgaaagaaaacaatcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtatgtctcaaaatatatcttataaaaaattactgtttattatgtacttgttttaagggggtaaggaaaggagaaaaaaataatgtatgctttactatgctttgaggaattattaacagggcttcacctttagccaaaagcttcatgcctttcatttgactattgctgtatattttagagtatatcctgatactaatttactcttaagttctgtatggcgagcaggtcaggaaataccattagtaggtgggcaatctgggccttaagtttagcactagtgacttttcccattcatttctccttgttagacaatatctctcagaagctagagaaatagtacttagttatttctatatcagaggctttgtattttcgtacctttctcttgagaatcactgcaactcagtttcccattagaaaaccaactgtttagaagaaatattagaggaaaagcatggggaagttttattaggtatgaaatttaatttagttagactgcagttatatacatacctgtttttaacatcaaaaagattgcatttggaaagaataagaattagacatttgacattgttcttatgtgttgcaaagctgttttgatattgcaaattgacatagatttagctggaaatagtaagtggttatggattctgtggaaaatatctcatggtaaatggcctaagtatgaaaagaagaggatgctcatgtttaaagacaatataagaggtgagaaatgtttaatgtagaacaaagaactaaagcaataaagtaaggataaatgcctataatttggatattagagatttacaactttatgtctaagatataggagaaaaaatataatttttttttctttatagatttttagttgagacaattttgaaagcaaaggtcagataaacaggggaaaaatagcaatagtatattgtacatgctatacctgtcacttgggagaggcctaagttcaaaagtatttttttcccaaggcagtggttttggcaccttgcctaaataatgttttaacaaagagccataaatcctctagagacaagacaaagaagaaagcaccttcaggcttccaaaaggtaggaaaatgtgggaggataaatttatgggaagagtgaagtctgctcctagatgctctggcactgctgtctcttagctaattagcaagccttgtaaaggggcctgtctttagactagaaaaggcagagaggaagggatgaagacctcttgtatttgtaaattgctgtcctgccatcaagcaggcagaagaagggacagaatggccccctggtttttttccttcttcagctcaataatcctcagttttttgagagagaagtattttggtttccttcagagataaggaacttatgcttggctatgcaggcaaacatatatgacttataataatgactacaagcaaatgctcgaggcgtgtgtgcgtgtgtgtgtattgaaaggctttttaaaatcattatcagtgaacttgcaggatttatttcctacccactacatgtcagttactgccataaaacacacaaatgcccctgcccttctagagcttagattctaatgggaggagaaaaacaagaaaaagtaagagaaatatgtaatatgttagatggtgttaagtgttatgaaggagtaaaaagggaacagccattcaaaggaggtaacacaattttgattaaggtgtgtagagagggcctcacagaggtgataatggagtaaaaatctgaagaaggtcagagaataagagactcctgcagatttctgggggtagagtgctccaggaaaagagcaagtgtgaaggccctgaggccggagagatatgtggccagaacagaagctccatgagagctatgcttgtcctttattcatggctatatccccgtgaagaagagtgtctgcacataggatctcaaaaactattttgaatcagtgaattgtgtagatgttttttctaggattctgctgtggttttttgtaggtctacattttggctccccgaggtgtcgtgtcataaattcatgagctaaaagaaacagaaagaatagagtggagggcatcaaatactctgggcttgaggttaccaccacccagcatagatggtagaggacatcagcgacctgaagaacccagaggcttctggggaggatgggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcctggcctctacttactgcagccacctggcttcccgttgctcttcgtgcctttggacaggtgggccaccctccctacctgtgggctgagtgactgctgactcagctaccatttataacatgaggctaatgtcacgtattgctgtgtcaggtcttttgctaaaaacagacgaaatcctattgtgaaagccttttgagaacaaaggcactctgtaaacataccttgttatcctaatgacacttactccaacttggttgcagattagggttttagcagagggaatagagagcaacttaacaacataaagatttgaccaagaagattaaaaactgaaatgttaataatgcctattgataactaccatgctggctcataatcagaactaaatacttggcagttttgcattatcatatcagttggtgccagttcctgtgttagcctttgactcttagcacatatttataacagttgtttaaaagcccactagtaatccaaaggaaggactggtccattcaaaaccacttctttaaagaattccctaacctgataatagaaggataatcattgaagggaactgttgtgggtattgattcaaagaaagctgtacttacaaaatgtccagtgtaattccatgcttatactaaaaaaaaagaccaaaatgactcaatgaataagtacagaagccagacctaagcattttggtttgggttcctgtttctgtgtgctggaagcttccaatgtgcaataatgggctgttcatttggagaatgcaactcatttttccccttgaaataatgtcaaaatagacataggttccaagcaagacctgaagtctgcattggcctgtatttaagtaagcatattcctaaccaccacagtatttcatgagaaatgtgtctgaaggccaccttagcatgataaggacgcatgtcttcctgcctgaccaactccttcagcaccatgatagagagtgcccttgcttggccctctgggccgctgtctaaaggtttctcaattctaaacctcagttggttttcttgactcctgggataaggggttatagattcgaagaacagtgagggaggcgagttgcaggctgcaggtatgacaacccactgaggtggttcagcagttccagctactagtcctcaaattcactgtgcccggatcacacaggggagattttaaacatagagacttttacagatttccagatctctgagattctgattctatagggctggggaggagagcctaggaatttgtaatttttaaaaatgtttctcatgaaattgctgagttatctccatttcctaaattaggaaagtgagagttagagctaagttaaatgataaaaataaaatcacccagtggtaaatggcagaatcaggcgttctgaatctcagtgctgtgtgtggcctcagagggtagcatttgacttttttagaattactaaatttgtttctaaaagtccaagctttcagggattgctctatattagtagatgagtttacattttatatagacatatcttgcttttagacagacatatcttgcttttctgctttatatcaatttttggaaaatgattatatgccgtatatttgtattcagatgaaaaggggaacaaacatctctggaagccctgcctcacagcatgctgcgtggccttgcccattccagccactatctacaaacttacccattagctttcctattctgttggcctgtctttcaactcttttccttgatcacacctttcccctacactatgaagatcttgagatactaaaaagaagcttctgtaaaggtttgaaacctagggaacatgaacaccactgaaatacactacatgcaaaagccttgtcatcaggaaaggaccattatttaagaagaagggagattgggtagagaagatgcagggaggatctcatgggaggacagatgatgagtcaggcttctgaagctggagctgctggttcagcctggaatagagggacaaagaggaagctggataagctcagcttcatggagccattctacttggaatactttagaaatgtgatatgtagttcagcttttttttttttttttagattatttccacagcttttatatttagacatatttattttatataaacatgatatatatatatatcttaactctttctctatgtaatttattttgatttgtgtttaactgtttcttgcaaatagttaaccatcatttcaatatcagcaccacttactgaataagattttctctctccacttgttcattctgcctcttcttttcttataaaaggcagtttgaggattttactttatttgtctttcttataagaattgattggtgctttattgatctccctagcttctggaaaggtgaaaattgtgagaaaaaaaaattcctttgttgtacgtatctcagaacagccatttaccttccctttctttctgtcattttatcttgttgatcaaaacaggatagctattattggacattttaatgagcaccctaaaaaatgaatttctactggttataataccatcttaggacttataatgaagcatgtaattttctaacctttccagctgccagaatgcactagggatgagtgttaggtattttcaaagaatctgagtgggttggagaaattttcccaccagatgtgtagccgtgccttaatctatgtgcaccttactaaccgtgtgaagagggtggggtcccatgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcttggtttctgaattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagcaagtcacttaactctctgagtgtcaggctactccttagtaacatggagatggtaataatactcaccttagagatgttctgaggattggagataattttagtgttagtaaagcacttagaacagcatgtggcacatagtaagccctatgagtgcttgacaagtaaaggttctcacctgtgatagttcagtcatgaacaacggcagttgtcactaataatgaggtaaaaacattgccagagtaaatcttgatgtcactttgacttattcctgatattttaggttggtacaaaagtaattgcagtttttgctattaaaagtaatggcaaagctacaattacttttgcaccaacttaatactt

SEQ ID NO: 1581 - DNA, 175902 bp, Homo sapiens; identical to SEQ ID NO: 1580

SEQ ID NO: 1582 - DNA, 930 bp, Homo sapiens
ctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccat

SEQ ID NO: 1583 - DNA, 55009 bp, Homo sapiens
gttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaa

SEQ ID NO: 1584 - DNA, 65601 bp, Homo sapiens
gttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaacttgttttctcaagtaagttagttttctgtttaattcacacaatatcagtttatagcagatcctcaaaaatcatttaatacctgtgactacaatcaaggcatatgatcattctcagactgacaaataagtagccatcattagaaatgcagacaactgagtaattatggtgactgctcttccttcagacacacacctcggggcattgcatacctgggtaccagttctggatctggaagttaggtgacaggagtagatttcaggagggcttgggagcacacaactttaagaagacacagttgctgatgtggtgggtagccatgtcattcccaaggctgccacttcactctcattcctttcccctaaaagatgcagtaaatgtgagttcagcaaatgagtatttattcagataaagacgtgctaccactgcactctggctagcgttatggaaagtggccaagtcctgggggcagtcctgtagtcactcagtggaatggtcacctttgaaaatctggtagtggctacagtgtcccctgaacaaaaggcacgttcaactttagtgctgcaaacagttttggattcaagaaaacactgaaaccacttttagatgtcttagagcagtgtatctcagggtgttgtccctgacccagaaacttaggaatgcagattcatgggccccacctccaaagggtggttctgttttgtgggtaccccatgtttctgtttgggaacactgctttaggggaaagggatgatcaggtttaaggtggtgtgagagtgcacctggagatggtttaaatgttttttaagatacctccttgcaggcagttgggagaagataaagcaggggagggagcttggtggaacgggtgcaggaagaagggacaagctggatgtgttttgaggatgggagagcatcagtccagctctgcaggtggaggttgctgagcgttgtcctatagggaactttatgcataagggaagtcaggtttagagtcctcactactataaagtggagttggtcagggctgatttgttccgattgaaaaccatgccctttgctttttgggtttacatttagatatttcccatcagagatcatgaggaatagcagtgggatttttctatttagcagccatggtgtggtcaaagctaccaaaattaaatttgaataatatacaaagttcaaattccctggcttccccgttttccatttttaaggataatttcaagtaagagagatgtaagtatttctattacatgtctgatttgaatatgagagcaacctgtctgctcctaagatgtcaggatttgtttccattttttatttccaggagtcagattccttgttaatgtaaaaatggttctgtttcctagaagttttgaatctgctatggatctaggtctggcccctcgttcttgagcttcactcttaatttcccctgggtggaacaatatcgaagagaggaggatgttagccacttccattcccaagttggtgagaatttctataaaggacacctgcttcttggattgagggtgtgcagctgtcagagaagggaagaaactaccttaactaggctgattgacatccatgtaatatttactatgagacagggagagtgtttttattctcaattctttaaatttaaaataagacaggaaatgttagtgacataagggattgttagagaaaaaaagatgggaagatccgtaaagtgaatttgttaggggcaggagaagcctgacttggcattttcctgtttaggccaggagatattaccataatgcaaatgtgaaagcctgtgttctgtctctcttaatgcttcatgtcctcttgcaaatgagactgccttcagcacagctggaattattagggtttagtctacacttacgctctacaccagagtgcaaaatcttttgtgtcttcacaaggcttgttgatgcttgttgctgtcctcactgccaaaagaaaaggttggtgacctttggactttttccacttaaagtagggtgatactactttattgagtttatggggaaaaaattataaaggtgtcaggggaagagtttgctcataatgggatatttttaggaaagtgaaggcatgcctgtaggagctaatgggaaagatgtggtcagataaagatgctaccactcctgccactgagattacttaggaggtcttgtccacatattcctgaagaagggtttaattgtgtatttggtgtgctgtgtctgacatctgtgtttgcaggtccgtgtaatctaatcaggttgaccaatagaagattttaggactgaaggattaggggagtttagagactaattctttaagttttgtgtattgagtgatgacaggtggggaacaaatctaaatgttgattactgagcataggttagggttatgtgatccaaagcagtcacacatcagataggaagtagagccaactcttagcactgggtcttttcagttacaagcgaatcgggagagggcaataccagtttttcaagtgatgatgcagagaactggactggagatgtctaaccagcaaatcattggcaaagctggaaatttcctaggcattcgcacacctcatagcaacacataagctacctgctaactccaggcctttcagtgagttcagtgtgcagttgacaaagacatttactaggattcttggtaaccatttggtcttccagtgggcctggtgcagggggctccactttgatgacccttggccccatgtttacccagttcagcctcagaagatagttgataaagtgcagaagtggcttctgaactgctttaaagccattggccatccaagtaatagaagatattgatgcaataattagcaaagtcgactggcaagaggttgcaagttttgacttggacaccaatggcctctgtgccgggatgggttaggtgtgatggaggaggcaggacttttgtaggagttctctaggtgtccctcccactcctgtgggtccctaaccctcttcgatgttgcttctgcctatgttgagggctatatgtggaatccttcttatctgcccaaaaggagatcagagattggataaaatgtttaaagtacctattgatttcaagtatctgtcaaggccctagtaggagtaatttctcttaggtaaagaaatttaaaaagcaccaaagtactgttatactgtattgcttacttagaatctttattctctacattctaggttcggaacctcacttacatggtgacccgcagggaaaagattaaacggtctgtgtgcaaagtccaggaacagatattcaatctttacactaagcttttggagcaagaaagagtttcaggtatgcattaagccctggtaggtcaaagtatagggcaggggtttgtaagctttaacactgttgaggaagaaataatcatttcttaattttcttatagaagaatttaagaagcatagacgttcatatttaaaggaagtctttaatttgaggcatcatgtttaagggaaaaagctatgaatttgccctctataaatatgggtggaatcctgtgttctctgcttactgagcaaacacatgaaagtcttttgagtctccctaatttcttcatgtgcaaaatggagatatcgcaagctacctcttggaattgagagactaaaatgaaacagtgacttatatattacacagtacttggtaaacacatcatggggatacctaacaggtttatattcagccttgggctctatctgtaacatggtaaatatggtcaatatatgttaagactgtacttaagacacagtccatttttagataatgttcacagtagattttttttgtgtagatggattgttgactatttctgagattgagcaccaaatatttatttagtgtcttctattttatattgccctgggctaggcaaacagaaaaagaaaactagggtatatacttcctctactctggacaacacatcagttacttgggagatcaagggcaaagatcaagttgggcaggttgtttaacctctctgagattccgttgatcttaaagtttgttttagaatcaagaccccttaagtgcatttgagccctatattctgtgatcataagcccccaaaagtaggtagtataaggatttcagagaagcagagctgctgagtgtggatcaggcagaattagggacccatggaacaggtaggtcttagactggacttcattggaagatagtcagcctctctcctgccttggactgccctttaaagttctagctgcaccattcttggtgcttgcgttgtgcaatcatagttgattcactcttgtttttgtgcatttgtggctttttgtcactccatctagattattatggtgcacagagaacaaagaagttgttataacctgttgtgttgaaatccaaattctggtttatctaaccaattatgtgcgactagagggagctcggtcatctgaagaaataaaaaaaggtttagggaggtttaaataatgttcttgaagtgttacatagtttgaatgcaataacttgttgatatcctagatattttcttcccaagattaagtattttccaggtgaatcaagtgtatatcattagctggaacttgcagtttaattgttaagattttaaaaataaattttctaagtagggtgtcatatgtaaaagtaggtcgattcagattccctaaggtgagctctctcttcatgattcctacctgaatacaaataaatgagatctgtttaactgccttggaagactgtctggtgcagatcaccgagcctacagcagcaaatgctgagctgggatcactaatacaagttgtgcctgtggagttgtgccattggagggctttctgcaactcttaggtcattatgtaatgagtgattccctgtaaaaataagccgtaaagagcattttcatctggtttcatttgagttatttctcatggatattgcaggcaggtttttgcatttcatggctgaggtttttactgggtgagcgaatgatattcttaataagtctgggagttattttgtggtaacagagctgtaatgtagatctgcattcagaagtcctactatttcagaaaaggaaaacaaatcttcctttcattctgatgtaagaaccataggtatgatcagttgaaaacatttatcttcctgtaggattctgttgagtaatgcagttgaaaccctttagggtgctttttttctttttccagtcctaggcttcagtcgtgttcttattcatgcctaaaggctgtctcctgcctgaagtagagcagatggtcatgatttatatgtcatttagggtccatggtttaaactctgtgattctgagagtgggtagggtcatttgctgagagtgtcctcagtggcaacagtgcttatggggggtgggagggtcatgagttggaggctctttagagacatggattacagtcaaggagatagaaatcagagttcagaaaatgttagcctcttcttaccattctcttttcctgtggcaggtgattgagtaaaagaaatatatgcagtgtgatgtgaaggttgattctaatgattgattcttgagaaagcagcatttccaaaccagcaggttgtaaaacacctcctgtggtcatgacagctctgtgttctgagtcgctagctatgtttcatttgcttgcagtgtctgtgtctggtgagcactaggttctcatatggcctcctgtctcataacctgggggctgaaccttgttttcttggtggctcatatcttatgggagacagaaaacatgagaactgctctttctagatgatcttgaggctgttgtagaatcatggtctttatgacaaacactaatgtgttatgaattcacctgctaggggtaacaactcattagtgggttgtgagatgaattcagtgggtcatgaccagtattaaaaacaagtaaagtataataggaaatgtcagagtacattatcaaatgatgagggttaatattatttcgtgaaatgtgaactcttactaggtcatgctgtggaatttagtcactgtgatttgcatcaaaaaatacgaaaaacatcaatttaacttacttcaagttgaatgacaattcagttgaatcccacaaatgtattttgcacataataataatgaacatttttggaacgcttactatgtgtcaagaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 1585 - DNA, 13228 bp, Homo sapiens
atcgccccctttcccctcccatctcccggccgtggtgcggcgcagctctctccccctccgcagtctcagtggcgagctctgggtgctgtggcccggccttggcggggcggcctccggctcaggctggctgagaggctcccagctgcagcgtccccgcccgcctcctcgggagctctgatctcagctgacagtgccctcggggaccaaacaagcctggcaggtaaagatgaagctccccaaacccaacaaccttagaacttagaaatttccctgagaaaggcaggacctacccgaggagagcttctttgaaggactttgaagaaagggatcaaacttgacactttctttcagtcctcaaagaaactaaccacccttcccataggcaattctgtgtgccggcctctgcacagtttaatattaacgacaacaatgtttgcattggaatataaatggaattctttctgcttaagcagtaccagaggggaccctctttatttttatgattgttaacagatgccattgagaaaggtatgaaacgcattcctgaaaagtctctttggcggggttactatgaaagctagcctctcccctctacccttttatcaacttggctgcggaggtcagcaaaaggagcataggaaaacgtttagaaaatgaggcggcgaaatgaagtagaaaagcttttgacttgctttgaaatactctagctgaaaaaaaaaagtgtgtggggtggtgatggtggatgaaacattggcaaaatattgacaatagttgaagctggtgatgtgcacatgggggttgtacttttctctcaacttaatacttttctctgtgcttttgtgtagtcttgaaattttctataataaaaggttttttaaaaagttgtagaaacactcccgcttgattgctctgacatttttacactgtccttgatttgaaaagaagctgcttgctgtgtctagggggctttcaccccttattaacccttctgacttctgaaattcattcttattttatccgaagtacatttgtctccacagaggattataaaagtcatattttgctggctggagaattatacttagaatctggtttataatttagaagagagaatgttaaaatccctgccaaataagacatgtaggcttgaaggtagaggccaagtatcatatggaattttatttttattaggaaatattagaggagttcctttagtgagggaagtggtagatgtggatactgtaccccatttttcttccagatagctgggaaaactgcatgcttttaagaagctttttcacgttttaaaatgtgagactgtttagcatatacttggcatacagtatgtgttcattagatgttaaaataagcaattgctagtgtgagttaattttctccattgggtaaatgattttcctctgcccaatgctcaaatatcaaacaagcatattgcattttaacagtaggatcagactcagaatttgggaggatagagctactttaccttagcactgaggtaactttgcagatgagaaatctgagatggagaggttaggaaacagtaaagttaagttagtagtatgcaagctattattttataactaaaaaacgttaagcttcgtataggtaaaactgatgtgggttagctaaaaacattgtgaccatagatgctttaaaacctgaaaagtagcatacctatttatagatattctttgctctcaaaggccaacttgaaaaatacagataagtctagagctatatgctgtgcacttcataaggcagcatatgaaagagtcctcttggggttcctttaatgtcattcacccaaaatttgatttatccataggattgcacaaattgagatgtacaggtcatggaaaaatagcccccaaacaaagggaggttttgttttttattgtgatgagaaacagaagttgtgggttactgtaaaataatcaactgtgtaactttaccatcttcctttccctcaagtactgccaaactttttaagcagacatttttttggtctccatttatgaaactaaacttgaaaatagtgctatggtatgatattttgaatagaaattggcccactgtcaatgaactttcttgccatttattctcagcctagaatcagtggagagcttatcctttagtaatggattataaagtatttgataaacgtgaaatatttggcaggttcaagattttccttagcattgaaataaattgtggcacatttgggggactagttaacagtgctgtaggtcatgctggaagtgtgctggcactacaactgtttttgaaaaactatctgccagaaaattgtctgactgtagacagcattatcagccctcagttcatcaggatgggctctgtggcctgtaggtaggtgggttttctaaatataataaatttcatatgtctccctatgtcacagccatttagtatattattagccagttaaaagttttgcccctgctgaatcttacatgcttttaaaataaaatctatttcacagctgagtaagtgtaaacattttaaatacctgcgttagatttgccatcaccaggctaattttgccatctagtggtagcaacatggataacaggcaagttcttccctggatgactaggaattgaaccttcctgagaagcattgatgagtaaattacttgtgttttctcatttgtggtttactctagaactttaaagctggaagaaatcttagaaatgttctagtccaactcaacagttaaggactatcagagagattctttaaaataaaggcttcgaaatgcatggcggagttagcaggtggtatgcatttgttgaatagacaaatttatctatcctgttctaattcttgtttttcctctagcaatattgcatcctaccactatgaagttttatcgtgatcttctgtttttagttttaaaattgcatttctgtatattatttcttaaaataacacattttcatttatattttaagtcccagaaggaaacattcttttctactgtttttgtttgtttgctttgagacagggttgccctgtctcattctagttgtccaggctggagtgtagtgacacaatcacagctcactgcagcgtccacctcccagcttaggtgatcctcccaactcagcccagagtagctgggaccacaggcatgcgccaccacacttgtagagacagggtctccctatgttgcccaggctactctcaaactcctggactcaagtgatcctcccatcccagcctcccaaagtgctaggattacaggtgtgaggcaccgcgcccggcccttttctactttttaatcactccctactactactacttctcttttcttttttttgacggagtctcgctctgttgcccaggctggagtgcaatggcgtgatctcacctcactgcaacctctgcctcccggttcaggggattctcctgcctcagcctccccagtagctgggattacaggtacacaacagcatgcctggctaatttttgtatttttagcagagacggggtttcaccacgttggccaggctggtctggaactcctcacctcaagtgatccgcccacctaggcctcccaaactgctgggattacaggtgtgagccacagcctccgccactccctactactactttctttctaaacagtcaggcagactgttgtaaaaactcgattctcacctttgtaagtgtagcagtttcctactgctgctgtaacaaattaccgaaaactcagtggtttaaaacaacacaaatttattatcttatgcatctggagatcagaaatctaaagttttggctgggcacggtggctcacgcctgtaatcccagcactttgggaggccgagatgggcggatcacgaggtcaggagatcgagaccatcctggccaacacggtgacaccccatctctactaaaaatacaaaaaaaattagccgggcatggtggcgggcgcctgtagtcccagctactggggaggctgaggctgaagaatggcgtgaacctgggaggcggagcttgcagtgagccgagatcacgccattgcactctagcctgggcgactgagagagactgcgtctcaaaaaaaaaaaaaaaaaaaagaaatctgaagttgtattgtgatcttctgtttttagttttaaattatatttcttcatatttttcttaaaacaacacattttcatttatgttcctccttctggaagttctaggaaataattttccttacctttttcagcatctagaggccactcatattcctcagctcatgatcctgcattgctctggcctccgcttacatctatcagctcttcccactcttaacccgtctgcctccttcttatatgagcccctatgattgcattggacccacctggataacccagaataaccacttcaccttaaaatccttaatgtaatcgtatttgtaaagtctcttttcttgtgtgtgggaaatattcacaggtcctggggatgaggatatttggcataccacaatgaggcagttagagatgtatgaaataccttgtaaatatctacctgagtgttggctccccctgtttgatatgaaaaacattggctttaatctttgtggagtgcttactgtgctctgggcattgtgcttatcatattagtttctcacaaaaatattctcaaatattatctctatctaataaatgtgggaaataatgtctagagagattaggtaaccttcacaagatcacagtgtaacaagtggcaagtgtacttaaggttgatttggcttcaaagcccactgcccccataatcattgaaacaccctagttcttactccccttttttattacgttacagacactgttattttctcatacactctctaaattaaatgttacctccatgtagtgctgctgtcagggagcgcctcagtggatcaggaattagttttcataagataccccctctcctcagcatctgttcccccaaataaaactgactatgaaagtttttacaattgtcatccaaaacatcaccgctttctttagtgcttgctttattcctgtttatgtcacttgtaattctccccctctcctgctgtggccttttgcctaagccatttctctctgcagttattcagaatcatctggccaggccccagtgtctccctgttgtgtgtcaatcctgagtaggtggaggatgaaagtagaggaggaaatgagggcatgtcttcacatttaggtatgcatgtaaacagagccagtggtgttaggaagcacaggtggttgggattgcagatggctaaatagaggacagccaagttttaaaaggtggtcatgcaatcattggtgtgtactaacatacacactaaagtagagggtggtgttggccctatggggtcattgatatgactgagtaattcctgacccacagcagcctcccaggaactgtttgatggatcaatgcaaagttgtgtcccatggcaacatgctatgtacataaatatggacaagtacctcactagacattacaaggaaccaggtgaaaagaaaggcataagtaattgtgaatctgtcacctagtgagggaaagcaattcaatgcaggtccttcaatggtaagtcagcatctttgctttctcatagacaggaaaaataattgatttgaaatattaatatagtgggcagccatctaatctttcattagtttgtctgctctatctaagctagactataaacttctagggtaaaaaacaaaacacaaaagagaaactgagccttaaggtataatgtcatttcatcataggattctatatactctagatagactcactcaaaaagttgtttttttttcattgtagatcactcccttagagtaattatgttgacatagactctgtttctttttaggctgagggtctgatgcagttccaaaattcccagtgtagatccaggctataaataagacacagaaaatgcaatttaagtgttttgtggctgcatagtgtttaatcacacttaagtttaatagcaatgagaaaaatatattacagagccatggatattcatagaaatgagtaattaggaaagcattcatttgggaagtctctaaagtgaagctgtccttgaacgaaaaacaaaacaaagaaaaagcgaattttagagtgagttggaaactatcttgaaataaaaatatttgactgtaaaactgactttttagaaaactacaagatctctaattttggcttatataacaacctgttttgaagtgatacaaattcaccaattaaggtaggataataattataaaataacatgtgttaactacttactatcctctgggctcagtagtaattctttgcgtgtatcatctcatttaatctccataacaatgttatgaagtcgaaattactataatattatccccactttgcagatgaggaaagtgaaacttggagagttaatgaactgcccacatgcacatgcctcataagtggtgaaaagggaattgaacccaagccttcccactccttggtctgcactcataaccactatgctggtacagatacacaaatattctcaacgctgtcagcaatcacatttctaagaaactataaacaaataacaaaagggtaatagtaagtgatctcgtagtcaagtgtggtcacttctattaatagattgggtacaaatgtgtaattacatctcttccatcagtaagagttcatctacatacacagatattcttacttcttccttaattcccttctactcaatctgtcttcaggatccagcccataatcagctgtgtgtatgctgactcacagtggtgggcagcaatcactgcaactttgctttcattaaccaaaattggaatttgaagccccaaatgcaagccatctggaaatggacagtgaaggtcacagttatattggaagacaggaaaaatgagggggatggggaagccaagggatgttagactttcaaaatattatagctgccccttcaactgggactgtgtctttttagatcaatgagttagtcctttttggataatgggcatatgtagatgtctccactgaacaaactgtggattgctctatcagtaagagctatcatttatgccacattgacattttaccacaagacaaacttagattttccaaaagaaagtgtctttaaacatttgcccaattttaaattacaggccaaattaggctaactaaatccatgtcctcttattactgtgattctgaggtcatattacaaagctctgcccttcccatacccaagggtagacgtgggcatggtttttattcctgtggtacactgcacagagctccctcaaagggcaccaggcagggctggtgaaccaatgccattgaatgatctgtagtatgagatattggaggcattacatataaaccttatgaacttcacttttgccattgaatgatctgtagtatgagatattggaggcattacatataaaccttatgaatttcacttttttgagacatatgatgcacataggatcactatgtgatcctagttcacaccactgcactccagcttggtgacagagccagactgactctcaaaaaataattaaaaataaaaataaaagttagttatgtttgttttttattaattggctgagttatttgatattgtcagttgctaacatagtaaaagcataaagtcagaataaattaattttgtacacagagatgaagcagatgtcatttaaaacccgggtaagccatcatccttggaaagaccaccttctggggtatggctcatgttgctacaccagagccttggctactgtagtggttcttaacctttattgagtgtcaaagtcatctggagggccggttaaacctagctgggagtcactctccaccaccctttcaggagagtttctaacagtaggtctggggcaggccctgagaattagcatttttaacaagtttccaggtaatgctgaagttactagtgtagggactgtcctttgagaacccctggtctggtgtttccttttggcgagcaaccaagatatgggctctcaaccaccgttcgtaactgctgtgagaatgtgaacgtgaacacagagaaggaaaaccatgcctatatcattggtattgtcatttgataagtcaaatcattgctttgtaccaagccaggtttcaaatagcattgaaaatttccaaagtattgtccaaggcctttgactagaacaatagctttataaaccagtgtcatctacatagccagaaataaaattatacttaaatacaattcaactctgatgaggctttcttaaaagtctggctacagaattatggcacaggataaacgtaactggggaaaaaatatcacagtaacactatttagacatcctttattttgcccaggaatgcctttcacaagtgtattgctcctcagatcattagtaccaagcattaagatataccaaatgagatactttgtgtctcttgacgtggatatttggctgactttcaagctttgatgtaatcatatattaagtacacagtggacagctgttgtcataaagagctaaatgaaaaagcaattaagaaaaaagtttcccacaccaaaacaactcccttgattgaaattttgctgagaatcaagtagatttaaaaatatacataatgatatatatcatttttatctattttggtttgttgataagctaagtagcagcaaataactctttgattttcactttttttttcagccaaggacataaattttcatcctgggaactacaatttcaagcgctcagtagagttactgagttgtgagcctttttcattctaattaaataaacttgatgaaatactattgagaaaaattgcatagaagacaaaataaaatactaagtggctctactctacaaaatccttgatgatataattactgttttgcagcggtgactattagaaaatattgtgacgtaaatgcagatttcctcccctcccctcccctcccttctccttcccttccctcacctccccccctcctctcctcttcgacagggtctcactttgttgcccaggctggagttcagtgccatgatcatggtttactgcagccttgacctcctgggttcaagcgatcctgctgagtagctgggactacaggtgtgtgccaccatgcctgactaattttttaaaagttttttttgtagagatgaggtctcagtatgttgcccaatctggtcttgaattcctgtattcaagcaatcctccgatcttagcctcccaaagtgctgggattacaggtgtgagctaccacacccggcctgcttaatatttccaaatgtataatggttcaaattaattatgttatgttttcattaatatatcacatttaaacaataaataggttaatgtagcatacatttttcatcaaaagaatgttttagtttgttaataaaattattgtatttgtatatggcaacataaattctgttgtatcaagggataccgatattgaactttgcatcagggttgacttttcccttttgtgccagtgcacacatcctgtgggtgtaccctgtggtacaatggctgtgggccattgctaatgtgctttcttttccatgcaaaaaagaaataaataaaataaagcttatcagaaagcattgaggatgaatgtattgtagggataagcgaatgctgcattgcctctgctttatacaaagtacaaatcatttgcttaagtcttgatattttaactattagttaaaaatgacttggagcatagttggcaaatactagcgacacagaggttcaaaattgctgctccagcatgctcctactatacccacctccaagcaaagatggctgatacatatcagttccactaaatagatacatgtacatgccagtgagcctcaagaaaagaaaaagagggcaagaagatgtgaatagtaggagaggtattatataatttattatgtactggcacctttaacaatatttaaataacacaagaacactggtcttagatggtgagacctacggtgaaaagggactatatctaaccattctcatgtcccccccaaacagcctgtacttcataaattcttacaaataattttaatatgcagtaaagtcccaccataaggcattttgtatggagctttgcttagagggtggtttcaagcacaactttgttttttaaaaatacatggtacatttttcttactttagcataaaatggcctgtgctatatattttctttttatgaccaggcattctatacaaatcaaaacagatcaatagaagattaattagcaatttatttattgctaatactcttactgctttaaaacattatccaagaatttgcattgcaccttcacatcagtttgggctgcgaatcctggttcatggacattcactgtatccaatgagcagttttttgagctctgtgctaggcagttacagtctagagatggagaagttatgatccctatttttaagtagctaagtgtgggaaaagactgcagcacatttgcttttatctttatttctaaatcatctggataaaaagttgtaggatatctaaggaggagagtgtggcttagccgacagaggattccaacctactaccgtattctactctctcaggcacgaggctattaggggagatagaggtggagatgacaggttggggtgggagcgaggtggattagggctggtggagggaagtttgggtggaaaacaacttactgattttggaagtctgtgtgagcccacttaccagtgtttatctaatctcaataaaatctaggtaaggtgaaaataaggacacctctttgtggtgaaggtacatttaggatccaagggctgaatgaaatggataagtaagatttaaaaaggaaacattataaacctctctctttttctatttttaaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcgggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatgacttaa

SEQ ID NO: 1586 - DNA, 13228 bp, Homo sapiens; identical to SEQ ID NO: 1585

SEQ ID NO: 1587 - DNA, 154936 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggaggtgggggtgcagatatctttaaaacttgcatgcgattgtctttcttttaatcacataaacatcatttaaaaccaattcatattttgtattgtatattaatgcctttcattcctgtattttaaaatgctatcataatcatttttcgaaatacatatttaattattttcatctgttcaatcatctttctttagtaattaaatgaaaatagcactttattaagaaagacaaatgttacatattctctgttttagtgttttccagaaatttgctatgaaatacgactggttgaaaaggagagggtcagagactttcctgagagccacaggacaaaatttacttacaatcgcaggcttaaagaagctatgatagtttaaattacgtggcttagtttgttcttattgtggaaggtgcacaaggaattaatttgtgtagacagaacactgagagtcccattctgaatgcagagacagctactttgctaccgtgcaaatgagtgtcgtcatattgtttgtttttctccttacccaaaagctatagacattggcttgcatatttgagtattttcactttggttttgtaaatggctgcttgacttgccttcctacagaaaatccataatacagagatgtattattttcttactcctttatgagtgattagtttgcactgaaataaaaatgccactcaggaaatgtcatacatcttcaagcagcatatattttaatagtatcatcttgtagaaagggaattacaatctttatttcttctatatcaatgagcaaactacttttttaatttttatatgttcatttttattgacttagtcaatagtttacctactttttaggttttacgtgctccattaatgtccattgttttaggctgaacctttgacactcctcatatatcgtttgtatgagactagatggcaagtaaagataggattcctcaccctaggttaaacactaacttcctcttgaagaaacaacttaggagtccaaaaagcaggctaggaattgtttaggttctgcaatacgaattgtgcaaatgccaacaggattgaattgagagaaacacattctctaatgaaggactcattcctgcagggtggatctatgagattcaatagcaaatggctgttatacaagtaatgaaatcctcaatcttatggtctaaaagcgattctggggggcacttatttaagatacatgagatgtgaaaaagcaatggaccaagagcattgatagtttatggatatttttatttcacattattgatagagctttgtttgccaggcaatgctgcagtcaggcactcggggtttcaataccctatacagaaaatctcaagagcagaccttggttaatttttttaagtaaccctcatcttcattcttttattgtattatgacctcgcgccattgaccttaaatttcactacaaatttagaagaacctaatagtcattgcaaactagatagataatggtatttatgtaatgaaggacaagggaaagatgattcccaaatctgaaagaaactagaagttttctggggaaacaaatagaggagataagatttactggtttattcttcattgatgagagttgcgttctgttctgataaatggaaagctccattgaaattacagatggtcctcaacttaagttggggctacttcccaataaaccatattgaaaatggtttcataaattgaaaatatcaccataaattgaaatatcataaattgaaaatatcaccagtcaaaatgtgtttaacatgcctaccttactgaacatcatactttagtctagcctgtcttaagagtgctcagaacacttatatttgcctacatttgtacaaaatcatctaacagaaaccatattttataatgtgttaaatatctcatgtaacttattgaatactgcaatgaaaatgaaaagcagaatggttgtatgggtactcgaagtacaatttctactgaatgtgtattgctttctcacaattataaagttgggaaatctgaagtcatacctcagggagtgcttttattacacaatacaggtttatcagacgcatataccaacaaatcataggaaattcaggtttgggtcaagggggaggggttcaacctacttatacatatttccttcctctctgttgggctacctttatccttgggattgttgcaagatggccgtgtcatgtaaagggctgtgtcttttagcatcatgaataagatgaaagagttgaaggccaacttcattcaaatgtcttctcgatgtgtccttccctttttctcctggactgctctgtgatccatgtctctgtagaaaatggctggcataagtcaatttctgactgggagctgtcatgattactgtctcccactgttaacactgtacttggaggtcttgatggaattgggcaaacctgttctttcagaccctcagtttcatctcaacacaaaactctccaaaagtccttgctgctccacagcagggaactctcttgaagcaataacatgaggaaatagtgggcttgcatggctgcctcacattcctcaggtatcactgtgctcattgcctgatgtactgtgtcttgccaaccatcattccacgtaatttacccattcttggtttttacattggttaaggcatgtacaaaccctgttagtttttctgcagtatttggattcataccttctgaaattacttgacgattactgtgtctctggttatttgcttctagttggcaatacaaaggaacaatgtgaatgaaactcataaagaaaaacctatgatttaatgggcgtgtgtaacactagagggaaggtcagagttagtctatgcatgggtataggtaggagtctcagtgggtgtcagccattctgtgtcaacaaatcaaatatttaaggtggatctaaaagaaaggtaatatctctgccaattaaactagagtcacgcattgactaatggcaaatacagtctaagaagtgcatttttaggcaattttgtcattatgagaacaacgtagagagtacttacacaaacttagatggtatagcctactacatggctaggctatatggtaaagcatgttgcttctaggctacaaacctttactgaactgtaagcaatgataacacgatggtgtcatatcccatatatatacacatacacacacatacatatatatacatatactatagtaaaaatatgatataaaacattttttaactggtactgctgtttaaagcagatatcatgagtggattttgcaggaccggaagttcatccaggtgagtgagtgagtgagttgtgagtgaaggtgaaggtctagggcattattgtacactactgtagatttaagaaacactgtatgcagccgggcgcggtggctcacgcctgtaatcccagcactttgggaggccgaggcaggcggatcacgaggtcaggagattgagaccatcctggctaacacggtgaaacaccgtctctactaaaaatacaaaaaagttagtcgggtgcggtggcgggcgcctgtagtcccagcatactcaggaggctgaggcgggagaatggggtgaacctgggaggcagagcttccagtgagctgagatcgcgccactgcactctggcctgggtgaaagagcgagactctgtctcaaaaaaaaaaaaaaaaaaaagaaacactgtatgcttacgctatactaaatttattttaaaaacctgaagtaggccaggcgcagtagctcacgtctgtaatcccagcactttgggaggttgaggcaggaggatcacgaggtcaggagttcgagaccagcctgaccaagatggtgaaaccctgtctctactaaaaatacaaaaattagccgggcattgtggcacatgcctgtaatcccagctactcaggaggctgaggcaggagaatcacttgaacccaggaggcagaggttacagtgagccaagactgcaccactgcactccagactgggtgacaaagcgagactccatctcaaaaaaaaaaaaaaaatcctgaaatactaatgacattatgattgctacaatgtcacaagataagataaattttcaactccattgcaatcttatgggaccagcaacgtgcatattgtctgttgttgaccaaaacggcccttatgtggtacatgaccctatacacataacagcatattttatatttatggaaaaagcccttctagaattataaaatcacaagttttactcacataaaatttaacacaatattgagattaactcataaatgaaattataaaagtcttaaaattttgactatgatagttctaaacaagattttaatccagagaaatgaatgtgttcacgtaatcctctgtggcataaagagtaatggcaatgaaacatttcttaataaaacaggctgcatcattgtcagtgcgatttgcaccttcccgttgacatccattctgtaggtattgaatgcaggtgatcttacctgaaggtgacaacagaagattttattacaagatcacgcatgtgccctcaataacgccatgtcattgatgccaccagggtaacagctattgtgataaaatttgaaaaataaacatatgtggcttgaacccgggaggcggagcttgctgtgagctgagatcgcgccactgcactccagcctgggcgacagagcgagactccgtctcgaaaaaaacaagaaagaaaaaagaaagaaaaataaacatacgctaaaaatttagaaggatagtaagtaataagcatttgattgcttgagcccaggaattggaggctgctatgctctgtgatcacaactatgaatatccattgcactgcagcctgagaaatatagctaggctccatctctaaaaaagtaaataactaaataagtgtttgaaaatatttagcaaggaagccatactaatgtagctgaatcttggaaatcaagaaaaaaaattgttcgtttaaaagggcaaaattaaaaaattctttccagatagaaagaataggtgcagatgatagagcagcgtggcccaggggaggggctaagcagtggactaaggatggggaggctggagaagaggctgaggggagtcacatgttgtcctgagatgagaaagggaaaaaaagaaacatgttcatcttcaagtgcaaactctcttcagattgaaagaaagtttttagtttcttgggaagcagaaaagaatataggtgaggagtttgagagattcattaatttctttgtgaaattcaacataaaggaagatattctgtgttgctctttgttcactatatgtgtggggctcacagggaagcaatatagacaaagtttccaaattctcagatgttaaaggccaatggggattcagaaaacgcaacagaaactaaactgcaagtggaagagctgcccttgggagcccagagggcaagtttcaggcctggactgggtgggcaagggaggcctccaggaggaggagctttggaggagattgtggagagtgaggagcagtgagtccagcaaacagggcagggaaagcgaggaggaaacagtgtgtctgtggcacaggccagggcatgagaagagggtggtgggttggaaggaccactgggatgagtaatacatgaggaggcaggagaaggaagggcagaccatgcagggactgggcatgggggtgagggtgccgggcagctcagaaagtgatgcaggggccgctctctgaggactgcattctgtggggagggatttgaatgtctcagttcttttatgaaatgttatccccaatccatgaggtcttctgattcaggaaccagtcagaacaggtgagggtggccccagtccactgtgcaggaccattagcattgccaggaggggttggtgctgaggacaaaagagagtgaaaaggggcaaagaactttctttcctgtctgtcattttgcagatgtaagtgggatctgtggatctgaaaattcacagtggccagctcaccaccacctgatgaaagatacaccacagggtgagagcatcctaacagcaaactgcaaatgaggtgggtttgcagctgcacagagaagggaccccagggaagctacacgggcaaggcaggcaggggacttcagaggtggtagcagtgggtgttgatgaaattattctctgaggatatacacgtttgtcagtgtacgtgcatgaccgcttacatgttgatgttcgcatacaaaccccacaattttctcatgtttttcagagcatagcatgtattttgactttattctttctaccacacgtaaccatgccttgtatacctagcaatacttaacgtttatttttggtggattattcatggttaatgcatttcctgacttggtagccaaatgaaattaccttgctttacaggcctttggttgatcatttctgaagatttgtgtcgcctgaattcagtgggggtcacctctccatgatcttaagcaacagtcctgttgggactgttatgctatcctacttaactttggacttgtatgtcctggaaaatatgaaactatcgatactcacttgaaaattccaggtgctttaccttttactttgtttttgccgtgtttccaatgttatatattttctcccacttactttggattcaattgctctgcttccttttacagtaaaaatttagatgtttgaattttgggtttcaacttttctaatatatacacactcaatgctgtaattttcctctaagcttccctgttgtagctgacaaattttgatgaggtgtgttttcctttcaatttagttcaaattattttaaaaaatttctcttgagatttctttgacccatgtattatttggaaatgaattatataatctccacgtattttgcaattcaccagtttttaaaaattgatttctagcttaattctgttgtgttttgagtgcatacattgtattagtctgattcttttaaatggtttcaggtgtgttttatggaggagaatgtggtgcatctcgatgagtggtcctgtgggcttgagttcaatgtgtattctgcccgttgttggataaagtctgtagatgtcaattatatccaattgactgatgatactgttgagttcaactatgtccttactgattttttctgcttggtggatctgtctatttctgatagaggagtgttgaaagtctccaacgataatagcggattcatctatttcttattgtggttttaacagtttctgcctcacgtagactgatgccctgttgctctgttgttacatgcatatatattaaggatcattatattttcttggaaaatcgatccctttattatcacataaggtctttatccctgataattttcctgtatttacattacattctttctgaagctaataaagctatgcctgctttcttctggttactgttagcaaggtacattttgtttcattcatttacttttatatgtacttttactttttttacatttactcttattaattgacaaaatttgaggtattgactatgtaaaatcttcacatcatcttcaaacatgatgtttgaagaataatatatattgtgaagtgaaaaattcttgctaagaacatatgtgttacctcacacagttatttttcgtggcaagaacactttacatccactctttcttcatttttcataatgcaatttattgttaactatagttaccatgttgtacaatctcttgatctttttcttcctatctaactgaaattttgtacccattcacaatcatctacccatcctcatcccctaccacccttaggccctagtactcaccattctactttgtatttatataaatgagcttttttagattccgcttacacatgggttcatgtggtatttgtctttctcttcccggcatatttcatttaacatattgtcatgcagatacattcattctgcctccaatgacagtaattctccctttttaaggccgataatatcctgttttgcatatacactgcattctttttatccattaatctgttgatgggcacttaggttgatcccatatttggctattgtgactaattctggaatgaatgtgggagtgcagatatctatccaacacaccggatagtcaatgaaatctcccaaggcagattttattacctttggatatatacccagtaataagactgctcgatcaaagggtaattctattgtttttttttttaggatccttcacaatttttcccataattactatattgtactaatttacattcccaccgacagtacacatgttcccttttctccctatctttatcaacactaacttttgtcttttaaaatagccattctaacaagtgtgagatgatatctcattgatttaaatttgcaattgtctatgtatgtcttcatatttatacagatttccaatatacaagatataacggggacttgtttttagatctactctgacaatgtgtctttaattggtgcatttcaaccattgctactcaaagggattactgacatggttgtgagaggtgaggccagctggacttcctgggtcgagtggggacttggggaaatctcctgtcttacagaggattttaaaatgcactaatcagcgctctgtaaaatgcaccagtcagcaggattctaaaagtagccaattgaggggaggattgaaaaaagggcactctgataggacagaaatggaacatgggtggggacaataaaggaattaaagctggtaaccccagccagcagccacaatccgctggggtccctttccacgcaatggaaggtttgtctcttcgctcttcacaataagccttgctaccggtcactctttgggtccatggcatcttggactaagagtccaaggtcagttcaacttggtggagcaagctggcagttagatgaaaaatatacacagacttgctgcagctgtacagatgatgaacgtagaactcaaaagatgatggaggccgggcgcggtggctcagggcctgtaatcccagcactttgggaggccgaggcgggcggaccacgaggtcaggagatcgaggccatcctggctaacacggtgaaaccccgtctctactaaaaatacaaaaattagccaggcgtggtggcaggcgcctgcagtcccagctactcgggaggctgaggcaggagaatggcatgaacccgggaggcggagcttgcagtgagccaagattgcaccactgcattccagcctgggcgacagagcgagactctgtctcaaaaaaaaaaaaaaaaaaaaaaaaaaagatgatggaaacagagtagaaatgatgagaatgatgaatgatgcctggagcttggttcctgggttgctgtggtgttagatggtcacagagcagctttttggaagcttatgtccatgtctcctgctaacagtagatacttgattagaatggaacagaatgtttacctgatttttacttatagcacctggaatgctagtagtaaaatgtaagccctttggagacagaaaatttttcaattctgtgttttcagagcctaggataattcctctgacctcactggtgagaatacgtaggtgttaaactaatgcacggattaaactataagggcaaagaaaaaagttcccctttgtcctctgaaggttcactgaaaaatcaactggcaaaaggaagattaatagaagaaaaggtatgtaaaattttattttaaattgcatagggagggaaccacaaaagaatgatgacccagtgaggtacacacgtttatatatctgttttcatagaggaagaaggcgatgtgtaacatagactattattttaagaggcaatagaccatcaaggagaatgaacagacccaggaggcaggaagcagacattaggagaaggtgaggtgcagagctacgcaggaagagaggttgttgtttaatgcaaattaagtcctccagataatctcttggagctgacctcaaaagaacagacggtaggtgtgtctgggctggtgaggactcccagcctcttgatctttcctggttacttgatgagatccctggggaggatgttcaagaccattgcatttctttattttattttattttcagatggagtctcactctgttgcccaggctggagtgcagtggcatgatattggctcactgcaacctccacctaccagattcaagtgattctcttgcctcagcctcctgagcagctgggattacaggcgcctgccaccacacccagctaatttttgtatttttagtagagacggggtttcaccatgttggtcaggcttgtctcaaactcctgacctcgtgatccacctgccttggcctcccaaagtgctgggattacaggcgtgagccactgtgcccagcctgtaaatgcccatcccattatatttcttttgtaaagaagcttgcttggtcagataaggaaatttcagagaggctcttcctggacttgggagtgggagacaagattagagagaccttcattctgaggcaaattctaagacggctcagcatgacaaagcaccagtctttggtatatctgagccccaacaaaataaactgatttgtgtatgaagaatggagcttacagctcagacagcaaatcaatccttattgactcagttttcaacttcatctggattaccagatgcacagtgtgaaaataagtcatttgccagcctgagcaacatagcaagagcccgtctctataaaaagtgtaaaaatctagctgggcatggtagtgaccgtctgttgtcctagctactctgcagcctgagatgggagcatcacttgttacagtgagctgtgatcatgatcaggtcactgcactccaatctagctactgagtgagaccttgtctctctctctccctctctctctctctctctctctctatatatatatatatatatatatatatagccaggcgtggtggcagtcacctgtaatcccagctactcaggaggctgaggcaggagaatcgcttgaatctggtaggtggaggttaaagtgagctgagagtgccactgcactccagcctgggcaacagagcgagactccatctgaaaaaaaaaaaagaaatgcatataatatatatagtatatatagtatatatatctatatataaaatagatatatatagtatatatatctatatataaaatagatatatatagtatatatatctatatataaaaatatagatatatagtatatatatctatatataaaatatatagatatatatactatatatctatatataaaatatatagatatatatactatatataaaatatatagtatatatatgaaaataagttatttgtattcaaagcatcaaataaaattttgttttagttttctaaaaaaatacaagtaacatatataggcatgctgtttttcttcttatatgtgactacattactttagtatgtagcaaatatcatttgctagctgtagtaaatgtgcattgtcacattttgtccaattttgttcaaactttaatcaaatgcctaagaatttaaaattaccttaattttgtagaagcaaatcacagcttatcattttagatgttttacttacttatgagtctactatttcccacgttactgctgtttctggcctgcctgtggcagtattgccattcactggaacctgcttccataggaggagcatcctgatgtgtttaggaatactaaaattcagatcattccccatcagagttgtctattctgtttctccctctcatccccataatgaatgcatacattctttctgtttgtttggtaattattgggtcatttaaaatgaagactatgaaatgagaacagaaccactgaccaaaatgtacaactttttaaacgtaccatggggaagaaaggtccagaacctatgcgcggagtatgttactaatccagagagaaagtatatttaaaaacaacctgagtggtcaggaagtcaatttcttttttctttatttttttaagagagacagggtctcgctttgttgcccaggctggtctcgaactcctaggctcaagccatcttccctcttcggcctcccaaagggatcagtttctgaagtgagatgagtgagttgattccttgagcattgtcttaatatgctacggctaccataacaaagtaccagagactgggtggcttacgcaacagaagttaacgttctggaggctataacgttctagaggccggcaaggttgtattctttgtgacctctctacgtggctggcagatggccaccttctctctgtgctctcacctcttccttcccctgtgcttgcacatccctggttctctcatccaagcattctattcttatagggacaccaggcagataggatttggcccaccttaatgacctcatttaccttaatcatctaatagaaggccctatgtccaaacagtcacattctgagacactgggggtgagggctctgcaggggagaaaaataatacctttccttcacctgctgcaaggttcgtggctgagtcctcataacaaaatccagattaacaaaagaaaagtatgcaaatgcattttttttttgagacggagcctcacttctgttgcccaggctggagtgcagtggtgtgatctctgctaaccacaaactctgcgtcccgttttcaagcgattctcctgcctcagtctcccgagtagctgggactataggcgcccaccaccacacccagctaatttgtgtattttttagtaaagatggggtttcaccatgttggccaggctggtctcaaactcctgatctcaggtgatccgccctgctcggcctcccagagtgctgggattataggcgtgatccaccacgcccagccacaaatgcatttaatgtaagttttatgtgacacaggagactacggaaatgaaaactcaaacatctagggagaactgtgcatttttatggacagtcatttagaagtatgattggaggacaaaagggtatgatctaatggtaataaactgggaggaacttaccaaggcctgactgttcaggttcttcttggcctccaagtttgatattccttcccttcgggcatagggcagaatacctgtcacatgagggtcttcaggagagaagaggtgggagcaggtcatttcaaacctttctccctctggagttttctgtctcctccagcttaaaatccttagtgtgccagggtgccatacattggggtagtatttcctgtactccagtagcttcaatgtataaatcttagccacaacaagcatgaatagagatttcaagctacagaaggaagcaaaggactaccgagaggtaaagatgtccaaaggtaactctggcgaaaagaatgaactccttgtacagctgtgaatgggagtttgggcaagcgttaagtctgaacctacctataggtgggactcttaaccattttatatttatgcagagcgagtaaatggaaaaatcccgtggaaaaacactaatcatatattgcgacttgagggggctacagatttttttttttttttgaggtggagtctcactgtgtagcccaggctggagtgcagtggctgcgatcttggctcactgcaagctccgcctcctgggttcacgccattctcctgcctcagcctcccgagtagctgggactacaggcgcccaccaccatgcctggctaatttttttgtatttttggtagagacggggtttcaccgtgttagctaggatggtctcgatctcctgacttcgtgatccacccgcctcggccacccaaagtgctgggattacaggcgtgagccaccatgcccggcttggggggctactgatttaaagaaagaaagattaaaaggattttgatgcaataactctttaaattttttttttttgagttggagtctcactctgtcgcccaggccagaatgcagtggtacaatcttggctcactgcaacctccgcctcctggttcaagggattttccagcctcagccttccaagtagctgggattatagcatgcaccacaatgcccagctaatttttgtatttttagtagagacagggtttcaccatgtttgccaggctggtcttgaactcctgacctcagaagatccgcctgcctcggcctcccaaagtgctgagattacaggcatgagccactgtgcccggccaactctttatttatttatttttttttttttgagacggagtctcgctctgtcgcctaggctggagtacagtggtccaatctcggctcgctgcaagctccacctccctggttcaagtgattctccagcctcagcctcccaagtagctgggactacaggcacctgccaccacgcccaggtaaaatttttgtatttttagtagagacggggtttcaccgcgttagccaggatggtctcaatctcctgacctcgtgatccacccgcctcggcctcccaaagtgctgggattacaggcgtgagccaccatgcccggcgccaactctttaatttttaaaattgggtttctggaggtgatatccatccttttccagtacacagtttatagagtttcaacaaatacatactgtcatgaaattaccaccgtaatcaatgtttcccatagtggccacagcttgggaaatcctaacaaaggctttaggcttcctggcctctgctgccatgaccctgtagaaagaatggattacgagattcgttcccacctgcccctccctgggtctcagatcttccctatctatcagataaggattggattgagctggtgtagccagtttgtctgtccctgtgctgaggttactacttctgctggcacccaaagcacttgttatagatctaaacaagttgatttcagtcatccagtccagcaagggaggacatgtcctatataaacttgatgtgcctgataacataagccaccccactggaagtatcagatgtttcccgcactactagagggttcctagcaccctggtcctccctgatcctgtcccccaacactgtgagatcccatagaaagtgggggtcaccttggggaacactgccataaaattagagttagggggccctttctggggttttatggtggcctgaaccacaaaccacccccaagaacatgcactttgaagagaaaaggaaaaagaatggtagggaacactgaggttggaatttcacaggaacagcctaattagccagctacctggtccacctccatccacatcaagctcagtgtttcccaacatgtgctgcagtgccccatttcccatgcattggagtgtagtgtttagtgttcatactactagatagaagtaccgcctcctgagcaggccttcttgatgtcctatcttcagttgctttggctgttccattgttcagtagctccattggcttgcagatgacagggtgcatacaaagcccatcatattccatgagagcatggccattgttttgctggtcatgtagtgaaggatgcttcttggtgagactgaggtcctctggggtgttcaaaatcatgacataagttctcctcaataacagcaatggtagtatcagcatccacaagcgtgcatattttttgtcctttccaagtagcaagctgttttgatagtctttgtccccacaaagaggctctttaaatattctagtcactcaattgccattccctgatgaggtatgtaggctgtcagcaacggcccacacattggtgaaatgcaggaagacctggtggtaggggtggcctgcatggtcatcacaaatgcgtgttgtttggtccactgggcaaattgccaaggtttattctgacaaatgatgatgacaaccacagcctaacagaccccatctgctctgttgtttcactgagccatcagtaaaccatgccacaccatcagcaggcttgtcttggagccttaggctccagacagccatgggaggagccaaagcacacccagtggttctcttggtgtcttctaattagctagccatttgttcacggagcctgctggtcacatgtggtcctagctgggcctgaacttgaatgcaccacttccatttgataagtgaagtctatggagcctgtctaattttattggttgagcttgtgagccatccagagagaaatggcagttcaggttgcagagtttcatctggcattctggccacgaggtgcccagtccaaaacagtacccaatatcaagtaaggattgccatttaaaagagggatataggccgggcgtggtggctcatgcctgtaatcccagcagtttgggaggccaaggcgggtggatcacctgaggtcaggagttcgagaccagcctgaccaatgtgatgaaaccccatctctactaaaaatagaaaaattagccggacatggtggcatgcgcctgtaatcccagctattcaggaggctgagacaggagaattgcttgaacccgggaggcagaggtttcaatgagccgagattgcaccattgcactctaacctgggcaacaaaagtgaaactccatctcaaaaaaataaaataaaataaagagggatatttggtggctgcctgaggcaacttatgtgtccaagatctgagaggctggtacaccccagtgtcagttttctgttgccagagacatccatcactgtgcatcaggttgcacacaactgtgatttcatctggctagcacatttaaggtttaaaaggaagtgcctgagacacaaattgttgtaaacctgctgctgcaaagggttccattcaaagtgtgtggctttattggttaccttgactctgggtgccagaagaacccccatgtgagatgcatgttgtctccagtacccaaagcgacctaaccagctgccaggcctcctttgtatccgtgagtgcagccaggggcttgcctgtatctgggatactgttttggcttcttgctcaggtagctttggcattcattgtgcccatggcctttttgaccagctaaactgggctgttacattgtgacaggtgggttgtcacttttttctttttttcgagacggagtcttgctctgtcacccaggctgacctggtgcgatcttggctctctctaacctccgcctcccaggtttaagcacttctcctgcctcagcctcctgagtagctgggattataggcgcccaccaccatgccctgctaatttttatattttagtagagacggggtttcaccatgttggccaggctgggcttaaactcctgacctcgtgattcacccacttcagcctcccaaagtgctgggattacaggcatgagcccccacggccagccggttgtcacatttttatctgtaacaagtaaatccagaattaataaaatagtgtcattgttccatttagtatgcagtaccactttttttaatgattcagtgcggcttgggtagcttaggtaacaggcaggagtggatacggcccactattgtgtcttagttcttagctgtgagggggcataatcttccaggacatcaatgcctataatgcactcagggtgggaaccagagccacctgcataaaaagttgctcacagggctctacccacaagtacataagcattgtgtgcagataagcatcacgggccaccagtttgttcccaaacctcccaatgtcatccgtttaattattctcctaaaaggacccagaaacattgtcatgtgggttccggtatccaagcacctgagaaaaaactgaagtcttctcttttctcctcttatcataacaagggtataaggccagagggcttcagtagggacctagaggccttggccccattcttaactgtgtcaatcagaccaagacacttaggtggcagtgttcctttatcaaacactcacaatagccacactgcgtaagatttccctggtcttcctccttatcctttcgagcctgactcttcccatcttctgggctgacattgtacgtgttagttcctctcatgcctcagggaccatacaaggacctctctctagtttcttcttgggtgcctcaggggctgtctgaatactcaccattcaagctcttgggccctgacaataagggatcacataagtgcccagcacctaggggaccttgaactatgatctgctgtttccacattcctttctctctgtctcagtccatgcagccagctcacttacatctgtggggaggagagtgacatgtcccatttaccacccatccttatccataactcatccaggtacatgtccagcccctgtgctcctgggctgatgtctctgccttgggctgagtactgggtggtattgcccctcccactttgccagaaagccatgtttctctgaccgaaccttacccactgcaccaatttttcaaagcaggttcaccaattaccaatcccaagggaggactccaccacacagaggacagcaaaggtcatcactataccagccatcaggaataggagtccagacacttctacccactgcatcctccgctgcagtgctacaactgcctgagagcagtgagacagaacacattctcaggcagtaagttaaaggatgcacatttattatttacagatagggagaaagtcttccttcaaaagaagcctaggctccattctgagctcatccccaaaggctcaagaagggttcccagggcagatgaagtctggattgcaaatgcccccctttcacacagctgaggaagcccaaaaggcagcccaccctgggttacatatctcagggcagacatggcgcattgagcaaagctttaaggaaatactgctttcagggcagagaggaacaaaccccagctctcctggacagtccctccctaactaaagatgtgacattccttaggaagggccagaacaaggccagggttgttccagacagtccctccctagctcagaatattgcattccaggctgatgctacacttattcttgacaaattaaaactgagaaaatgggaataattgaatccatccaaggccacctggaggactgttttgcattttcaccccaaaagttccttgtagtagtcttcccaccatatttagttttggaaattattgatatctatctccataactttgccttttacagaatgtcatataaatgaaatcattctgtatgtaatctttcagtaacactttcgagatatgtcatgtttactgtatcaatggtttgtttctttttgaaactgacctgtgctatattcaatgaatgtaccacaatttactcaattgtttatgtttttttttaagacagagtttcgctcctgttgcccaggttggagtgcaatcctgcaacctcggctcactgcaacctccacctcctgggctcaatgattctcctgcctcagcctctggagtactcatcatttttattaatataaaatgttataaatatggataacttgatggatatttgtgttgaggtattatatggttactacaagcatatggtttcattcatcttgggaaaatagatcttagcgctgagatgctggatcatataacaaaagtatgattcagaaggctggttgtggtggctcatgcctataatcccaacactttgggaggccaagatgggaggatcacttgaggccaacagttcaagagcagcttcgccaacatagtgaaaccccatctctactaaaaatacaaaacttggccgggtgcagtggctcatgcctgtaatcccagcactttgggaggctgaggcaggcggatcacctgagatcaggagttcaagaccagcctggccaacatggtgaaaccccgtctctactaaaaatacaaaagaaaattctccaggtgtggtggtgcatgcctataatcccagctactcaggaagctgagacaggagagtcacttgaacccacgaggcagaggttgcagtgagccgagatcataccactgcactccagcctggatgacagagtgagactccatcacaaacacacacacacacacacacacacacacagaaaacttagctaggcgtggtggcacacgcctgtaatcccagctcctcatgtggctagggcatgagaatagcttgaacctgggaggcagaggttgcagtgagctgagatggtgccactgcactccagcctgggcgatagagctgactctgtcttgaaaaaaaaaaaaaacgtatgattcactttacaagaaactgccaaaatgttttccaaagtggctatcattttgcatcctaacagaaaatatgggaatccccgttactccacatccttaccagcacttggtttggactctgtgtgtttgtgtgtgtctgtagtgtgtgtgtgtgtgtgtgtttgtgtgtgcgcatgagtaaatatatgtgtatatatgtatatatatcgactcttaataattccagtagggacatagtggcaccttactgtggtttcaataatttacatcttcctgctgataatggcattgaataaaactcattaacttgttcgtcatccatatctactatttgactgtcactcttctcatttcaaaaaatgtttattgttgtattattaaatttaactatgtatatgtataattttgatatgacctacatctgttaagtaccgaaaatatttttttctgagcctgtgccatctcgtctttctcttaacagtgtctgtcaaagagcagcatttattttaattttgactaagaataatttgtccttttttgttgtttttttttgagacagagtctgtctctgtcacccaggctggagtgcaatggcacagtcttggctcactgcaacttccgcctcctgggttgaagcgactctcctgcctcagcctcttgagtagctgggattacaggcaccctctatcatgcccggctaatttttgtacttttgtagagatggggtttcaccatgttggccaggctggtcttgaactcctgacctcaggtgatccacctgcctcagcttctcaaagtgctgggattacaggcatgagccactgtgcccagccaatttatccatttttaaattttgtgcttaatatttattccctaccattatatattgcttaacacaaggtcataaagattacctacagtattttccttagaaattttatgtgttaaggatttacatttatatctgtggtattttgaattaattttatatctagtgcaaaaaagggtgaagagttttgttttgtattttggcatatgaatgctctgttgttttaggagcttttgctacaaatactctcctttcttcaattcaagaaaattgaatttccgtggcacatgagtcaaaaacctaccaaccatatatgtatatgctataatgctccagttatctaaatatttatccttatacatatccatatatgaatatgcatatgctatacatacatacatatatgtatttgctatactgttccatttatctatttatccttacaccaataccacactatcttgactaataccacattatattaaacttgaaataatggccaggtgcggtggctcacgcctgtaatctggcactttgggaggccaaggcaggcagatcacctgaggtcgggagttcgagaccagcctgaccaacatggggaaaccccatctctactaaaaatacaaaaattagccgagtgtggtggcacatgcctgtaatcccagctactcgggagtctgaggcaggagaatcccttgaacctggcagacggaagttgcagtgagccgagatcatgcagttgcactccagcctgggcgacaagagcaaaactccgtctcaaaaaaaaagaaaagaaaagaaaacgtgaaataagtagtgagtcccccaatattgtcccttttcttctaaattggtttggctatactaattatttagtttcttacataaattttggaatctacttctcagtttctaaaaaaaatataaaaaatcagctgaggattctactgaatgtatagataaatatgtaagaattgacccttggtcaggcgtggtggctcaagactgtaatcccagcactttgggaggctgaggtgggtggatcacgacgtcaggagcttgagaccagcctgaccaaggcatggtgaaaccctgtctctactaaaaatacaaaaattagccgagcgtggtggcaagcgcctgtaatcccagctactcaggaggctaaggcaggagaatctcttgaacttgggaagtggaggttgcagtaagccaagatcgtgccactgcactccagctggggtgacagaacgagactccgtctcaaaaaaaaaaaaaattgatccttaatattgagctttccaatccattaaattggtatatctttatatttatttagatttttttgaatatcaatctgatcagcattttctaattcccagagcacacattttgcacacattttgtcaggtttatctcgaagtatatcacgtttttatgctattataaaatacattttaacttctatagtcaatttttcattatcagtataaaggaagtcaaccgattttcactcactcatttttacaaactaagcaaatctagtggcagccatgtggtatatacattgctacttgtgagggatggataaatgaaaaacatttctcctttatttgaggcatttgtcaagcagagatatgaacaaataggcaatgcaaatcagaggggttgtagtagggaatgtgcattattctgtggaaatccacaaaatgcatgggcatacaaaccaaatttaaatagtcatagaaggaatcctgcaggaagtaatttatgattgaataaagtagctgaaaaccatgcaaattagaattagacaagacaaaagaaggattagtattcaggtagagaccagggtgtgtctacaagtcaacatttttgagacatcacagggagagtaacaatttcagtacactgaaggaagttagaaatctatgtcagggctagatttttaagaaattttgttctgtgtcaataagttaggatttttatagttttctaaggttctattcagctactatggggtcgactcaagaatacagctgttgtaattgttaaaatgggaatttgggagtcttttgaatttgaaagaaaaaacaaatgtgcgggattgaggctcagaccctgtacaggcaaagaaaaagttaaaagtgaggaaaatgagagacaacataaactctgggaaaagtgttcacaaaaaattttagtattttcagggtagaagctcctcttgattgagtcataccttcctgcgaaagatacaaagtcagaaaagaaatcctctacctagaaaacgacattttggcaccaagcataggttactttcatgccttaatttcaccttaccagcatttcaaaatacctgctacactgtggtttgaggaatgagactactatgctcacagcgccacctagcatcaacagaaagggaggcccatggcaaacttaataacaagaggcgggaaaaaaaaggtgaggcccaggaaccggaaacttaatttgagcaggatttttcttatatttatttaaaaactaaaatattggccgggcactgtggctcatgcctgtaatcccaacacactgggaggccgaggcgggcagatcacttgaggccaggagttcaagaccagcctgggtaacacggtgaaaccctgtctctactaaaaatacaaaaattagtgggcatggtggcgggtgcctgtaatcccaactactgggaggctgaggcaggagaattgcttgaacctaggaggtggaggttgtagtgagccgagatcgcgccactgcactccagcctgggtgatagagtgagactctccctcaaaataataaaataatattgctgcaggggtcagtggtgaaatgcaatccataaccattcccagtaaacactcagcgagtcctggcccatgcccacttttcctgtcatttaacgcaagggttaaatatcaaagtgaatcccattatgctaattgatttacaaatacggatgtataggagtgtgataccctgagcgcaatcatacttcggatataactgtaaaacgacttcagctgactttgcagtgttgcagtgtcacattaaaccctaagttgtttgtgtttccctacacatcactctccaggagcattatagttcagaagattagagtaatttcttagactaaagccttgatgggttattattacataaaacgttttccactctgatggagaagtcaggtgcattcgctcatgtctccgtggcagggccgggactcctggtcccccgcgattctgagcggtgcctcacagcctaggtcctccaacctcacagggcggcccgcagcaaatgcgccactgtccggtgcggccaaccagctcgtggtgcgctgtgggaaggtcacaggacggagctggggggcgggggcggcggtgggggcgggggcggcggcgggggcgggggcgggggcgggggcagatcctatttgcgcctgcgcgggactggaggattcggtgttgccctttccccctgctatttccgtttccgcgcttcaagcggatctcttccggttatggcgcccgctgggagtgtcttatcagccgcttataccgcggaaactttaacctgcgttttcccgtaaaattttcctctctaggtttcgtatcattgtcttgtttcttactcttgtattaactttgttttaacctaaggtttctctttcccaaaaactgtggtgtttctttacaacctctttttatagttatataaacattgcaagaaccatgattttatattcttccttttcagtattaataacttcaatgtcttttttggcatttgtctgaaaatttgaaatatttttcaatttactgaactgattatcgttttgtaaatatcggatactactttaatcatttgtgtattggccttaagattctctatttttaactcttccaccaacatacctttaatctgagaggtgttgtaggggcttcaagatcaaactttccccacagtctctattttcattataaaataccgtgttttaagaaaaaatgtacaaggttgaaagaagtttcactactacgtgttttttttttaatttttattttattttattttattttgagacggagtctcgctctgtcaccaggctggagtgcagtggtgcggtctcggctcactgcaacccccgactccctggttcaggcagttctgccgccgactccctggttcaagcaattctgcctcaacctcccgggtagctgggattaccggcacatgccaccacgcccagctaatttttgtatttttagtagagatggggtttcaccatgttggccaggatggtcttgatttcctgacttcgtgatccacccgcctcagcctcccaaagtgctgggattacaggcgtgagccaccgcgctcggcctctactatgttttaaaacagtggctaggtcatgcttttctgtgtatccttacttcccttattccatcacctcatccatcactttacaactgatcatacaattacaaaattattttactaatcagattaaatgtgtgccttccatttgaagaagaaaggtctactaaaggcttagttttccctaggacactgggagaatacaggatctggtttccagtgccacagtggtgatcacacaggaataaacgggacacaggtcagacaacagccagaaagtcatctgccagtatatgtttcctgtgagatggacacctggtcccaggtcagacacaggtgttagagtgtcagctaggtaaaagaagtaacctgaaagagacacgctgtgaacaactatgtccacctccccttcatttcctagtattggagggctgctagctgctctgttactaggacccagatttagttggggcctctcagaacaggtcagaattgacctatgcacagtacctgtgggagtctggatgagggccatccactgaaagttagtgaatcaaagatttaagattgatctaaatgcaaatagatctgtgtcaaacgactatacgcataattgccttattttatacttattgaaaaaatcctcgtaaaattataaaggcataagatttacttgttatgaaaatgaaggcaataatgaacgtaattcataagtgaatttgcaaatatcttgaaattccaattctgatttttccaaattagattttgattcagagtcatcgatgtcttcacaccaccctctgtggcatgaacagagatggtaatgaagcatttcttagaaaacaaggctggaccactgtctgtgtgatttccacctttcttgctgacaccattctgcatgttttgatgtaagtgatgttaccagaaggaaacagcagaaggttgcaaaacaagtgcaaacaatgaaagccatgtcatggctgccaacaggctaatagtgattgtaacaacacttgacaaaataatttttaaaaattattcaaatatgataactaataacgatacagaattatcaagggaggtccaatttttttttttgtctgagacggagtctctctttgttgtccaggctggagtgcagtggcacgatctcggctctctgcaacctccctgacccaggttcaagcatttctcctgcctcagcctcctgagtagctgggattacaggcggctgccaccacacccagctaatttttgcatttttagtagagacggggtttcaccatgttttttggccaggctggtctcaaactcttgacctcaggtgatccacccgccttggcctcccaatgtactggaattacaggcgtgagccactgcacccggcctaagggagctctattaatggagctgaatctatgaaacaagaacatcttccttcatcaagggagcaaaactgtccagaaaaaaagtacagatgaggtagaaggagcctggtctatgtgttcatctttgtggtggattgagaatagggaggctggagaagaggctgagggggaagtcagggctcactcctgtcctaaaagcaaaagggagcaaaagaaccatgttcatcttcagattcacacattcttcactttgaaagaaaatttaagtttattaggaaaccatatctgtgaggagtttttattttttttttgttttctttttttgaaacagggtcttattttgttgcccaggctggagtgcagtggcatatacactgttcactgcagcctctacctcctgggccctagcagttatcctacctcagcctcccatgtagctgggaccacaggcatatgccaccaagccctgcctattttatttttttgtaaagacgtgtctcactttgttgcccaggctggtggggggaagttttagagattcattaaataatttgtgaaatttaaaataaaggaaaatattctgttttgggttttgcccagtgcatgtttggggctcataggtgaacaacatggacaaaataacctctgatatttcagtccagtagtgattcaaggactgtaacccaaatctcaaatgtaggagttttgggttacaaaacttttgggagctgagagcacaggcatcagacctgaaatggaatggacaaggaaggcctctaggaggaggaacattggaggaggttctggagagcgtggagcagtgaatctggcaaacaggagaaagagaagaggaaaaaatgtgtctgtggcacaggccagggcatgagaaggggacagtggattagaaggactgctgggattagcaacatgtaaggagggcaggagcgggaagggcagaccatggagaggctgtgaaggggagagtgggcaggtcaggaagtgacacagggccggccagcccactaaggaatgcatttgttgtgctggtagttcaaatatcagtctcgttccttgcaacagtacctccaggtcaagaagagtgaggatagcctctgtgtctgaggaggtccctgtgcattatgaggaattggttctaggaagaagggagagtgaagaggaacagagaggaccctccagatccagtacgggccaactaagggaacttggatgctcctgttcatgtccctttctccatcactgagactcgccccatcccaccctgaatgcaggttcctttcccctcggttattttgtgcgtctcagatgatgacatgtattgtaactttattctatcacatatgacttttacattatatcatagaaaaagttacttacataaattacttaatggtggattagtcatagttaaaatgttgtcagcttggtaaacaaatgaaattatcacactttagtttttcttcgttgatcatttatgaagattagtgtctcctcatttcatggatgtcacaactacatgttcttaagtaaggtgtatgcttggggtgttgtgttttccctgttaatgttggatactccagtgttcagcaaactataaacctatcaacacacatttgaaaaatccagttgttttgtgttttatttcgtgtatcctgtctttacaatattatatcttttcttctgcttacttgaaatttaatttgctcttctttttctaggttcctaagatggaaacttaggcgatcattgggcatcatcatagggtctacctgccaaatcaggtcttcttcattctgcaaaagtttctcagtcaccacttatatttcatgactttgacccttgtgaaaataccagtcagatatcttgtggaatgtcccacaatgtgtatttgtctgatggtttctcataattagactagaaacaatgtgtaaattaaacatatttttccaaattagaaaacaagaaaaacagaataacatattagttagaagtattaacatagggctggacgcagtggcttatgcctataatcccaacactttgggaggtgaaggtgggcagattaattgaatccagcaattcagcaattcaagaccaatctgggcaacatggcagaacgctgtttctaaaaaaaatgcaaaaaattagctaggtgttgcagcatatgtctgcagtctcagctactcgggaggctgaggtgggaggattgggagggtggcctgagcttgggaggtcaaggttcactgagctgtgattgtgccatagcgctccaacctgggcaagagagtgagaccatatctcaacaaaaaagagagaaaagaaaaaataacagagaaaaataatttttaaaaatcaggtaatgacaaatagggaattccaaatatattgctaatggtctgttaagcttgacagtgcttttagaaaacttgttctgtttagaatagtgttagactcacagaacaaattggtaatataaagagtttacatataccacacacagttttccttattataaatcttaacattagtgtgttacgcttgttacaattaagaaccaatgttaaacattatcattcactgctatccatgctttattcacatgtccttaatttcacttaatgtccattttttgattctggaatcccatccaggatgacacatcatatttagatgtcattcctctttatgcttcataagctgttgacacttccttcaactttcctggtctttcatgacattgacatacttcattaggaagttgtctgattttttttttttttgagatgactctcgttctgttgcccaggctggagtgcagtgacgcgatctcggcttgctgcaagctccgcctcccaggttcacgccattctcctgcctcagtctcccaagtagctgggactacaggcgcccgccaccacgcccagctaatttttcgtatttttagtggagacggggtttcaccgtgttagccaggctggtctcaatctcctgacctcgtgatctgcccacctcggcctcccaaagtgctgggattacaggcgtgagccaccgtgcccagccataggttttcaaaaggaggactacacagggaaattgccattcttatcacatcataccaatgttacatactaatagcatgtcatatcatgttgaccttaatttgattacctatttgaattacttcttatcagattcttccactgttaaattgctatttgttacacttcctgtgttgtacttttgaaaagaagtcattaggcttagtaagaagtgggaagtcattcttcacctctttatgggaagagtatctgcaaaaataatttggaatccttcaacatgtgaaatgtgtcagttttcctccatttgttttatatattttttcactcatttatttatatcaatatgcaaacatggatctttattttacacttacattttactagtttattttgttgttcaaaattttctactcttggctattggaaggtcttttaattggctactatatcattttcgtatacacactcctagtataatggcatgaatccgtttatgaggctaaagccctcaaggcctaattaccttttaacagccccaccttttaatactgctacagtggcagttagtttccactaactgtaggggacaaaaattcaaaccatagcaagaacataccaaaaccatttttaaaaacaataatgcatttatttctgcaaaaaatggccataaagggccacctttatatgtgatcatgtagatcaccctctatatgataaggaagacaaatggagaacgaattagatagagaactgttgtgaattaaagtattaggtttggaatacaactttttgggttgattgctcatatttcttagaacagaaattctcagtgtacaactttaactctgaagaaagctacccatccaatgaagaagtagcaaagtgactgtttgccatttctatcttccttctcaatagatttattgaaacatagcatatacatcacctctccacatttgttgtacttttgttatttctagttcattcttgaggtttctctttaacacagcgactattaattctagcccagttggccaggagctgtggctcacacctgtaatcccagcacttgaggttgaggtgggtggaatgcttgagctcaggagttcaagacctttgggcaacatggtgaaaccccatctctactaaaaacacaaatttagctgggtgtggtgatgggcacctgcagtcccatcaccatactcgggaggctgaggcaggagaatcacttgaacttgggaagcagaggttgcagcgagccgagattgtgccactgcactccagcctgggtgacagagcgagactccgtctcaaaaaaaaaaaaaaaattctagtgctgctcaagaagcctctagaagatttgttcatggatgtttacattgtgcctttcagggtacacttttttaaatcttattttacagccaaatacataattatctgatttgtcagtggttttattctccattgtgaaatgtaaagtaatgatgcaacctataattgatgtgaataatttattttgcaattactatttatgtcagtatcagcaaatactacattcatttgtatagatgatattaatctacaggttttatggattattagttcatttcatcctcacagcatctcaagaggtcggcactagttttactcccaatcacctagtgaatttgatctaaagccctacaagaaaggaatggatgaaacttgattttgactgagtctatctttgaagtctttacttacatcacgtgttttagaatatctttttttgtatggaaaacacattctaggaccggattaagaaatgttactctagggccaggcgcagtggctcatgcctgtaataccagcattttgggaggttgaggcaggcagatcacgtgaggtcagaagtttgagaccagcctggccaatgtggcaaaataccgtctctactaaaaatacaaaaaaattatccaggcatgctggcgggcacctgtaatcccagctactcaggaagctgaggcaggagaattgcttgaactcaggaggaggaggttgcagtgagccaagattgcaccattgcactccagcctgggcaacagagcgagaatctgtctcaaaaaaaaaaaaaaaaaaaaaaaggtattctaccccggaagtcatgttcccaaattagatgtaaatcctgtgttaaattgatttaatatttaggtctaagatccacctaggaatgattttatgtgtaatgtgaggttatagatcagattttatttttccctgtggatatatttcttgaaatatttatagaaaaattcacatttccccaattaatcttataaattatttgtgtatatatgcttgtgtctgatttgctctctcctttttttttccattggtttatttctctgtgaaaatatcacactattttagtaagacacttcatttaacacagaattttctctctagggccttctcttagccaagtgtgctattatataaagaagaaagagtgaaaacctctatgccttgaacctacaccaatattctcagttgtcccttgaataaagagcagaatttagaactcactattactgatgacacttaggtctttaatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtggcagaaacccctgcagacatccttcttgcgcaagcgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 1588 - DNA, 154936 bp, Homo sapiens; identical to SEQ ID NO: 1587

SEQ ID NO: 1589 - DNA, 154936 bp, Homo sapiens; identical to SEQ ID NO: 1587

SEQ ID NO: 1590 - DNA, 122032 bp, Homo sapiens
agctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 1591 - DNA, 23595 bp, Homo sapiens
cagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 1592 - DNA, 36025 bp, Homo sapiens
tgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaacagtggtcctatctgagtggtgccattatgggtgacttttttactcctttatatttctcaaaagttttacgagcacacaagcctttgaaatcagaaaaaaacattgtctaaatttttttttaaagcctaatttctcatgctactcactgtcctcctcctcaacgtccaccccgagccacctcccctggaacttggggtccatgtaagtacttgccctaggagaggcatcctccgtgcccagcccggggcaccctgccaaggcccagcgatggccccccaaccattcttccacctgtcccatactcagatccttctggccttgggccccacgcatgctgcttctccagggccgcatggcccttctcaggcttcgaagtactttgaacctttgagcactttgaactcccatcaccccagctgcctatacaagacctttctggaaggcagagcctcaaaaacatgcagaccctttgaaccagcaacctcacctctaggaactgagcccaaggaaatagcagggttgtgggcagccattgagttacagcaatagccgtgagacaatggaagtagccttcatgtccagctgtgggggactgattaagtacacgtgcacattggccgggcgcagtgactcacgcctgtaatcccagcgctttgggaggccaaggcgggtggatcacgagatcaggagatcgagaccatcctggctaacatggtgaaaccccgtctctactaaaagtacaaaaaaaaattagccgggtgtggtggggggcacctgtagtcccagctacttgggaggctgaggcaggagaatgacgtggactaaggaggtggagcttgcagtgagccgagatcgcgccactgcactccagcctgggcgacagagcgagactccttctcaaaaaaaaaaaaaaaaaaaaaaagtacacatgcacatccacatccacagcagagagtgccatgcagccgccgccaaaattcaggcaggagctcatctgtcttccacttaggactggagtccccagaggatgtagaccaggggataggggtaaggtgtatttgtaccccaaggcgcagggccaggcctggtgccaggaggccacccagtgattgtggaacaaacagcaatgctgaaagatcttactgaccaggtgctattctgggccacacaccatgacctagagaaaccttaagaatcctcaggcgaaccccattttatagatgaggaaactgaggtgcaaggagtcagtcacgtgaccaagtgacaccctcgggatgaggcctgagggcctggaataccagccccacatcggctgcagacacggccttcccacttcagctccctctgctctggcacactcccacaccccaacatccagccttcaggcaaggtgaggccctggcagctcctggcaggctcaggggcccagtggccagccctctgcagagagagaagggcttgggcctgcggagaggggtttggagaggcctctgacctccgagggggaggtggagagccggggtcaggagccctgggagtttcccctgctgcacccacccaacctgcccctctctggaccagacctgccatgcagagtcaaggactccggggagctctgggtgcagcctccaggacccccaggtgtgagaggacagggacatcccctgcttcatggctcactgcctgctagaaagtgcagaaggcagctcttgacatgatttatggcactggggagatttcataaactccaccagccgcagagaaggcggggaggctccgcagttgctggaagggagtgccctagctgccagccaagcctgggctccctgcagggccacagggacagtggggatccccagggagggtgtgatcctggggagccccttcccctgagcctcaggcccttcctctagaaaatggggcagattcctgggaacctgggacctcctgggtccaagtctcagccccgtgcccctgcctgccctgaggtcccgccagtagacaggcatacccagtgcctgctcacacacactggcacactgccagggccccagacacgtgagccaaagccttggggacattgaggtgcgtgtctggcacaactctgctcgtagcttctctggtgacctgtttgtcctgtgcgtgaggacaggagccactctcttgcattttcccagccgcggtcctaatcagaggaaacagagtcgaggaggaggatgggccaggatggcagcgcccgcccagagaggggtgcaaaggagagattaagagggatagagtcgcaaactgaagagccaacaatgggcagcagggccaggcctggccttgccgagggattagtctgtgtgtctgaggccgccgctgctcttgacagatccctcagggtcagtctgcggagggggataagagctatgccaccaggctggggcttcatggacccccacttccccatgtttacaaggagggctggcctggctcactggagaggctcagctcagccagcggaggttggagcccgcaggtctcggttccccgaggtggggtgggcagctctctgtgccttgtactctgggggaggaagcagataccctgagaggaagagggggtcccccaggcttccagaccaggccccacaaaaggctcgcagcactaacacctggggaacgcccgaacagcagcctaaatgctcattcatgcagtaaacctgtcctgggcacccccaagtctgcccaggccatgcaggagaagcgggggctgggaggggtgatgtctcagctagagcttccaggacaagtctgactctgccaggcagagaggtgggaggcagtttcaggcaagaaaatagcatgcgcaaggtgctccaaaatcacaaatgatgcctcatctaagctgctgccgagtgtccagtgggaccaccagtcaggccagaggcaagaggtgagaaggtgagatccgactggctgcggaggcatcagggagggtcccccgccccagccccagccccagccctgcaaatggggctgtgcggccagaggtggaggatgtggggaagcgccagggccagggtgcatcagggctgctgtgtggaggatcccccgcgggagcagagggaaggtgggagaccagggaggggccgctggggtgcccaggagagccagggtggaggaagaacattgttgctgcagcactgcctccaggctggagagggagccaggaagaaagtgaggtagccttgcgggggctggggctggaatccaccccctcccattaagcagggtagggggtgtggatgcaggggaggggctcaaagcccaggacggagggaaaggctgctaggcttcaggagaccagcctgcccggagacagttatggacgcccaaggcagcaatggcaaaagcaggaataaacggtcacctcccttcccacagcccctttttctcaaggctggacaggcctgctctgcctagagaacaattcattttggccccaagccctcaggaggcaggaggaaggcaggtggcagatcccctggaaggggccaggctgggtggccagagggacaatggcccagagcacagggctcagaccccctacagccaaggtgggctccagttgcagaacaatcattcccaaaacagtcactgccatcagggcagcctgctgctgccactgccactacccacagccacacagagccttgggccagccctgaacttggtgtcagaggcagcctggggtctagacacagagcagggacctagctctctctcaagtgagggctaagggcagcagggcacgtgtgatcaggatggccccacctcctggagaggttaagattcctcagatgcaaaatgggggtgccaatctccctgaatgcccccaaacactgggaacactgtaagcaccaaactcaattctcatatggtcaccacttcaacctgtgactaggagccagtcattcagcctcagtttccccatctggtaccctagtcccccaagtctcaaattcatagcgccttgtttcagcacagggatgcatctgtctggaacccaggcaaggactctggggcaccccatctctaccccacccattggtgctcactccagttcagccacagggactccatgaaaccttgtcacagccccaagagacagccgggcctctgtgactcgctcccagcggaggacaccatggacccagagcagggaggcgagtggctggtgcaactcggttagcaggtggcagagtgaggatgggactcataggagatcctgtccaagtagcggtgcaggggccagagctttctgggcagcctccaaccagctcaagccttttgcacacgggctgaaggagtctggggtgtaggacgtggatccctggacagcaaccagtcccaaaggaggtgctcacatgcacaaagacaggatagaacccctttagacgggacccttcagacaggaccaggaggagagaatgtcacactccaacgtttgagtcatgtctgtaccacatatacttttaaggtggggagacaaaaactgaacacggatttaaaataaaggtaaaagacaaagttagttttaaaacacctttactggctgggtgcggtggctcatgcctgtaatcccagcactctgggaggctgaggcaggtgaatcacctgaggtcaggagttcgagaccagcctggccagcacagcgaaactctgtctctactaaaaatacaaaaattagccgggcatggtggtgcatgcctgtaatcccagctacttgggaggctgcagcatgagaaatgtttgaacccaggaggcggaggttgcagtgagccgagatcgtgccactgcacttcagcctgggtgacagagcgagactccatctcaaaaaaaaaaaaaaaaaaaaaaaggctgggcgcggtggctgacacctgtaatcccagcactttgggaggctgaggcgggtggatcaggagggcaggagattgagaccatcctgggtaacatggtgaaaccccgtctccactaaaaacacacaaaaaaattagccgggcgtggtggcgggtgcctgtagtcccagctactcaggaggctgaggcaggagaatggcgtgaaccccaagaggtggagtttgcaatgagacaattgcaccactgtactccagcctgggcggtagagcaagaatccgtctcaaaaaaaaaaaaaaaagccgagtgtggtggctcatgcctgtaatcccaacacgttgcactttgggaggccgaggcaggcggatcacctgaagtcgggagttcaagaccaggctggccaacatggtaaaaccccatctctacaaaaatacaaaaatcagccaggtatgatggtgggtgcctgtaatcccagctacttgggaagctgaggcagaagaatcgcttgaacccagaggcagaggttgcagtgagctgagatcacaccactgcactccagcctgggcaatacagcaagactccatcacaaaaaaagaaagaaagaaagaaaaaaaacaccctcatagtctctttcactggagcacagagaaggcaagaagtttggccttcacctcctggcagagctccaagggaaggcctcttcccccagactatctggccaggtccccttggcccaggccaggccaccattttgtgaagccacaccacagaggtagtcaggtctgaagcccgttgcaagatggggaaagcaaggtagtcgggatgggaaaacgtgttcaaagtcgcatgcggctcctgggcgcagctttatccccttttcctcccctccctccttcaactgctggaggaagagcccaggagctcaggcttcggttttggccgccagcctttgtctgcccctgcctgccctgtgccccgttctgatgtgaatatcacccgaggcccttccctcaaagaggaggaccagggacatcacgaagcacacaccccaaggaccccgatccagcagctccccttctacttgtgagcgtcccgagggctggggccatctccagacccccttccttagaaaggcagtgggaccaggacctcgtcatcacgcctgtgcaatcccggctctacattttcccgtctgtgtgccctcgggcaagtcgcaccctccctgttttcccttctgcaaggccctagaggcaacagtgggcagcagtgcatggtgaccacagcccaggcccctccctctggcaacggacttgtgacttgcagccaaatcagctctgccgcctgcctcccctccagccagcacagactccaacaggggcccagctttgggagaggctctttcaaacacccctcagcctctggccagggcctggggccccaagggctcctcggggagctatgtgtaggcaactttattcggcccctgggcctgggcagttcatggagattcctgagcctcaggaaggggaaggcgggctggggttttgcccccagggggcacagcgggagggaaccctggggacctgtacctgctacttggggctgagctcagccgcttggctctcttctccagccagtcctccagatggccctcggggagctcaggagcatctagtagccactccctggctcgcctctcctctgtggggacagggagacaaaggcaagtgaggggtacactcctgcctgccagaaccctaccctctcacaaagcagaagcaactggtaggccctgagcaagcctgggaagttgcagcaaccttccaggaggatgcacctggactgcttctccaggccatctgtgcacgagggcccagcactcggcctcgctctgttttcccatcaaatagagacaaccccggctgcctccaagctcttggggagctggaaacaggacagtgcttgtagagaacctggccctggccaggcgtggtggctcacgtctgtaatcccagcactttgggatgccaaggcgggcggatcacctgagtccaggagtttgaaaccagcctggccaacatggagaaaccctgcctctactaaaaataaaaataaaaaaaattagccatgtgtggtggtgggtgcctgtaatcccagctacttgggagactgaggcaggagaatcgcttgaacctaggaggtggaggctgcagtgagctaagatcgcaccactgcactccaacctgggcggcaagagtgaaactccatctcaaaaaaaaaaaaagagagagagagcctggccctaaggaggggtctgaatctgaggtgcagggaggcagtgagggcagtcgaatggggtcacatctcagctctgtcacctgccgggtctttgaccctgggcagggtaatgagcctcagcttccctggtttttattctcataagctgtccaacaaaacctgttgctcaacgaattaaaaccaatcaacgaatggaatttatacaagctgggtgtgagcgtttgatggggtcagagtcgccaagtcatctgggatggagtcttgggccagaggaaagtaatcatacacttgactagcactcactcagagccaggccccagtctctggagctcactcggggccaggcctcggtctctggagctcactcggggccgggccctggtctctggagctcacttggggccgggccctgggctgtacaggtgtcatcttgcttcatccttagagacatcacattcgacaggacacagcctccaagaggttaagccacgtaccaaggttacagaggacgtggcagagctgggactgtcagagctgccagctgggactctgttcccagcctccctgggcctctccccattcctgtccccgctcggcatcgtctccagttccaggcccactgccccgtgctcgtcccaccatgggccagccgtcctctgagagcccatagccagggaagagctgcagctgccgctgctgccaggacttgctggccagtcccacaaggccttgcttccaccctggggaaaaatgctcctggaaaccctgtgttggtcccggggctgcagccacagcaccactggctcccagggcagggcacggagcctgcagtgtctaactggtcagaggggagtgaggcccgtagggggatcagggcaaaggccaagctgccccagaccttcactggctaccctgaggcctcctggacagagaagcttaagggggcaggcactgagagacctggagtctgcccccaacctgctggggggctcacgcgaggcctttcagtctgaatgttggccttagtttccccacctgttcagtgagaggctgtggaagaagattgataaacaccatctcagtcagaacttccttgttctctaactagaggagtgaatttcccaaaggcgagatgtcagtttccatggaagctgaacttgcccctccctggaatcaccaggctgtgagactccagagggcagggaaggtgcgttcctaaactccttatccctagactgtcgtaaggggtctgcttggtgccaagtggggactgggtatgctgcctgattgaggaagggatggggtgtacccaccaatgactgctgggctggccacagggtccaggtggggctgaggtgcaccttcagggctcccaggcaggaagccacacaggctccactgtaaggggacacaggcctgccttctccactcatgctgaagctgttcctaacacctggcccaaaccgggggctcagggctccgcatcaccctgggtggcccttggttgccaatgatggggagatagggaggcataggccagcttccccggtctcagagcccacatgccccagcaccccactcccgcttagcccagggcatcccgagacgtaccctccacctggatgctcagctcctgcaggtctcgctctgacatgtgggaaaatctgcagttggagccaaagtcgcactggcctgcagcaggaagacagagttactcgctgctcgggaggggctccccacaggggctgaggggtgcccagatgagggatcccagaatcttaggggcaggacttcagggcctaaagaatagcaaccctgatccgggacagaaaatggaatctctccggccctgcccattcagcagccagagcgacttctcacctatcatgccacatgctcacgacccttctccagctgccccccatgctggggatcacttccaactgaagcctgtcatgactgggcctcgcaagcctctgcaggctgtctctgtcaccagccctcccagccctgcctcgatgaactacatatgggttcctgaaagggcaatgcttcctttctccactccaagccgcagcacgtgctatgcccagcctagtattctgcctgcctacctggctcacgggagcaattggactgctccttagaaaggcttcagtggcagctttgccaaagaggcaccaaaatctggggtggcttcccctctttcaaccaaggagaccaaaatgtatgtcgagatactgggaggctggaggtgtctcaagccaggataacctaccagtgacatattcacatcaaggcaaagtctgtagggaagcccctgatctgcaggcttggtgcccatcctaggggagcttggacattcacccagtttccctagttcagctgcagcacctctccccagtgctaagctcccttacaaaccatgtgaatcatcatagttttcctctttgccatggctgccaggaagctcagagccaaacccttagagaatacataggacctcaagggcaagcatggaggagactattctcttggttttatcttatttttcctactcttatttgtatctgtctttggttccttcacttactgaggttttacctcttgctctgtctttttttaaaagagacagggtcctcactctgttgcccaggtgggagtgcagtggtgcaatcatagctcactgcagccttgaactcctgggctcaagtgatcctcctgcctcaacctccctagtagctgggactaccagtgtgtgctaccatgcccagctaattaaaaaaaatttttttggtagagatggggtctcgctatgttgcccaggctggtctcaaactcctggcctcaagcattccttccacctcagcctcccaaagtactgggattacaagagtgaggcaccatgctcggccctttatctctctgacctatatgcatctctagtagctgagtactgagcagtcaaatctacacctagcatccttggttctgatcctgaacttcctcagatcatcaaccctgttactctctgaagttctgcctgctgggaaggaggccaggttcccaggctaacttaatcaacaagtctattccacccataagtgtctcttggatttacatgtaatctcccacgccttgcttgttctaggtgagctgatataatcacattctagatctgaagagctgaggaccagactctaggaggtcctgagacacacttgggaaggccctgactggccagtcagctggagccactgctgcaaagtgggcttgggatggtggcccgggtcggggaagacactctgcagaggtccaagtggggcaggctggatatcgcaggtccccgcagggacctgagctgtgcagaggactttacctgtcagtagaaacttcctgcagggccgcttgttctgctcatccagcaagatggcagctgcatctgcgagagaagagagggacgggattcggatggttcaggctccaccaaaggaggcaggaagtggaagccacaggggcatatggaccctttatctcgacacagctgtgcagaaagaagagtttcctgttccacggaggagtggaagcaggagatgaccacaggtgggagtcctgggcagatggatccgagctgcaggtgacctcaatccatcccaccccacgcaggacgggccaaagacaaggaccaagtttcatgccagcagttctcaacttggcacgagggagtcagctggagagtctggggactttgggtttttttgttttttagagacagggtctcgctctgtcacccaggctggagtgcagtggtgcaatcatggctcactgcagccactacctcctgggctcaagtgatccttctccagtctcagcctcccaactaggtgtgactacagctgtgcaccaccatgcccagctaatattttttatctttttgtagagctggtgtctcattatgttgcccaggctggtcttgaactcctgggctcacacgatcctcccattttggcctccaaaagtgctaggaatacaggtgtgagccactgggcccagcctggaggtataatactttaaaaaaatcctggcactatggaacttctcattattatctttgcaacttgctgtgaatctataattatttcaaaataaaatgctaaaaatttttaagtaaatcctagtgcccaggaagcccaccagccaatcccaggatccaggcactgctccacaggcaagactgcaatccctggcctctgtctcccctccttccaccagctgtagggcactcagggccagaccagccaccgccgcggacaggacttccgacaatcactctgtagcatcggcaatcactctgatcctaatcttaaccctagtttcctctgatttttcctatttttcttttctttctttgagacaagttctcactctgtcacccaggctggagtgcagcggcatgatctcagctccctgcagcctccaccttctgcactcaggtgatccttccccctcagcctcccgagtagctgggactacaggcgtccgccaccatgcccggctaattttttaatttttttgtagagatggggtttcgccatgttacccaggctggtctcgaactcctgggctcaagcgatcctccccacttggcctcccaaagtgctgggattacaggcgtgagccactgtgcccagcctatctttactttcatcatataggtatggttttaaatttgcttcttgataggcaagctattaatcagtcaaaatctgtaaggaagtagggtacctgaggatggtatcctgactcaggaacccttatatccaccccaggggaggggagaggcaaggcctgggctggacattcacccaccaccttttctagaggccaaggaaagaccacaggctccagagtccaagaaacctgagctcaaatcctaacaacatatgaccacgtgcaagctgcataaactccaagtctcagtttccccatatgtcaaatgggaggatagttcccacctggcagggctgctgtgaaaatgtcatcagataatgaatggagagtgctttgcagaggaggcccgtggctcccaactctggtggtacatgagaatcactaggaaagtgaccaggtttgcctctggggccagcagtggccttagcaccatgttctccaggtatacggccaagactgggtgggtacacagcaaatggtagcaattcttcattttttcctcacaaaccctctgaacagcgcaaacatccccactttgcagaggggaaaacagaggttcagacaagggaagtgatttgccaagggcaactggtggcttgtgggaggcgggggcgggcggggggtgtggtctgctgggataaggagttggttgtcagagaactcatgccagggggaccagcagggtggggagggtctatctgttagcgccgggcttgtcagactcattgtacccagctggtgctacagacaccactgcctgcctttccctgaggtgggggggtactaggggagggcatgtggacattgccctggacccccaaggctgggatgactgaggcaggcggcgggactgagcctgggtcctatacaaggggctgtgccaggtggcttggggtgggagaagaattccaggctgcccacgtccgcttagtggttcctgaccccagccacacatcagaatcaccaggcagtttttaaagtacatggacacccggccccagccctctcaggttctcttttaattcattggaagggagggcatcagaattgtttaaagctcctcggtgactctgaagtgtactcagggttgagaacccctggcccaggccctgcacgaggaagcccatgctcttgcagtgggtattcaaggcccctcatgatctgatcctattggtccttcttgcttcatctcccagatgaacagctgcccctggtgcctcatgtttctttgctcaatcacttagacattcatctgccaaacattcactgagcatgtcctgtgtgccaggcaccacgccaggctgaggatttaagtggagaacaagtcggagctggtccttccttctggtccaacagtcacactaatccctatggatgtaagcggggtaaacatctagcgtgtagccaaacgacctgacccgttctaggggtcggggaggacgtccctgaggatttgctgcctgacttgagttctgaggtggtgggggggcctggcttggggcagggaggacagcaggaagggcatgtctacagaggggacagcttatgcccagcagatgcagtggccagggtggctgcagctggaagggagaggccggcaggtcatggaggcctgggcaggacaggggctttgcccagaacacaccattctaattgggcgcaagctcgctaggcagaggggccctattttatccacctttgaatctttagagcctgcctgggagccgcggacatgctgaatgaatgagcccatgagatgaaggctggagggaatccttctgaggacccacaggcaccatgcctacttagtaagctcttatgtgccatgcagtcatcatgaggttactgagcccctgtcatagccctggaaggtggggactgttgtagctgttttatacatgacaaaatgagggccacagtgttagtgagtgacacctggggactggtgccctgcacctgaccatggcggatggatcatcagcccctctgagggctaaggggacgtggcccaggccaagaagctgggagcaaagctgaagtcgagttcattcacacggtatatccgcaagtccctgcggttgctcagagtgagcagaagccctggggcagcctcctgaggaagtggaaagaggtcatgtgccagcttggtcctcggtagctggggacccaaggtgagggaacccactgccctggattttatttcatttatttatttttttttgagacagggtcccgctctgttgccgaggctggagtgcagtggtgcaatctcggctcactgcagcctccacctcttggggtcaagtgatcctcctacctcagcctcctgagcagctggaaccacaggaatgggccaccatgcctggctaatttttttatttttgtttttatttttttgagatggagtcttgctctcttgcccaggctggagtacagtggtgtgatctcagttcactgcaagctccacctcccaggttcaagcaattctcctgcgttagcctccaaagtagctgggattacaggaacccaccaccacgcccagctaatgtttgtatttttagtagaggcagggtttcaccaggttgaccaggctggtcctgaactcctgacctcaggtgatccacccacctcaaacctcccaaagtgctgggattacaggcatgagccacggagtctggccaaatttttttatttttagtagagatggggtttcactatgttgcccaggctggtcttgaactcctggactcaagcgatcctcccacctcagcctcccaaagtgctgggattacaggtgtgagccaccatgccctgcctgctctggattttgaagtcaccacctgtaactgggaatgcctggcttggcctgcccagcctcttacagaactgttctaaggactgaatgtgttggggatgtgaggacactgagaacacaggagccctggggcactcctgtcacctgctgcttcatcttttctataagtgacacagggacctctgccaatcagccctggatcccagcatccagctgttgacagctgagaatctgggactaggtgatctcggcccagctccctctagatcacagcccacactggatttgcacagcagggagccttagcgtaacaccagggttagagtctcctagggagctaggagaccccactgcccatgaattttcctgtggccttgcaaccacagccacgcctggcctgctgagcagcctggccaccccctcacttgaacctctgagcctcagctccctcaagtgaaatgcggagtctgggaagcctttagaaacaccatgcctagtccccaaacctgcctctggggaggggatggggttggggaatcagtggttttagcctaaaggtctccaggtgatcctaacctgcagccggagttgagaatcactgccctagagagttgtcgagaaaagcaaatgacgaactatgaaaagcaccagcatgtagcaggcatgcgatccatgctcattccttgtttgtgaactctcagtttcaggccttttttgaggcggggtctcacaatgctgcccaggctgctcttgaacttctgggctcaaacaatcttcccacctcagtgtcccaaagtgctaggattacaggggaaagccaccacacctagccccaaccagggaactctctctccacctctcctcccttcttggctgctggatttggttccttcttcggaggccctgtcccagaatcctgctcaccaacctacagggcatcggccccactctggctcattccaggagctcctggcccaccctcgccccaccgccaagtgcccatatctctcaacctggctcctgccagtcaccctctggaacctccctggctgttcctcagtgtgaatgtccagtgacagccgtgcaacagcacaactcccctctctgggcacctcccgggaaacaggccctgtgctaggcacttccgaccttagctcattcaccccaattgttcttgctctgagaggcctttcccagaagagcctgccttccttctgcaactgggttattcacccgtgcctgcagccagtcattcaactgccactgaccgcacccaactgctccccacgaagcagtctgcgctgtcaaggcaggtctggccacggcagctaaagcccttcaaaggctgctctctgcccttggaacagggacccccccacctccgccccctgcttatgatggcctccacaggcttggaagatccctgccccagagccagcttgagccctaccattctcccctggcctgctccgcccagccacaccctctccctcctgctccgagagccctggtgctggactcagggctgcctgcttctcttcacaccctccacccagaactgcatggctagctttcccctattttagctgttggctcaaacatcacctccttctagggccttcctcctgtccacagagccttcagtcagcgttgttggggaaagagctcacctaccagcctgctcctctgagggcccagtggctcaggcctccctctcttttgatcctcaaagagcccagacctagactgtcactgacccacaggagtctttgatgataagaaagatcagagagcagggctccaggagcctggcccccagccagcggcacccacctcggaacatgtcgtaccagaccttcttggccttgaggtgctgcagcccgttcaggtgcttcttgcggttgtggaggttgtcctggaaggagcggtcgcagtagtcacagaagtatcgcttccccatggccactcagagcaggtgctttgctgcctgggaagccacaaagagctcagattagaccattggagaaaacacatccctcaccagcccactgaatgcttcctgagggccaggcctgagcccaggctttactcatatgcaccccgccccattaggagtgtcaagctgatgagtatggcctaagaggcctcattccagagggatctgttaaccattctgatgcccagcctgcaacttaggccagttaaagtagaacctcagtgggtgaggcctgggcactgttttttcttgagagggtgttgctctgtcacccaggctggagtgcagtgttgcaaacacagctcactgcagcccccacctcctgggttcaagcaatcttcctgtctcagcctctcaaagtgctgggattacaggcatgagccactgtgcctggctgctgtttggtagtttttaaagtctatcaggtgattctaacatgtaagtaggctgaactgccaccttataccctgtggctggcctcccttgtctcctaccacatagggttttatttttttgagacagagtctcgctctgtcacccagggtggagtgcagtggtgtgatcacggcttactgtagctttaaccttctgggctcaagtgatcctcccacctcagtctcccaagtagctgagactacaggtgcgtgtcatcattcctaacttaaaaaaacaatttttttgtagagatggggtctcgctatgttgcagaggctggtctcctgggctcaagtgtcctcccgccttggccccccaaagtgctgggattacaggtacgagccaccgccccatcccctaccatacctctgacctccacatttgcatcatataggccacaccggcctcccctttgctcctcacacatgccaggcacatggccacctcccggcctttgcacccaaggctccccagggaggggtatgccctcctgcaaactcccgcctcacttcccctcctgaccccttccatctttgctccaatgctactttatccaagatggcagaatcttccacttagcttcctccactccctgctttattttccctcatagcatgtatcaccctttgatatggtgaggctttgtatccccacccaaatctcatctcgaattgtaatccccataatccccaggtgtccagggagagaccaggtgggggtaactgacatgggggtggtttcccccatgctgttctcatgatagtgaagagttctcacaggatctgatggttttataaggggctcttcgtgctttgctcagcacttctctctcctgctgccttgtgaagaaggtgcctgcctcccctttcccttctgccatgattgtaagtttcctgaggccttcccagccatgcagaactgtgagtcacttaaacctctttcctttgtaaattacccagtcttgggtatttccttatagcaatgtgagaacggactaatacacccttcatgcaataagttacttgttatgtttactgtctttctcccacaatgagaatataaacccatgagggcaggtttgtgttttgtttactgctggagccccagcacctaaaatagtgcacagtacagagtaggcattgaagtacttgttaaatgtatcaattctcattttccctttgggacaactgaggttcagagagggagtgtgatttgcccaaggtcacacagctgataagcagaaggcaaacccagtcccctaacgttacattgccaggtgtcctctcttccacagccagttcaaggcttagagaagccagagggcgcaggcagtgaatgctgacagcttcccaaggagatcactaaattatcaggtggcaggtccgaatccagtcacagagggaaatgaaaacattttggggtcttaagacccctcagccatggtgaccacagccaccactcctgacccaggagatctgcagcccaaggtgggtggcaattcagtgactctcatggccagcccttgggtccatgagtatggtgctgcaaaacaggaggacagacaggtccactttgggccaccaagggggatctgccaaggctgagcccagaccaactgctcaccctgtggtcagacccctcacttcacagaaaaggttcctgaggcccagatgaggaagagaaatgatttcccccaggtcacaaggtagctatccgggctagcagccaaagccctggactcccaggacctgatcaccacagtggaccaatgggggaacacagctcaggaggaggagactggggagagacacagagacagtcccaacagccaagcaggttgatggagaaagccattcttgcagcagacagggacagcagccattaagtcaggggctgtaatgggatcaggaacagacagtcattcaaaatgaaaacatataaaacctctcttctcccattactgcagagggaccgtgtcccagacacgcacacttgatatattaaatttggcagctctaatacaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaagactctaataataaccataacaattactgttagtgtcagtaacaataatgacacatcaataaccaataacaaccacgtctcatcatcctgagctgccagtgggccagggtgccatggacccccacatcccctcctgtggagtcttcaccatgacactgtgaagccacgtgcctaaggccccacagccaaggcacaccagagctggcacgcacacttgggtctggctgaccccagagcccactctctctccatcccactgtcctgccgtgaggctgctacagggcaaacatttgcgcttcatcaatattctccattcctttcgttgtgtgtgtctcaggtacagaaagagctggctttggcacaaggcaaaaataagccaacagctcggcctttggccaggggctgggatgtgcactataattatcctggacttgtgctcaccacaggcgaccctgaagctcacctgttattttttctaattatggcacctccagaccccaggtaaacagtaaaccacagccagaggacggctttattgcacgcccactaggagctcggtaatgtcccagtgtcatatatgcctgccatctggagttgatggcatcagaaccaccctgtgggggtggtctgcagactgctggtgcaggaccctgttcggaaggaagcgccaaggaaatccagatgtctttcctgaccgaacccccgtatgctagaggcatccttgagatccttgggtggcagccacacacctttttcatcctgacctcatccctgtgtttgcctcctgccctcccctggggtaaggcacatcatctttttcccacaggtctaaggcagcgaggggcccacccactgcaatttctgactcggcaggtctgggacagggccaggatgtaagaaagtcctgattcagactccacagagaaatgcgagtccaggctgggcacagtggctcacacttgtaatcccagcactttgggaggccaaggtaggaggatcacttgagcccaggagtttgagaccagcctgggcaacatagttagaccccatctccacaaaaaaattttttttaatttgaccaggcatggtggcgcacacctttaatcccagcactttgggaggctgacgcaggtggatcacctgaggtcaagagttcgaggctatcatggtgaaaccccatctctactaaaaatacaaaaattagctgggcatgatggtgcatgcctgtaatcccagctagtcgggaggctgaggcaggagcatcacttgaacctgggaggcggaggttgcagtgagccaagattgcaccactacactccagcctgggcgacagagcgagactatctcaaaaaatatatatattttttaattaaaaaattagctaggtatgataacacacacctgttgtcccagctgcttgggaggctgaggtggaaggatcacttgagcccaggagttcaaggctgcagtgtgacgtgatcacgccagtgcactccagcctggacaacagggtgagaccccaatctcaaaaaaaaaaaaaaaggacttcacagaaaaaaaaaaaaaaacagaaagaaatgctagcctaaggtagcagatgatggacagaacagagagggtgagagcatgctcaaggtcacacagaacaatcctttgaagctgttttcccttaaacacaactactctaatcaccaacccaggtctgaatccagtccctgccactctcaggttgtgtaactctcagcaaactgcttacctctgagcttcatctggaagacgagggtaatgactctatttcataagattactgtgagaattaaatcatgcatgctagctgcttagcacagtgcctggcacgccaatggtgcttcacacacgcttgtgcatgttgcagccagcctccaagcccccagcaatcccacctcctgattttcacaccttgtgtagtcccctccaagctgggtcagggttggtctatgtgaccaagagaacagagcagaggtgagggtatgccatttccaagaacaggttataaaagacactgcagggagggcatggtggctcacacctgtaatcctagcactttgggaggccaaggcgggcagatcacttgaggtcaggagttcgagaccagcctgaccaacatggggaaacctcgtctctactaaaatacaaaaaattagccgggtgtggggcgtgcacctatagtcccagctacttgggaggctgaggcaggagaattgtttgaacctgggagacggaggttgcagtgagccgagatcgccactgcactccagcctgggcaagagaatgagactccatctccaaaaaaaaaaaagacactgctgcttccatctcagtgtcttctttctctgatcacttggtctgggggaagccagctgccacactgtgagcagccctgcagggtggcccacgtggcaaggaactgagaccccctgctaacagccacgtgaatacatttggaagcaaaccctctggccgcagttaagccttcagaagactccaccctggctggtatcttgactgcaacctcccaagagactcagccagaaccactcagctaagcagcgcccagattcctgaccctagaaacagtatgagaaaataaaagtttgttgctttaggttggacgcagtggttcattcctgtaatcccagcaccttgggaggccaagaaaggaggattgcttaagtccaggagtttgagaccagcctgagcaacatagtaagaccctatctctacaaacagtttgttttttttaaattagctgggtgtggtgatgcatgcctatagttccagctacttggggggctgaggtgggaggatcgcttgagcccaggagatgaaggttgcagtgagccgagatcatgccactgcactccagcctgggtggcagagcaagacctcattcaaaaaagaaaagaaaacttaataggattatgtccagatttttttcatttggtatctattttttaaagtttctatatttggcatgtattgttttaaaatttacacacacacaaaaagtcccttcaaaaaaagtggggggctagtccaagtgcagcagtgttggtgactaactgatcacaaccagatacagatttctttgttccttctgcactcccactgcctcgcttgactagcctctaaaaaagagaaaaagaacaagagggaaatttgtaaggcggggataaatcctattccttctccctctggaggctgccatggagggttccagagacctggttcactcggatgaaccagccaggggtggtaagtgaaagaaatagagcagacattcccctcaccccctggatgaagactgacaaggcaaaccctgattccaaccagacttggcctagcacaccccaaggcctggtgaaggtcggctgagcctgaatctgggctccaggaactgcgggctggagacaagtttctcatcagatagttacaggtcccaagaggccagagtttccaaataggaaaggtaaaaatagtctgaatgaggctcctgaaccagatacttggactcagaactgtctctgcctcccgcttcttctctcccgagtctgggcaccaaatatcatctgatcctctatctccactgtcactactgcccaagaaagaactcagctcctcacctctggactcctcacatctggacagccccctccattcactgtatcataagcagcatcagatcaactctccttaaatcatccctgctcaaaattttccatggcttccaagtgagaaacttattaaaaatgaatctcagctaaatgcagtgactcacacctgtaaccccagcactttggcaggccaaggcagatcagttgaggtcacgagttcaataccagcctgggcaacatagtgagaccccgtctctaaaaaaaaattttttttttaattagccagttggggtgtcatgtgtctgtagtccttgctactcaagatgctaagatgggaggatcactggagcccaggagtctgaagttacagtgaactctgatcatgccactgtactccagcttgggcaacagagtgagaccctgtctcaaaaaaataaaagggggccgggcatggtggctcatgtctgtaatcctagcactttgggaggctaggcgggcagattacctgaggtcaggagttgaagaccagcctggccaacatggtgaaaccctgtctctactaaaaatacaaaattaggccgggcacggtggctcatgcctgtaatcctggcactttgggaggccaaggtgggtggattgcctgagctcaggagtttgagaccaccctgggcaacatggtgaaaccccatctctactaaaatacaaaaaattagctgggaatggcggcacgagcctgtagtccctgctactcgaaaggctgaggcaggagaatttcttgaacccgggaggcggaggttgcagcgagccgagattgcaccactgcactccagcctgggcaacagagcgagattccgtctcaaaaaataaaaaaataaaaaaaattagctgggcatggtggcaggcgcctgtaatcccagctactcaggaggctgaggcaggagaatcgcttgaacctgagaggcggagcttgcagtaaaccgagattgtgccactgcactccagcctgagtgacagagacagactcctctgtctcaaaaaaaaaaaaaaaaaaattagctcagcgtggtggtgcacacctgtaatcccagttacttgggaagctgaggcacgagattgaacccaggaggtgaaggttgcagtgagcccagattgtgccactgtattccagcctgggtgacagagcaagactctgtctcaaaaacaaaaaaatagtctcctgggtcaggtccccagaaatcctgatttagcagatctggagggggacctagaaatctgcattttaactagcaagtctaataccccttaagaagcaaaagcctggaggaatgaactttcccttgagttccaaatgcagcctctgctggggacagttattctgggtagacacagccccctggactcatgtcccagctagaaatcagtccaattatgaataacctcaggtcactgaagtggtaatccaacttgatgctaagcacaattagttaaagtggataaagctgttttcttactagataagtgtcttgtcacactcctggaaagtttagaattaaaaatagaagcataagagcaaatcaaattcactgtattaatgttcctatcctaaatttagtaataatctgtatattttggaattaaaaagtagctgttggccaggcacggtggctcacgcctgtaatcccagcactttgggaggctgaggcaggcggatgacaaggtcaagagatcgagaccatcctggccaacgtggtgaaaccctgtctctactaaaaatataaaaattagctgggcgtggtggtgcgcacccatagtcccagctactcaggagcctgaggcaggaggattgcttgaacctgggaggcggaggttgcagtgagccgagattgtgccactgcactctagcctggtgagagtgaaactccgtctcaaaaaaaaaaaaaaaaaaaaaaatagctgtagacagggcatggtggctcacacctgtaatcccagcactttgggaggcaggaggatcacttgagcccaggagttcaaaaccagcctgggcaacataggggaaccttgtctctacaaataatttttaaaaaattagccagacatggtggtgcgggctcgggcctgtggtcccagctactactgctcaagaggttgaggtaggaggatcgcttgagcccagggagatggaggctgcagtgagccaagattgcaccactgcactccagcctgggtgagagagtgagacactgtctcagaacaatcctactgggaactgtgcatgcgagggatctaggttatgtgctccttatgagaatctaatgcctaaaacaaaaaaagtatctgtaatattgaaaaaaaaatgtgatatgttgagtgtctaacagataagcattgtgattcctatttaaaatacaaaagttaaaatatagagttagtgacaaaatatatgtcagtaattgatattagagttgtgattttagattgagaggttagcaatgattggaaatatggactgtataacagaattacctggggtgctgtaaaggttactaaggggccccccatatattcctatttcatgtcagaaatacagcctgtttttttgtttttgttctttttagctccctaaactaagagccactgacatagagaattttactaagtctgtaaaaataattatttataagaacttgaaattcattataagtttaattgattagattttgtagtaactctttactctggggaaaactgtgcttgttatgttattcatataaagtacttaaaaagaaaatcaaatatattaaatttacaaatagatttaaaatgttggcaggaatgaaattaagctgtaaatagggatgagtgtcttgagaaattcagaatcttcaacttgagttcaaatattaataaaaaaattaaggtcatttttcttatttgccgatatttatgtattgaataataatttctaagttgaaatacatggcttaaagcaggggaccccaacccccaggccccggaacggtacgggtccatggcctgtcaggagctgggccgcacagcaggaggtgagtggcaggtgagtaagcgaagcttcatctgtatttacagccactccccattgctcgcattaccgcctgagcttcgtctcctgtcagatcatcggcagcattagattctcataggagcacgaatcctattgtgaactgcgcatgcgagggatctaggttgcacgctccttatgagaatctatgcctgttgatctgtcactgtctcccatcacccccagatgggaccgtctagttgcaggacaacaagctcaggcctcccactgattctacattatggtgagctgtataattatttcattatatattacaatgtaataacagaaataaagtgcacaataaatataatccacttgaatcatcctgaaaccatccccctcctgtatcccgtccatagaaaaactgtcttccacaaaactggtctctggtgccaaaaaggttggggactgctagtttaagggaaattacgttttttaaatgattacctccgaatgagaatttaaaagataaaatataaaaccaaaatccagtactttgagaggccaaggtgggagcatcccttgtggccaggagttagagaccagcctgggcaatgtggcaagaccctctctctacaaaaaaatttttttaaattaggctgggtgggaggccgagacggacagatcacctgaggtcaggagttctagaccagcctggccaagatggtgaaaacccatctgtactaaaaatacaaaaattatccgggcgtggtggcaggtgcctgtaatcccagttactcgggaggctgagagaacagaatcacttgaacccaggaggcagaggttgcagtgagctgagattgcaccactgcactccagcctgggcaacacagcgagactctgcctcaataaataaataaataaataaataaataaggccaggtgcggtggctcacacctgtaatcccaggattttgggaggccgaggtgggtggatcacgaggtcagagattcaagaccagcctgaccaacatggtgaaaccccttctctactaaaaatacaaaaattagctgggtgtggtggcgggcgcctgtaatcccagctactcaggaggctgaggcaggagaattacttgaacccaggaggcggaggttgcagtgagccgagatggtgccactgcactccagcctgggcaacagaacgagactccgtctcaaacaaaataataataataataataaataaataaaaattaggctggggagatggctcatgtctgtaatcccagcactttggaaggccaaggtgggtggatcagttgagctcagtaatttgagaccagcctggccaacatggtgacacccctaaatttttttagtctttacaaaaaatctataagaaaaccagaaaacgaaattagtggggcatagtggcatgcacctgtagtcccagctacttggaaggctgaggtgggagtaccacttgagcccaggagttcgaggctgcagtgaactatgatcgtgccactacactccagcctgggcaacagagtaagaccctttctcaaaataataatagtaataataataacccagcatggtggtgcacacctgtaatcccagctatttgggaggttgaagcaggtgaattgcttgagcccaggagttccaggctgcaaggaactatgattattacaaccaggaattatgtgccactgtactccagcctgggcaatggagggagaccctgtctctacaaaaataaaacataataaaaccaaatgaaacaagccacacctttaactccctgtggtcttccctactcatttctccctcctctgaacttcccatcagccagattggttggaaatgattagcaagacctaagtagtcttcccctggagcctcacaacttcctgctctgaggggctcccaggatgctttgcaaatagtataaaaccacagtaaggataactcatggatgtaaagcatttcacattttaccttctgatcccctaacctggtattactgttgctctttacagatgaattaaaagagagttaaagcctgatcaatgtcagagtcagaggcagagccaggcctgcaatccaatccctagtttttgtttgttttgttttcatttgagctccatcacccaggctggagtgcagtgacgcgatctcagttagtggcagcctccgcctcccaggttcaagcgattctcctgcctcagcctcccgagttgctgggattacaagcgggtaccaccacacctggctaatttttttgtatttttagtagagacagggtttcaccatgttggccaggctagtcttgaactcctgacctcaagtgatccacccaccttagcctcccaaagtgtggggattacaggtgtgagccaccgcgcctggcccctagtttgtttttcatggagacggtctcactatacggcccaggctggtcttcaactcttggcctcaagtgttcctcctgccttggattcccaaaacactgggattataggtgtgaggcaccatccccagcccagtccctggttttgaatgccacccctatccggatgactcttctcaggctcatacctctcctctaaactacagatccatgtcctcatttgcctctagacacctccacttgatgtctgttggctagctcaaactgatgtggccaaaacagaacttaagatcattctgttgattttaaattgttgaggtcaaaacttagatgtcagctggacgcggtggctcacacctgtaatcccggcactttgggagaccgtggcaggcggatcacttgaggccaggagttcaagaccagcctggccaacatggtgaaaccttgtctctactaaaaatacaaaaatgagctgggcgtgttggcatccgcttgtaatcccagctattcagtaggctgaggcatgagaattgcttgaacatgggtggcagaggttgcagtgagccaagattgtgccactgcactccagccgcacagagtgagactctgtctcaaaaaaaaacaaaaaacaaaaaacaaaaaaaacttagatatcctcctcaattcctctttcctgtgcaccctacacacatctgctagcttgctctgtctgccctccctcccaaattacatcccaaatctgatcactgccctgctccacaccctaacctaaattaccacccatcaggccgggcatggtggctcacgcctgtaatcccagcactttgggaggccaagatgggaggatcacctgaagtcaggagtttgagactagcctggccaacatggtgaaaccctgtctctactaaaaaaaaaaattagccaggcatggtggcaggcgcctgtaatcccagccactcgggaggctgaagcaggagaatcacttgaacccgggaggcggaggttgcagtaagccgagatagcaccactacactccagtctggacgacagaccgagactccatctcaaataaataaccacccatcttccctcaaatgatctactacaataacttcccccttgcggtccactctccatagaccagccaggatgatgacattaaagtgcacattaaatcttgtcgcatttctcctgaaaacccttcaatggcctcctagtgcaactagaaaaagacaagactccttggccagacgcggtggctcacgcaccttggggggcgaggcaggaagattgcttgagcccaggagttggagaccagcctgggcaacacagtgagaccctgtctctaaaaacaaaaaccaaagaaaacaagactccgtaaggtgggttccaaggccagacatgagctgaccggagtcaacctcttcacagtccactctacttctttccctcaaacatcccaggactgtagctgcctcaaggcctttgcaccaacgttttcctgttcaactctactattcattcaggtctctagtcaagtgtcaccccccagagcagctacccagggtgcaatgtcaccaccactgcctctccagtcaaccaaagcactatctgtttgctgtactgcatctccccacccgcccactccgtagattgagcgctctgtgagagcaaggactttgttcactgctgggtccccagagcagggaccagaacaggcgctgggaaaacatctgttgaatgccccaggtactccaaagcccttgctcttttcaatcccaagcaggttccaagtctccagccttccaaaccagggttgcccggtgcgaagcccaggggtgagaggaacaggaagcagggcagatccgtccctgcccttaatccagggtgaagggtttaacctccaggacaagacttttgccgcaggctccagctcctggcctagacttggggctggtgcaggggacaaggcgaagagttgagccagggtctcgggaacccagctgccctcgcccctctatccacaccctatcccaagaaatggtgcgtcccgccgcagggcgtacgcacagagaaggaagtgttcaagtcttccagtgcggagaaaagagactaggactcgcccctcgacgtctcgcggaaggtacctggctccccggtggctgcagctccgggctcc

SEQ ID NO: 1593 - DNA, 36025 bp, Homo sapiens; identical to SEQ ID NO: 1592

SEQ ID NO: 1594 - DNA, 128295 bp, Homo sapiens
cagtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaaggtaaccaaaaagaaatcaattgtcccagttactgcactcccagctccatttctgctacgtttccaattgcaaagaaaacacacaaggcagaggggaaaattgaataccacctctccttcccacaaaataagaagatgaaagtaaatgtgacctataaattatagggaaaaaaatttattacgtgattcaatgttaaagagtcaattccgaattactcttaatattgctgtgtttttcttttttttttcctggtgagggtaatcatttttcttctaacttcctcttttcttctcccttctctacccaacttaagaagtgggaaacactggaaagcaaatgagttagaaacctacaaaagattgtttatctcaatgggtagatatgtgatattacaccatgagatatatctaggtaatggtactgaactatgattgtggttatcttaaataggggcatgaaactataatcgtgtctgtgacaaagaaggaatgttatagtcagagagacggtataaaaagatttgctgaaattcacttaggtgattatttcctttgagtaaattgaataatactcaaatatggtaagaaatgtttagcatgcttattttgaatgacatttgaggaaataacttcagtttattttgtgatggtacaaagataatttggcacagttatgatagcacatcatttgtttcagggccttaatctatatcctgtcctatctatcctttctttctctcctgtttcctgaaggtcatttgttctagtaaaatttcattttgatgttgatattgggcagcattttaagtcttttcttcggtacttgttatgtggtcctccagaacttgcctctcctgcttttagcacaaggtgtgtctgaactctcatcatcccactgtgagctgtcgttttggatttaaaaactgtgatgaggtcagaaagaccgataggacatgcttatatttaacaaatctctttccacaaatatgagcttagatttagttatgcaaattaattaagttaaataagttaaattaaatgcatttaaattaaatctaaaaattattactataagttaatgtgtaaaaataaaaaaaaaattaccagtagttcagcactaaagcacagcatcaatcttatcctcaaatactttttttttaaaatgagggagagcattgtttaatctttgaaattaatttttctccaagcaatagatacattggaaagaatggatgtcttaaaatttcaacttttattttagattcagggggtatatatgtgtgtttgttacttgcgtattttgtgtgatgctgcgatttggggtacaaatgatctcatcacctgggtactgagcatagtacccagtaggtggtttttcagcccttgcctctgtccgtttctcgccactccagtagtctccagtatctattgttgccacctttatgtccatgtatgtctaatgtttagctctcactcataagtgagaacatgcagtatttggtttgctgttccagcattaatttgcttaggataatggcctccggttgtatccatgttgctgtaaaggacatgattttgttctttcttctggctgtgtagtattccatgatgaatatgtaccatgagaatttaaaatcatacacatttagtttctaaacctggttcttcaacttactaccaattagaacttgagcaaattacttgaaatatctgagcctcaattttcctgtctgtgaaagtgggactaatgatacttgccacatagtgttgttgggagattgaaattagataattacaaaacatctagtatactggctgataaattttaggaataatgggtaccataatgataaaacagaacttgcccaatattaatcgaagtttgtataccttatttctctttttcaattcttttttgtcctttgataaagagaccacatctagaaattcaggaaaagcccattgctttatccctaatgacatgttttttctgtctgagtttcactaattcagcatctatcagagtctccattagcaaaataaaaacagaaaataatttttgctattcacaaatttttgcttactaaattttcctaaaaaaataagtctatgaccacacaagagagcagacatgggttggttactttgcagaagacctcagacttcttacgcacttcatttgatttgtggctttcctgtgctctgttggattctttgaaggtggaaggcaaaactcagcagttaatacatgcttctagtctgtgcttgagaaaaatcaccaagaagtatagaggagcacataagccataaagataggctggcctcctgagaagtaacatcttaaaaacgtaacccttaaaagaatccaagtctgattatcgaacgcctaatagagcttttagcatggttcgactagaacagggaaggcgacaagggaaggcattttctcattaatgttcaaagcaatcagttctgtgcgtttgttctctggcctgtacgatacccattattatgcagatgagtcctaaatcaccttaagaagctctttattattcaaatgccgagagattttcctctccctttcttggaactggtggtccctgggaggcactgaataaacacctggactggttagagccctcagatagatggcctaaagctcttgtgaggtcaaagagtgctttcaaatactggaatttctggcaacaccacattcctcaaattatttagctggttatttaattagttatttaattggttgtccttcaatgctatattacctgagtaaaattcactgctctaactctctggggaagcaagttctctgggttccgtaaaatgtaagatttttctttggtgctcttgagcttgtcttttaactcatgatacctagtctatctgttcaattcaatttctcacatcactttagtagcatgaaacttaagttgtaataacaattttaaaaatggtacactggctgaattaaaacgatagaacatggctctaaccaggacatcctaaaacctttgcagaagattgtgatcacatcaacatagtcattcctactaagcctggagttgtataataatagaaaggccacccttaggctcccttactccttgaacagattaattcagttgactagcatttattgaatatgttataccttgttctttgaaattaatttttctcaaggcccttgatacattggaaagaatacaaattgtaaaatcatacacatttggtaaattgacatttattgaatgttttagatgctgtgtcttgagggttacaatgaacagcaaaaacagaatatgtgccaggaattacaactacaaaatcatcaagaaaacatgtctgacctttactccaaagaggctcaaagtctggttgggaaagataagacaggtaaacaaataaatacaataaagtggcatgatagaagtggaggtaggatcagtgggtccacaaaaggaggaaacggtctattcaggactgcatgaaggaggttgtcagaaaatggtgtctctaagaaatggtaagggtagggatgagggaaggtacaggtaagagaatggcattttaacctcttcactgtatttagctctgtctgaaatggtttttgtttccttgtttatcacctgttattgactgttgttcccctcccttttctctccctccccgctcatacaccatgaaagaaaccctatctgtcttgttaactgttgcatctcagcagcccagaatacagtaaacactcagtaactgttaaatagagtgaatgacttgaatgatcaggcccaagcaggaaactggtgtgaagaaagacaccatggcctgaaataagagccattgtatttatctaaatatgtgaggacacatgtttctatcagaaagatgattcttcagttaaatgaacatcagagattaaaatgtacagaatttatataataagtaattcttagtggaagcctgtttcattcccaactcgacctttcagagcacacaacaaccatatttcaaaaattcctcttctattagtgacaagagccatcttaacttccactagctcaattcctcatttccattctactgggagccatagaaattacctaaatacaagaaatttagtggttgagttgtaaaaactcagaaagggtttcataaatacttatatacatgatctctacatttgaaatatgcctaatttaaatagttatacagaactgtgtctgtgcatatgcagatatatatgtgtatatatatgtgtgtatatatatatatctccagtatgtagatatagatatacatgtatgtacttgtatgtgttcgtgtgtgtacttgagacacttttttgcaatgattagactttttattgaaagttactataaaatttgaagaacaaaaagaacaaaagtttactaacattcaggagtcttttctgaaaaccatatatgaattatatcactgacattataggtttcctctcagtatgggtactatggactgaatgtttgtattcctctaaaattcctatgtgaaacctaatccccaatgtgacagtattaggaggtggggtctttgggaggtaattaggtattgagggtgaagctttggtgaatgggattagtgacccttaaaaaaaaaaaaaaaaggcaagagagagcttgcttctctctgctctcagccatgtcaggatacaagaaggtggccatgtgcaaaccagggagtgggctctcagcaggaataagatcttccgcattaggaataagatcaacttgattctggattttctagcctgcagaactgtgaaaaataaatttttggtaaacttaagccacctaatctctaatatatttgttatagcagcccaaaccaaccaagacgggtcgattacctttatcctctatggccacactaaacttctggttaattttctggccagtgcatatttttgtttatccaacaccaggtgaaaaggtgagaatacatgggtaaaatgctattacccattaccactgccggtaacacaaggcaaaaattacgtctccatttcttagtgtgtctgtggtaccttctatttttgcaaaggctattgtatcattctaattaagaaaggttatctttatgagacccaaagttgtcttaatatggtgcgaaagatgaaccaccctactgtatgaactttatacaaaataacagattgtgccatgtggggacaagtggctcaaataataaattagacttggtaagactatgagggcatttaatttaaaatgttttttaagaatatagacagtctgtcagggagcagaaattaacactggaagacttggtgagttttgttcaaggccaaatgaagaatggagtaaaacaaattgtccagcttcctgtgcatgtttctatcccagtgctacaaaccctttttgttcgtgtctgttctttgattagtgagtagctccttcccctttatctgccttcatacactctacagtgaaatgggaagtatttgaatcagtaatgtgacaccagtacaaacaggtgtgtgtcatagtttgaagggcaaatctttctaaaaggcaagacgctttaaaaactcagtaacttttgtcttactgcatatatagaaaccagtgtaaaacacggtattttactttcctatttttttcagtagagacatcttgcagtttttagaaggaccatttgtgtcaaataatgtgtgagtcacagaaattgagactgtttgagctattctactactaccatattgtgatgggcaaatttattcctatgtttgaccgatatgactttaggtataactttcttaaaagtagcaaacacaatttctagttgtgctttttttttttgtttataaaaattatgggtttatcaaaatgagacatcaagaggaagaaggaatgaaagaaaggaaggagagagagaaggggaggggagagacagacagaaaccaagcaagcagcaagaatgaatagaaatataccttaaaatagtaataaagttggagaaatgatgggagagagaaaagcacccaagccacattcatctttgtttctgttgacacaggaaaagaaaaaaaaaaacctctgtttacagaattactttttcttgatgccataatcatattagcatcagtacctttatgaatattgatttcctgataaaagtagaattattgcaagagttgctaaatttataagcagtatcgttcttagaaccagtcaagactcaaagttatggcttatttgggagtcctaccttcacttctagactgtttctgagactgtggaattttctgttcaacaggcctcagtactggctccaacatttgcttggaccgcttcttatcccatgctctcaagggcagactgtggttgctggtgtgcatgctcttaggcctaaggcacaattgatgatgggggtgtttctggagcttgatcatgctggagtgttcagatcatgtctaccaggttcctctgggtgggaaagctggtagagagaagagtagggattcaagcctcaagattaggtaggagtgcgtgtgtcccatggtcccctgccaaattttggcataaaactctgagggatatgagaaatctaaattagaagttggcctttcagattgttataaaatatatttatcaagacagaaggaaatatcacattttatttaatagtttgccagcttcatttataacttttaaatatgtagatctggtatgctggcctccatctgtatccttgctccaggtcccacaaaggaggcagctatgtgtggtttttgactgtaatctatttcaggatataacccttcttctatactaggttgtgaaagtaagagggaaggggagggaaggaagagattgagtattagtgttatgttatctgctaggagctatgctagccagatgctgtcacacacactgttactgaatcccaacttctcttctgttcagttctgattttatcattgagaaaaataggtggtaggccttgggtttgagatgtcacatgcttgaaatatttgcaaaatggaatgaatttaactagttgactcagtaggtattttatacatatgatttactaagaagtcaaagccatttgatggttgcagcacatgttttgtaatgtgatgacatttctctgctaccataataaagcttaacttgctgtttttcactttggaatatattttctttcttttgacttatagtggcatgtccctgccagactgtcactgtttaataaatactttttttgtttagttgtcggggaacaaaattacaaaggtaggttaagcaaaactgtcttatagtaatagcttaatgatctccatttcctgcttcattgcgtatcttgacactgaaactcatctttctttaattttatgcctgttgtcatttatttgcatctcaataaaacttaatatatatcagaataactgagagtcctattctacagcaatgagaggagggaatacatttgcaaatgaaaagaatggaattatgtgtgggaaacaagcaactttttatctggataggtgatatttcagtagaattgtatgaagtcagcttaaattgtgagtcataacttaaatgcagcaggaacacagagtgctatgatttaagactttgtccaaggttttctgaacaatgtttttcttgattaatgaatcagagaataaatgaatagtctaagatacctgcactgaagccctcgatagaggatgcaatcttagactgacatacaattcttacttaaagaagaaaacttaaaggtcatgtcatctagctactactctaagtattgtgagtcattatagcacttcacagaaactgtttttcctgaatgcttcttaatgttaggtctccagtgtcactacaaaaagccatcacagatttctccttctgtgtttgttgtgaaatggttgatgaagacattgtttacctctctcagattttattcaatggaaagctgactctccttaagaataaaaacacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataatagaatagaatagaatagaatggaatagaatagaatagaatagaatggaatagaatagaatagaatagaatagaatagaatagaatagaatagaatagaatagaatagaatagaatagaatagaatagaatagaatagaaaagtttctttccccagatctctgcaagagcagatttttatcactgaagtctctgttcgtcttttttgggagtccctccctgaccatccgacctaaagtgatgtaggtaagggaatacctttcctctaccctcttaaattctgtgactaggacctgtgaattgtatagacaaaagacatactaacaaaagaaaaagcatacacattttacttgaggttaacatttttatgtgtcgtaggaggctttgtaggaagaaagaagtaaaaacctcaaagaagcagttagacctaggggtttacataacattttaacaaaggtcataaattgtggagatatgacaaagccaaagtaaaagagtttagggttggggaaagaaattgtggaaaagtgactaggaaatacatgggagaagctaatggaagataagggttatttttgtaagatttgtttgtgtagattcatctctgtgtcaactccctgtctctgatgatgagaatattcccttcttggtgatacagggagggcacttttctcatggtaaatttacactctgcttttaagtaaaaaaggaaaaggcagagagcccttcctgcatctgctattgagcatctccagctcaaaataatcagtatcccaaagtggcatatttagggatggtgtgttctgatccccctcagtggctttcataccatctattactctatgaaattatactacttcattctatttttggcttttgctgtcatttgaatataattctccttggggaaaaagacttagcatttaagcaatgcctggtatacagttattctgctcaatgactatttattgaatgactttaaaatatccagtgaataattacaactatattgatccttatgacatacttgcttttacaattctgtcattttcacttacccactatgtaatggtagttaactttcagttaatttctttacattctttttctgtaaagaaagattataaataaataaatttaattaaagaagagactagaaagagtttcctggccaagaaaaataggatctctttttaaatgaatttattcaacaaatatttgctaggtattcgtatgtgccaggtatgactaggtcctaagaatgttttttaaaatatcagaagcacacccagcccactgagtgagacaggttgtgaacaaattattgcagtaatgtaacaagggcctgaagtatactgcaaattgggtttccgacttgcaaattctgaaatagagattcgggtggaggggaattattaggcaacattctgtgaccaccacctggggaagaaaagggaaggacataagcctgggcacagggagaggccgagctgtgatgtggtctcattggaagctttagccaactctgagggaagttctgaagacagatgattttttggagttgtctccagtgttgtgaaggacctgggcccttgtatcacactttacgtttggggatgtggctatcttgggaaaaggcatggcctgagaggtgctttcatctgagataattcctaaagagggcatatctgctggttgcactcccggcagctgaaataataatttatcccttcctttaaggggaacgggtgctaacatggcatccaccacatattaagtggttattattattagagacacaaataaagcaatataggagctatgataagaaagagcttaattgcacctctgaaatgccaaaagaaaatacactgaaatctgaatcttgaaatccaattaggacttttaggggcagaagccattccaggcagagggattatgctggtcctcatacatggaacaaggtaataatactaatttttgtatttggggatttctaaatggaagagcaggtacaaacaccaactgaacatctgtagtaggcacttaggtgcagtacgtcatttcatgctcttagcaactttgcaaataagttattgccatatatttatagatgataaaacagaggttaagagaggtataagcattctcccagtggtcacatagctattaatagcaactggtgaagtcagagttttcctgaggtttgcttggctccaaagtcagggctttttcaaccatcatgcagttttcctgttctaaccttagtttttagtagtagtacctgttttatggtttgctcttaagaaatcaactgattttaataaacttttgaacaatactcacaagcatcaagagaactgtaagttctgccaatacattcatcggcaatcttgaagtgaacagtgaccaacaagtatttttcagtagctgtgttattttatgcctctcaacaaaatgttctatgtgcttggaaattagaaagatatgtacttgcattgaataaggtccatacttcacagaaacactagaatattctgctctaaaaatacaaaactgattatctgaattatctagtctttgaaaactccttgtcatcactaactacagagtacttacctggattagggtactcagtgaaaaactgggtcagaatgtcaaactacatggctcctttgcttaacactcctcattgcttttcatttttctatagctagcagcagtacccaaagaggggaatatataaaccccaggagattttacagacaatctattgtgcaaagaaaaaaataggtttgtttttcagtattgctctttgaaaatatttattgttgtgcatgcttcataatatgtatgatacattaatatgatacgtatattagaggtgtatacacagaacagtttaactgacacaataaaaacatttgcagtaaaattctgacacgctactacatggatgatcatcaaagatattgtgctaactaaaataagctagtcacaaaaggacaaacgctatatgattctacttatatgagagtagtcaaattcatagggacaaaaagtagaatggtggtttccaggggctgggggaaggaggaaatggggaattattgtttaatgggtagagtttcaatttgggaagatgaaaaagttgtaatgattgcataataatgtgaatgtatttaatgatactgaactgtttacttaaaaatagttaacattgtaaattttatgtcctgaatattttaccacaataaaaaatgataaaaaagtttggcggcccttggtttacaatattaaaatggaatgtaaggcttttcccaatttgactctatctcatctctggcctggaggacagtgttacttttgtcaatgaaaagagtcaaactctgtgaaatatttgaagatatttattctgagccaaatatgagtggccaatggcctgtgacacagccctctggagatcccgagaacatctgcccaaggtggtcagccagcaacttggttttatacattttaagcttgggtcaggaaaggtgggacactcatcttctgctaaagactttaaataaaaacattttctgaagtacccatttatttaactcctcattgctctgtctgtgctatgctgatcactgtcggagcctgtaaattcaaaccaataccacttcagtatttttcaagacaggtaagctttgtttaattcctttttgaaatccactaatctactttctatgccaattagcagtcagaggaaataaatcacatgcccttccaatgaagataaaatattcccagccccagtatttgagctttcaaattcagagtctcagagggtctgttcctccacattttcacttaatacctcactggctcccctccaaaccctgtctgacatgcaattattttcaacctatttcacagaagtctgctccattcatctttctgtgggtcagatttccattgaaactgattttaaacgataaaagattttactgtgtgaaacgtatgttggtagggctcgacgcaatgctaagccaagatttttttgggtttattggggcagatatgaaattggcagcatggagagggatgaaagaacatttataatcatatctgggggtttcgtaatgatctgtctggaataaaactgtatattgaattatgggtgggtgtttgcactatacgggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaaatctagttcagtggaggccaaagtgatcttgctaagagaatctaatcatgtccctcatttattaaaaaattcctcattgtcgagatctgtctcctgagaatttctctagacttgtccccttttcacaacctctatcacttgtacttcagctgcactaagttgttttcgcatctttttttgccaccaagcctttaaatatactatttcttttgctcatgacacttttgcatttctcttcaccttgtgctacctgtttcagatttcaactgtgtcacttctccataggactgatgtccaggctgtgctatgcttgcatgggtcacaggttatcataattctatttatactaactacagttttaatttttttatttttaatttttgtgggtacataataggtgcatatatttatgggttacatgagatattctgatacaggcatgcaatgcatagtaattccatcaggaaaaatagagtatcaatcacctcaagcatttatcctttgtgttacaaataacccagttatactctcttagatattttgaaatgtacaattaaattatttttttattatagtcaccctattgtgttagcaaatactgggacttacttattatttctaactatgtttttgtacccgttaatcatccccctttcctccactacatcctccagactacccttcccagcctctggcagccatcttttttttttttttttaagagacggagttttgctcttgttgcccaggctggagtgcaatggcacgatcttggctcaccgcaacctccacctcccaggttcaagcgattctcctgcctcagcctcccgagtagctgggattacaggcatgcaccaccacgcccagctaattttgtatttttagtagagacaagatttctccatgttggtcaggctggtcttgaactcctgatcttaggtgatcctcctgccttggcctctgaaagtgctgagattacacacctcgcctgccatccttttactatctatcttcatgagttcagttgttttaatttttagcacccacagataagtgagaacatgcaaagtttgtctttctgtgcctgacttttttcacttaacataatggcctccagttccatccatgttgttgcaaatgatgggatattattctttttatggctgaatagtaagtactccatttacaccagtttttaaatactgaccaatattttaaaatgcaaagtgatttgtttgcagaatctttctggaataattcttaatcttttaaatttgtctcattcaactcctaatataacagcagtgctttggcaacttgactttataaaattatgtcaaaacattaaagcagttttcacagaaacatacacatggtattttaccctcatatttcattaattatgtaagtttcgttaaagtaatataattacaaagaagtacaactgacataatgaagtcagctgttgaacacaattaagtcttgaaaaatatgccccttgattgttaagtggagaagtacatagacatcagtttgtgtatttaagggagataatggaaaatgttgatttatctcatgacttcaataccctgtctttacttctagattatacatatcttgatggtaagagctgttgtttattcatttaatatacacaacacaaagcacaatatcaactcaatatccaatatgtaatttaaaaaattaatattaaattagatataaggtttttttttcttttattattatactttaagttttagggtacatgtgcacattgtgcaagttagttacatacgtatacatgtgccacgctggtgcgctgcacccactaactcgtcatctagcattaggtatatttcccagtgctatccctccccccctccccccaccccacaacagtccccagagtgtgatgttccccttcctgtgtccatgtgatctcattgttcaattctcacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtccatcacatgaacagacacttctcaaaagaagacatttatgcagccaaaaaacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggtctataaatcatgctgctataaagatataaagttttttaactccaaagactatggaatttgtaaaattgttaacttaccttcaaattctaatattctttgatttgtatgtaattataaacatatttgtgttgtgatgaaattatatattagttaatggccagattcttgtgttgtattatctttgtgttctccacagtcaaatgactgtgaaagttgctcaataagtaagtatcaaatggtgtatgtgtgcctgcctggttggttgttgggagtatgagaatgttccaacattcttgaagtatgtctttgttagcagcatgagaacaaacgaatacatactgcattttgtttataaaagtgcatattcctgaaaattatttttagggtgagggcaagtgctgttaagtaaggcattaaacaaaaccttaagcttggtatatgaaattattcactacaactattctttactaagagatcagtaagatttcaatacaattaagaaaatctaaattcaggattatttattggtagctattgaaaaacaatatcagaggggaaccttaatctaaataaacaatgacttagaattttacaagtaataataagctgtgtactttagcaggacacagctgtttaatcatctccttgcccattaaacttgtttgagaagcacattctcagtgactgctcagaaacttatttgcattggtgatttagctttggggtaaatgattcagatttttaaaattcagatgttattatattatgctaaacaacatgccagggctatatccctagctcatttgaatttagcctgaataatagcagtgcacattaggcctggtgttgaaccgactttgtagcagtctttgctgtttttgctttttccagccaaggagggcaatttcctgatagatggtcaatctcccctcttgcccttggaacatttccaaggaaaagaaaaagagggaaagcaggtgtagccattcacaaccagatacagaataatggcaagtaaatcatggtcgtaaaaacaatgactgacattttttgagaggtttctggtatgtcagacattgaattaagcaattttcatgctttatctcaattctcacaacctcctagcagtgagcagtggttaacatgcaggttcaggagccagactggcttaggtttgaatcctggccctccactttcagtggtgtgaccttgggcaaactgcttaacctctgtgtgtgtcagcttctgcatgcgtaaaaggaagggaatatatatacatcttattgtgtttttgtgaagattgaagagaaaatgcaaaacaaactcagtatttgcactaaaaaatgttagcttttattatcatttaatattactattattctttttctctttctacagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccagtcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaagtggttgctcttattataggcttatcacaatacattataatcaaatataattgcagtaatagtgtataatgctttaatatcaaaaataatttgggggaacatacacgtttataaacaaaatgcagtatgtattagtctgttctcatgctgctgataaagacatacctgagactgggtaatttataaaggaaagagatttaattgactcagagttccacagggctggggaggcctcaggaaactcacaatcatggcagaagaggaagcaaacacatccttctcatggcaacatgagaaggggaactatgagtgaagagtggggaaaaggcccttgtaaaactgtcaaatcttgtgagaattcactgtccaaaaacagcagcctaggggtaaccatccttgtaaccatccttatgattcaattacctcccaccaggtccctcccatgacacgtagggattatgggatctacaattcaagatgagatttgggtggggacacagccaatccatatcatggtatatatacacaatggagcatcatcagccttaaaaggaaaggaaattctgataacatgatataacatcaatgaaccttgaggaaacatgatacaacacagatgaaccttgattacattccgctaactgaaataagccagacacaaaaggacaaatactgtatgacgctacttatatgaagtacatactagtcatattcatagagacaaaaagcagaatgatggttgccaggggctggagggaggaagaaatgcataagtattgtttaataggtataaaatttgcttagaaagatgaaaacattctggagacgtttggtggtaatggttgtccaacaatgtgaatgcatttaatgccgctgaactgcacacttaaaaatagttaccattatacattttatgtcatgtatattttactacaatgaaaaagttggagaaaaaagaatatatccatctacgggaggaaaaatttgttattaaaattattgaaataagaattgcagtcctaaaattaactcatacctcatcctttttttttctttttctttttttttttttttttttgagacggagtctcactctgtcacccaggctggagtgcaatggcgcaatcttggctcactgcaagctccacctcccaggttctcgccattctcctgcctcagcctccggagtagctgggattacaggcgcccaccaccatgcccagctaattttttgtatttttagtaaagacgggtttcactgtgttggccaggctggtctcaaactcctgacctcaggtgatccgcccgcctcagcctcctaaagtgctgggattacaggcgtgagccaccgcgccctgcctgctcatgcctcttcaggaagatttttgatattttgcgttgaattcctctaagaagtcatttcagtctttatatttcacagtagtgagaaggagtgcatgactgttcttacccacacatatgttccttttcgaattggcagatgagtattcatcaatgtagattctaacaatactgtcagaggagaaataatattgttgtgacaccaagagaacatttttattgtacacattaccttggaataacatttttgccaggaaatttgatgcagcatacatatggtgcctgatagaaagaagccaggcgaaagtacattagtcctgtgtgttgtacatgatatatagtcaaacagcctgtgagatagaaggatatcattaactatgaaggtcattccatcatcagtataatgtttggaacaaagatatattcagttatgctgtttactctatttatacttcaactctgcatctttataaacctacctttctatgtgatttttaaaactcacagaagacttttttttaagaagagaagatctgttttgtttaaattgccttgcactccaaataaaaactattatgaattttaaaacatgacttcttctgacattgaaactcttcttttttttccaatgactatataactgttaaaattttggaaaaatattttagtatgcccaggaagccttgctatgtctattctatttgcatttgtttcatagtctcattaggttcattttccccctaatttttcatttgtggtaaaatgcacataacaacatttaccatcttagccactttaaagtgtacagttccgtggcattaaatacattcataatgttctgtaaacatcaccaccacctccagctctcttttcatcttgtaaaaatgaaactctgtaactattaaacaataactctctcttccccccaatcctcagcccttggcaaccatctccactttccgtttctatgatttcgactattctaagtacctcatacaagtgggatcatatgtatttgccctttgtgcctggcttattttacttgccataatgtcctcaaggttcatccaggttataacatatgtcataattccctttctttttaaagcttgaataatattccattttctgaatattacacattttgttcatctatttatccattaatggatacttgggttgcttccatgctttagctattgagaataatgcaatcctaccaacaatactcaagaattccaattccaatttctccacatccttgccaacacctctggcttatattttaaaatatattagccatccttatgggtgcaaagtggtatctcactgtagttatgatttgcttttccctcatgattagtgatgctgagcatcttttcatatgctgatgggacctttgtatattttctttggagaaaaatctattcaagtgcctttgctcattttttattcaggttgtttattttgttgttgttattgttgagttttggagctctttctacattctgggtgttaatcttttatcagatatacaaatattttctcctatgctgtaaactgcttttttattttgttgatagtgtcttctgatgcacaaactttaaaattttcataagtccaacttttctgtttcttcagaaaagaagaaaaaagcctgagcctttgtcatatccaagaaattactgccaaattcaatatcatgaaatttttgccctatgttttcctttacaagttttatatttttagatttctgatccattctgagttaaattttgtatgtggtgttagataagggtctaacttcattcttttgcatgcaaatatccaattttcccggcaccatttgttgtaaagattgtcttttccccataaaatagtcttggcacccttgtaaaatatcatttgaccatatatgcaaggatttatttctggttctttattctgtttcattagtctgtatttatgccagtaccacaatatgttgatttcctgtaactttgtagtaagttttgaaatcacgaagcatgagttcctccagctttattcttctttttcaagattattttggcctattgttgtcccttgagatgccatgtaagttttaggatgggtttttttttttatttctacaaaaaaaaattggaattttgataaagattgcatagaatctgtaaatcactttgggtagtattgacggcttaacaatatcaagtctttccgtccatgaacatatcttctcatgtatttatatctttaatttctttaataatattttgtagttttcattgtacaaatctttctcctctttggttaggttaagtcataagtatttcattgtttttgatgctactgtgaatggaaacactttcttaatattttttcagattgttcattgctactgtatagaagaaatgcaactgatttttgtgtgttgactttatattctgctactttactgaatttattagttccaacagtttttggggtgaacatttagttttccacacatgagatcatataattttagaacagagagaattttacttcttttttttccactttggatgcctttatctctttttcttgcctaattgctccagctagaattttcagtactatgttgaaaagaagtggcaaagaccgggtgcggtggctcacacctgtaatcccagcactttgggaggccaaggtgggtggatcccggggtcaggagttcaagaccagcctgaccaacatagtgaaaccccatttctactaaagatacaaaaaaaaatttagccaggcatggttgtaggcacctgtaatcccagctacttggaggctgaggcaggaaaatcgcttgaccccaggtggcagaggttgtagtgagccgagatggtgccattgcactcccgcctgggtgacagggcaagactccatctcaaaaaaaaaaaaaaaaaagaagtggcaagagcaggcatccttgtcttgtttctgatcttagaagagaagccttcagtctttcaccattaagtatgatgtttgctgttaattttttatatatggcttttattatgttaaggcggtttctttctatcccttgtttgttggattaaaaaaattttttatttctatagcttttggggtacaagtcttttttggttacatagattgattatatagtagtgaattctgacattttagtgcacctatcacctgaataacgtatgttgtatccaacatgtagttttgtatcccatatagaataatggtgtccagctccatccaggttgctgcaaaagacattatttcattcttttttatggctatattccatagcacatatatatatgcacacacatatatatagcatatatatatatgtacacacatacacacacatatatacacacacacacacacacacacaccatattttctgtatccactcactggtcagtgggcacttaggttggcttcatatctttgcaattgtgaattgtgctgcaataaacatacaagtacatgtgtctttttcatataatgacttctttcctttgggtagatatccattagtgggatggctggatcgaatggtagatctagttctttaaggaatctccatactatttttcatagaggttgtactcatttacattcccaccagcagagtagaagcattctcctttcattacatctacatcaacatctatcattttttgactttttgataatggccattcttactggagtaagatggtatcccattgtggctttaatttgcatttccctaacaattactgatgttgagcattttttcatgtttgtgggtcatttgtatatcttcttttgagaaacgtctatttatgtcctttgcccacttcttgatgaggttatttgttttttccttaatttgtttgagttccttgtagattctggatattagtcctttttcagagacatagtttaaaagtattttctccactcttgattgtctgtttattctgatgattatttctttggctgtgcagaagctttttagtttaatcaggtctcatttatttatttttgctttttttccatttgcttttagggttttagtcataaatactttgcctaggccaacgtccagaagagttttttcaaagttatcttctagaatttttatgctttcagccctagacttaagtctttgatccatcttgagtttatttttgtataaggtgagagatagggatccagtttcattcttctacatgtggatatctagttttcccagcaccatttattaaatagagtttccttttcccaatttatgtttttgtatgctttgttgaagatcaactgtttataagcatttgactttatttctgggttctctattctgttcccttagtctatctgcctccttttgaaagtaccatgttgttttggtaactacagccttgtagtataacttaaagtccagtaatgtgatgtctccagatttgttctttttgtttaggatcgctttagttatttgggggcttttttggttccatatgaattttaggattgtttttgctaattctgtgaaaaatgattttggtattttgatgggaattgcattgaatctgtacattgctttgggcagtatgatcattttcacagtattgattattccaatccattagcatggaatgtgtttctgtttgtttgtgtcatctatgctttatttcagcagtgttttgtagttctctttgtagagaattttcacctccttggttaagtatattcttagttattcaattttcttttcttcttttttttttttttttgcagccattgtaaaagggattgagttctttatttgattctcagcttgctcattgttggtatatagcaagcagcactgctgatttgtgtacattgattttgtaacctgagactttactgaatttgtttatcaaatctaagagtcttttgaaggaaaatttagggtttcctaagtatagagtcatgtcaccagtgagcagtgaagtttgactttctcttttccaaagtggatccccttattttcttctcttacctgtttgctctggctaggacttccagtactatgttgaataggaatggtaaaagtgggcatccttgtctttttccagttcacaggaggaattctttcaacttttcttcctcagtgtgatgttggggtttgttgaaggtttttatcataaagggatgctgaattttattgagtgcttttttctgcatctattgagaagatcctatgatttgtgtttttaattctgcttatgtgatgtatcgcacatattgactcgtatatgtttaaccatctcggcaacctgggtatgaaacacacttgaccatggtgtattacctttttgatttgctgttagattcagctagctagtattttattgagaattttgcatctatgttcaaaagaaatattggtttgtagctttctttttttttactttctttctttaattttttttattattattatactttaagttttagggtacatgtgcacaatgtgcaggttagttacatatgtatacatgtgccgtgctggtgtgctgcacccattaactcatcatttagcattaggtatatctcctaatgctatccctcccccctccccccaccccacaacagtccccagagggtgatgttccccttcctgtgtccatgtgttctcattgttcaattcccacctatgagtgagaatacgcggtgtttggttttttgttcttgcgatagtctttttttattatatcctttcctgatttttgtatcagagtgatgctggcttcatagaataatttaggtaggattccctcttcctctatcttttgtaatggtttcagtaggattgatgccaatttttctttgaatgtctgatagaattcagctgtgaatccatctggtcctgggtttttgttgttgttgttgttgttgttggcaaatttctagttaacttctcccatctcgctgcttatcggtctaatcagggttcctatttcttcctgacttaatctaagagggttgtatgtttccaggaatgtatccatttcctataggttttctagtttgtgtgcctagaaatgttcacagtactctcaaatgatcattttttatttctgtggtgtcagttgtaatgtctcaagtttcatttctaattgagcatatttgaatcttctctcttttcttggttaatcttgctaatggcctatcaattttgtttatcttttcaaagaaccagctttttgtttcattgatcttttgtatttttttgttttaatttcttttggttctgctctgatctttgttattcctcttcttctgctagctttggattgagtttgttcttttttctctagttccttaaggtgtaacattagattgtcaatttgtgatcttttagactttttaatgtggtcgtttagcactataaactttccttttagtgttccttttgctgtatcccagggctttgataacttgtgtcattatgatcattaatttcaaagaatacttaaatttctatcttgatttcatcagtaacctcaaaatcattcaggagcagatcgtttaatttccatgtgtttgtatagctatgggggttccttgtggagttaatttctagttttattccactgtggtctgaaagatagttgatattattttgacttctcaaaatttattgagacttgttttgtggcctattgtatggtctgtcttggaggatgttccatgtgctgatgagaagaatgtatattctgcagttcttgagtagaatgttctataatatctgttaggtccatttgttatagaatataagttaagtctgttgtttctttgttgactttctgtcttgatgatctgtgtagtactgtcagtggagtattgaattttcccactattattgtgttgctgtcttaggtctagtagtaattgttttatgaagatgggagctcccgtgtaaggtacatatgaatttaggattatgatatcttcctgtcgaaattatccttttatcattataaaatgacctttttgtcttttactgttgttgctttaaggtctgtgtgatctaagaataaccattcctgttcgctttggtttccatttgcatagaatatctttttccacttttttaccatgaatttatatgaatctttacattttaggtaagtctctggaagacagttgatatttggtttgtgatttttttaatccattatgccaatctgtatattttaagtggagcatttagccacttacatgtaacattgagatgtgaggtatagtttcatttatcatgtcattgttacctagatactttcagtttttctcattatgttactgttttataagccctgtggattttatgctgtcaagaagttctattttggtgcatatcaagcctggctgttcttggtgtataggaatgctagtggggtttttttggtatgttgattttgtatcctgaaactttgctgaatttgttcatcaactgaaggagtaccaggactatggggtttcctagatatggaattatgtcatctgcaaacaggaatactttcactatttggatcccatttatttctttctgttgcctgattgttctggccaggatttccaatactatgatgagttagagtggtgagagcgggcattcttgtcttgtgccagtttttaaggggaatgctttcagcttttgcccatttagtatgttgttggctgtgggtttgtcatagatggctcttattattttaagatatgttccttcaatacctagttcattgacagtttttaacatgaagggatattgaaccgtatcaaaagccttttctgcatctgttcagatgatcatgtggtttttgtctttagttctgcttatgagatgaatcacatttactgatttgcatatgttgaaccatccttgcatcccagggatgaagcctacttgattgtggtgaattagctttttgatgtgctgctggatttgatttgccagtattttgctgaggatttttgcattgatgttcaccaaggatattggcctgaagttttctttatttgttgtgtctctgccagtctttggtatcaggatgattctggcctcatagcaggagttggggaggagtgcctcctcctcaattttttggaatagcttcggtaggaataatatcagcttttattcgtacatgtgtttgaatttggctgtgaatccctctggtactgagcttcttttggttggtaggctatttactacttactcagttttggagctcattattggtctgttcagaaattgaatttcttcctggttcagttttgggagggtgtatatgtccaggaatttatccatttcatctagattttctagtttgtgtgcattgtgtgttcagaatagtctctgatgattgtatttctgtgaggtcagtggtattacctcttttgccattgccaattgtgttcatttggatcttttttcttctttattagtctagctagcagtctatcttattaattttttcaaaaaaactagatcttggattcattgatcttttgaatggttttcatgtctcgatcttctattcagctctgattttgattagtttgtgtcttctgctagcttggaggttggtttgctcttccttctttagctcttttatttgtgatgttaagttgtaaaattgagatctttctaacttttcgatgtgggcatttagtgctatatatttccctcttaacactgccttagctgtgtcccagagattctggtatgttgcgtctttgttttcataggtttcaacaaacttcttgatttctcccttaatttcattatttacccaaaagtcattcatgaacaagttgtttcatttccatgtaattgtgtggttctgggcaattttcttggtcattaattctaattttattgtactatggtctgagagagtggttggcaaaatttcaaggatttttgtacatgtactgagcataattatatgtctgattttgtggttgatttcagagtatgtgccgtgtggcaatgagaagaatgtatattctggtttttttgtttgtgtctttgtttgtttgtttttttgagacagagtcttgctctgttgcctaggctggagtgcagtgacactatttcagttcactacaacctccaccttcctggttcaagcaattctccaccactaagcccggctagtttttgtatttttagtagaggcggggtttcaccatgttggccaggctggtctcaaactcctgacctcaaatgatccaccaacctcggcatcccaaactgctgggattacaggcatgagccaccaagccgggactattctgtttgttttttggtggagagttctgtagaggtctagagggcataatagagactgtaaggaagaagcattatttgaagtactccttgtctgtttaactcaccccacctgcaggagtagttggaggccaagaacaagtcccggtgccccgtagccccatacaggattcccagctttctctgccttgagcccagcatctgtggcttccttctgtcccctctcaatgccttttctttgaagatttactaggagtgcaccagtcttcccagtgttttggtcacttggtgggagatgtttctcctgcttgcatgtagttggccatcttggaatgaactcaggaatagcatctttcaaaaattctgaaaagctcccagctttgagcacttcaaataatgttcttccttacattctctattataccctctagacctcctagtaaacattagttgaaccttcttattcaatcctcaacatctcctaacctctctcacatattttacatgtctattgcattctataaaattttcttggcttgttcattaatctctttaactttgtataatttactatttagttcattatacaactcaactatttattcaacttagccatttattgattaaacaaaataattaaattttaattattatgagcttttattttaagattctgtattatcttttaaaatccacttgatcatttttatattctcttgtttcttgcttataatttcaaaccattacttgttttttaaacctattaagtaccctttttatatctctaataatttcagtaacttaagactttgtggatataattatgctatcaattttattttctgcatctgactcatggtatcgtgtttccgtgtgtgttttaggatttcttaaaatctcgtattcctatggccgggtgtggtggctcacgcttgtaatcccagcactttgggaggccgaggtgggtggatcacgaggtcaggagctcgagaccagcctggccaacccagtgaaaccccgtctctactaaaaatacaaaaaattggctgggtgtggtggcgggcgcctgtaatcccagctactcaggaggctgaggcaggagaatcacttgaaccaaggaggtggaggttacagtgagccaaaatcatgccactgcactccagcctgggcgacagagctagactccgtctcaaaaaaaaaaaaaaaaatctcgtattccttgcaatgtagctgcaaggaacagttgaagcctgacttgagtttctattcaatttcattaagctttgttcttaatttcctttattctattttcttttggcttattgtatttttttttttttacttatttagttaagagtcaaatcattttcactcttgcttcttttcttgtatatgaatttaagcctataaattttctgtaagcagtgctttacctacattccacatgttttaatttgtaatatttttcttatccttataacagatatcttctattcactttagtcatttcttctgtgacccatcagttattttgtaggttttggttctctattaattccaaaacaaatgagtcctaacattttatttttgttatttatttctacattaatttcatggtagttgtggttctcaatttactaattctttgaaatgttataacttaatttataatgtatttcttcaagtgtccttaaaaatactatgtaatctctaattattggagtaaatattttctgtcctaacagtctatcagttactgacagttatgtttaaaatatcactattaagactgatttgtcaaattctaccttcaactctttcactttttgcttcacatgttttgaaatcatgttatttagtacatacagaattagaattttcatatcttcctaatgaatgggacactttatcactatatagtgcccacttttatttttgccttaaagtctattttatctgtgtaaaatagctatatctcacccttcctttaattagtatttgctcagtatatatttttgtactttcatcttcttgtgtgcttatgttctctactataaatggcatatagttgttgttttttgaatacagtttgataatatggtcacttgagttatgattacacatagatttgaatcgactgccttatatttgtttttctctttcggttttctcctttcttcatttgaactgctttctctcctctactggttttgaaattttacatgctattttattttaatggttggccttgaaattttaacatatatccttaatttaaaaacatctaaagttcattaatgtctttagcttttctgcaatatcacaaaaatgtttaaatgtttaaaatacttagaagtctccacaatctctcccaagctgtcctgtccaccaaatctcttatcctctccccagcgtcctcctacctggccacacattgctctgcttcctgttccttaaataggccatgcacacgctcaccttaaggttttccactgaccagttcatctgctaaaaaccacctctcccagatatctgcatgactctctcacctttcaactctatttcaggcctttcctgccatcttatttaaaattgcacacgttttaagctcttcctagcagctttcatagcattatttttctctatatcacttatcaccttttagtatactaaataacttgtttaaattatttatgttcttcttccccaactagaagtaaagttccataaggaaaggaattttttttttattgctgtatccccagagcctaagatgattttgggctcatagtaagcccttactatttatttgttaagcattcaataatttcagatctcaaatccatatgagagccagttagtgtccttgaattgttaagggatgctatttttttttctattgatcaccaccaaggctgagacaaatcattttattgatgtctctttctttggagcattatttttacttagtgtgtttccttttctgatcctttatctggatatgtttcctgagtatgttcccttttcccactcttgatttaaaaattgcccaataaataaatatttttatctatttatggttcagttcatgaaaaacaaataggagaatagatactgtgcagacaacagcagtgtctgacacaattatgctgttgttacaaaaaagatccccactatatactgttatagttgcaaaagcaagttgcagaagaatatgtatatgagcttgttactgttaaaaaataaaacaaaaaactgaacttctgtaaatatgtgtatttgtatgtgcatggagatattttgagaagcctatacactacactagaatacaaccaataatacagtaaaaataatattacaattaataaatagggattgcatctaataataataaaacattttcaagatatccagtataatgccaggcactgttacaagtgttttacagacattaactaatttaatcttcgaaatcactttataaggctttactaacgttatccttaacttacagatgagaaaattgatacaggaagagctaagtaacttgtctgaggtaatagatctaataaatggtagtggtggagtttgaacccaggcagtctggctcccaaggctatgcacttaaacctctactatatctacatctctctctctatctgtatctatgtctatctatctatagctatagctatttctatgtctatctatatataacttagatagatattacaattacatattattttataatttacaaagaaagaaagaaagaaattacctctccttaaatccaccccaaaatggcagtagtagtagcaaaagcaagaagaaaggaaaaacaggataggataaattctaagcaaaacgtggctatcagtgaagattgtcttcagtcctcccccaacacccctttgcctttgggtgctgttgcacttctctaagagatcgaggttctccccacgcatatacccaagccagataaactgctcaggattctaaaccccagctttgttctgactttcctccgaaagcagcatccctattttttttcctcttcctcttccaactgaactagctgtccacccactttagagtcatgcatttttcttgacaagttggtaaccacaaaataatgggataattgtttgctctagatggtggaagagtttgagactgtagagaaagtaaccctatttttcccattcccacagaaatagttaacatttgtattgttttaaagatctcaaggagcttccacatggagctgctcatttaattcagtcttcatgatcacactgtgatggttttcatgcatagtttacaggtaaggaaaccaaggctctgtgaggataactattagttattagtctactgtgttctcacagctgagtggcagagctgatctcaagtcagattatccttttcccaaactgcaacaacctctttttatataaacttccttggccaggaatctccacatatattattaatgaattttgtggctagaatagtaaaaattcacatcaccactggaaaaataaagcttgagtgtgaaagaaatacagagtgaagtcaattacatggtactgctttaatatacagctgcatatttctgttatagcaatctgaatatccttttaaccttagtttcactttggctttgacattgtattttattatatgcaaactattgggaaacatttattcttaaaacaatttttccttctttcctaaatagcccctccgttgctttttttttttttttttttttttgagatggagtctccttctgtcacccaggctgaagtgcaatggcactatctcggctcactgcaatctccgcctggtgggttcaagtgattctcctgccttagcctcccaagtagctgggattacaggcatgtgccaccacacccggctaatgttgtatttttagtagagatggcgtttctccatgttggtcaggccggtatgaaactcctaacctcaggtgatccacccacctcggcctcccaaagtgttgggattacaggcatgagccactgcgccaggccccctcggttgcttcatccagaaataaaagacgggctatagctgactgctgatttgggcgatatgtgttggcaatattgttgagttccaaatacttttatatataaaagctaagtataactaaaagataaaatgtttaaatgcagagaaagatcttacaaaaacaaaatgtgtccacaatgcattgcagagtttgttggtttaagaaatgcaaacatagaaagtgtttagaaacctgaccataaaatgatgcaagtgaagtttttgttcctacaataaacttgagtcaaaagagcaaacaaagatatctcataaggttgctcaactgtaaattctctgagagatttttacacctgagggagaagttgagtattttcactgacactttatttcacccaccttgcccccacaaatttgttctcaacaagttgttgagcagtattggaaaacctaagcattttttaattgacaaaatctgatgtagtacattttaaagtgcagcaactgaaacgtctgtgaagcaggttaagttaacattgtgattgagtcctggaatttagaactaaaaggaacccaaatgcatgttttagggatattcctttgtcgacgatcaggaaaaacttccttctccttgctaggatcccaaataattcatagattaattttataaggcatagaaggtttagaacctggaaaagcaatgtcagagcagtttttcatcagcatcatttttattttcaaggaaacattaagtgataattgggcagtgtccatactggtttgtcagctctcttacgcatgagatttcctcctgtgctctatttcacatactccaggagtaaaggacgtccctcacacctctctgccctcagtctcccccacccccacccaatcatttcactatgtataatacatcaaaatattatgttgtacatcttgaatatacacatttttaaaaagaaagggccacaatgcagcctcctcactgcagctcctctcataaggtgtcctgtcttcctctttcatatccaaaataattcattgtaatgacacgtgattgtaacttgctttttcaaatctggggcactgagaggcaggctgcttctactttccaatgcaaatattacaaattaggctggtgcagtggctcacacttgtaatcccagtgcttcgggaagctcaggtgggaggattgcttgagcccaggagtttgaggctgcagtgagctgcaattgcaccactgcattccagcctggttgacaaagtgagaacctgtttctgaaaacaaaaaacaaaaaaacaaattagcaagcacccccaaattctcataatatagatcaggattggagggctacaggatatctcatgcattcattctctctccttgaatagattatctgttcttatatagctcatgtggattatgatttatgattatgattattattttgagacagagtctcattctctcgcccaggctggagtgcagtggcacgatctcggctcactgcaagctccacctcccgggttcatgacattctcctgcctcagccttcaaagtagctgggactacaggagtccgccaccacgcccggctcttttgttgtatttttagtagagatggggtttcaccgtgttagccaggatgatctcgatctcctgaccttgtgatctgcctgcctcggcctcccaaagtgctaggattacaggtgtgagccactgctcccggcctcatgtggattatttccttagcactaaatagcccaaatctcataaaaccatgtggttttggatgctatttgtcaaaacttcctgctttcctgatgaaggagggattggtaggcgataaatggttccaaacatactcacctgtgggtctggattgtccaaagatcaacctagtatagcttccaaactgatgctggaattactctccacagatgtttgaatattgagtctctgccttaaatgctgaagttagtggaccagagagagagctcattactttttaaagtgtctgttcacattcctggggcagtctcttgacatcacaccattaactcttctgctatattgtttctccagttgtcttagctttgttcccggagtcagccaagaaaacactgtttattttcactttcatacattgtgacctgtacatttattttttactgtacagactctttataggcccttttgtaaagtcccacattctcagggaatgtgtcaacattgaagatgtctcatataccagttactagaatcatgttaactttaaatgaaatataattacttctgcaactgcagagactaagatgaaaattaagcttcaagcttgaagcaaatccatttacacacactcttacatacacagactcacacactgccctgatgtttatcgccactttgatttcatggtctgtggtctggtttgtggcttccaaaattttacattgctctggggagctcgtccttgaagatacttagctttcttacttgaatacttcatataaacttttgctatgtgtgaggcttcccatttatctcattatctccccagtactgtgactttttaaattaaaactttctgttcgacagttcaagaattttgaaataacaagatatgcttggtataaaagatgaaccatgaaaaatttcagttgaaatttatttaatccaccacttcttcactcctcatggattctgatagtgaattgaaaagaaaaactccaatcatgcaattgttttccatttcattgagatttggatattacccactgagaatgagaggtaattgtttttaatagcagtgacaaaattcattttcatttactaattaaaggcatttcatttactaattaaaattcttcccttgatttaaaagcaaatgtgaacggaagttgtgaactgttttttttatacatttgatctccaggctgaataccggctttataggctaagctacaacaatgggatattttaaagaagccacgataattgagtatcatttaactcacttgttagaggaagttcgctcccacttttcttcttgcttatagttttgtaggggaatgtccatatatcacttcctaagaaaacatcatgaggataccttcagcctttttccttgttaacaaagtccttcgaaggcgttgtttgtaatgaaggaaaaagaaacctcagcagaatgcctcacctgtatatgttttcatttaacagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaaggtaaatatatatttgagatttttttttctctcccatatcataaataggatcactagcaccatgaaattgaagcactcaggtgtatcaatgggatgatgtgcctttctccccaaaacagcactgttctcagctctggggttacagtttagtacaaaacaaagtcctgcccttgtggagttcactttctagtgcagaaaaggaggagtcagacaatacacaataaataaataagcaaacaaaattaagatatgttatatggtgtgaagtatggctgaggaaactaaagcagggaaaaggaatgaaataaggggacaaggccgggtgctgtggctcatgcctgtaacccagcactttgggaggctgaggtgggaggatcacctgaggttcggatttcaagaccagcctggccaacatggtgaaacctcatctctacaaaattacaaaatacaaaaaattagctgggcatggtggcacacgcctgtaatcccagctacttgggaagctgaggcaagagaattgcttgaacccgggagacagaggttgcaatgagccaaatcgcgccattgcactgcagcctgggcaacagagtgagactctgtctcaaaaaaaaaaagagagaaagaaagaaaaagaaagaaagaaggaaggaaggaaggaaggaaggaaggaaggaaggaaggaaggaaggaaggaaagaaagaaaaaaaagaaagaaagaaagagagagagagagagatggggacaaacgagtggtcattctatttcaaatagagtggcaaatgaagacttttccagtggaggacattgagcagagaactgaaggaggtaacagaatggtccaggcaaagtggaatacaagggcaaagactccaaggagtgataactcatcattagggttgtaaatacacaaatcaaacaatatagaaaaacagaagctagaaagtgaaaatgatcagaaattccacggtcaaagaaaattaccattaacacaatcagacatatcccctcagacatctatttgaacacttacatatacatatacaagcacatatatttttacataaatgtgatcaaaactacaaataatatcttgtaacatacttgtttcatccataaatctgttacatgtatctttttatgagtactaatatttttcaatatctgtctactattacagtggttgagatgttttggatgtttgtttccttatatccttagaataaattcctagaaattaattgttaggtcaaagggtatgcatatttaagattttgaataaaatggacaactgccaaacagaaagtcaatatgattttaatattcattcctattaataatgattcagagagcattttctctgcatcctctttaatgctgagacttgttgatttcataaatgttcttttgattccttctgataaatatcttctcatatattcattggccttttctgttattcatatccatgttttttgctgttttaaaaaatgatggtttaatatttttcttattattttataagaactttctgtgtattagagttattctttttccatcccacatgttgcaaataatttttctggtaagtcttttggtttctaaccttgtttaagatgtatgtttattttgtttttgccatgtttagtcaaatatatccaactttattgattctgagacatattttaatattacccatgattataaaagcattgctagcctgtcatgcccccaactatttacaacattcaggagcagattttatatttcttaacacagtactcttctcagatttttttgttttgttttgttttgtgacagagtctcgctctgtcacccaggctggagtgcagtggcgctgtctctgctcactgcaagctccgcctcccgggttcatgccattctcctgcctcagcctcccgagtagctgggactacaggtgactgccaccacacccggctaatttttctgtatatttagtagagacggggtttcacagtgttagccagggtggtctccatctcctgaccttgtgatccacccgacttggcctcccaaagtgctgggattacaggcgtgagccaccatgcccggcctcagaaatattttttaaaaaaccatctggcctacatattagggaaaaccagtataggtcaaggcacttctgacacaaaaattgttttttggtctaagacaatgtataaagaggagtagcaaagaaggcatggaagccttttcttacacaggaagtcatcttcagtttgcctcatgacttttatttaatgcttactatatgtcagatcttgctccaggcacttcattagcattctcatttaatcccccacagttcccacgccagaattaccagacactttctgaaaacctggaaatttcttattcatgatgtaagagtagaagtaatattgatggtcgtgataaaaatttgctctttagtgtcattgctacgtatataaatgttttctgctgtgttttctttattttattaacatataaaccagatgtatttgatataactgctattctggcagatatcaatggttactaacatgttcatttacatacttattcaaatgttgattttaaatgcacatagcatcagactctgtcactacctttccttatggtacagtcctccctgtcaactcttattctttgaaaaatttggaacctagcccactgtgtctatgtattctcactctctcgctctcctccttaattctgacatcttttttaggtaatttcaatattcatgcaaataacccatgcaacattcgggcctctcagttctttcactttttcatatccaacaatctttcctcaatcccattcagccactcacgccagggtcataacctagaacttgccattaccaacaacttcatcccctcaaaatcagaatttcaagcttactattctctgatgcccaagcctactcccactggtacgatttctgacaaccttctgatggcaccgagacctccaaactatggacattactaccatttctctcttcatcgggcccaaagatgctttaatttctatgggtccttcattataatcgctccttgcacacgacctcaattcctttttctctctttctttccatttacttccctgcaacaacttactcgagtgaagttcaatttttcgtctacttcacacctttacctgtgcagcagaattaatctcttataaaattcatgaccactttctactggggcccccagtaatgtttctgaggagattctctcacattcttttcctcacatgtcaaacacccctttttcttctctcagcttatgcccttttccatcatttcataaagaaactagaaacaataagatgtgcacactcccaacaccaaatctaccaacttactgcatctctacctatataagttggcttcctcctattaccggaagcaatggttcccgcttctaatgaaggatgacctctctctgctagtgcagtggattctatcccctcagactgaaaggttttactccagtctgtgtcctttctctctcctgaataattagtttaccctccttatggaatcattcatagcactattatctactatcttaaaaaccaaaatcaaacacaaacaaaccaaaaaaattgttttcctcgatcctaaaggaatcatctatattcattgtctattttaaaattaaatataaaatatttactaggtataagaacatttgtgactaaaacatgtttcaaaataagcacaatttatcaaaaatctgtccctgcgattggctaatgatcaatataaaaaacagtaaaaaacacgcccagttgcagtggctcacacctgtaatcccagcactttggaaagatcagcacaaccaggaggattgcttgaggccaggagttcgagaccagcctgggcagcatagggagacctcatccctatttaaaaaaaaacagccaagtgtagtggcttgcttctgtagtccaggctactcaggaggctgaggtgggaggatcacttgagcccaggaggttgaggctgcagtgagccatgatcacgccactgtactgcagcctgagagacagagcaagaccctgtctccagaagaaacaaataaacagacagacaaaaacatcaaatatacaagaaaagtctttctttgaattcttagtccacatttgtatcaaatggactaagtttaccttatatgaaaatgttgccaatttaaataatctgctacattggtgagtcaaactagccccgctaaaatgaatgtcattgatagctgtattcttatatattttctccaattcttttttgtgcttttactttttgttatttttctttacttgtttttggcttcctatgaaactcttataagcagttctcagaattggtgtcttagaccatgccaggtaaaacttttccattatggtaacatttatggtcgtttatttggcacatttggcttttgctctcaatactgtgaattacaattctcaaaattctaactcacattttctaggttgttttatttgaattgtttataggttgttgatttttcacactttgaccttgttatttagctatctttcaatgctgtctgctctctgccttcctcattgtggactttaatttcattctattagttctctccactaaggtaatagcaattctcttaaggttctcagaattctcatgtcagatctgcctttttcccacttctcaaaacttttaacctttgattaagtaaataaatgttcgggtactcatatgactcttatcagcgtttatatgagtgctgaggtagttagttgacaccaccagttcattcagttcactaccttttcaatgttcgttagttctttcctgttctcacttcccttctggacatttaactaccagtgtctttgagcacaaaccacctgtcatcactgtcaaaatgtgtagattaacacatacagttttcagataactatagcaataatctgtaaaccaagcttagctaaacctggggcaacataaatattttacaactacaggttaagctaggagagaatttgggtatcatcggattcatcatcttttctctatacaaaatcaaactcagaccactcccagtaaaaacaaaacaaaacaagtcattttatttaagtgaaaattggatgaaggaagttgaaaactgaggaaagtaccagaagttcctggcttaactgagtcaccttgtatgagtgaatcagtgtacaaatgagtgattagatctagcccttgactgacaactgttctgtgacaatcgtgctgtaaactttaatcttaacttcaaggcttttctatgtcagacctttaccgaactgataatacatcaaactcagcagttacacatcttctttaatagcagcactgtgagaggttttgcaaagaaggcaaacgttatccacatcagttagtgttgaaacatttagtgggaaaacaggttctagttatttattatccaaacagggcagtgagagatactctatgtttttggctataagtcaaagtaaatcaaactagagtagactaatctaacaatggaaagggcaaaaagtgattgaaaggaatagctggaggaatttgagtactgtacttatttttatttttctttgttttttaattattttcagttgctaaaattcacatagtgcaaatctaccaaagatctcaagggggctatagaattcctcagctactcggtttcctcccctagaggcaaactccattaccagcatctttttacccatccaatgatatttcaagtgtatgtgtttgaatgcacacttggtagattttatttctataacaagaaagttatgtgtatttattttgaatttactcatatttggtttaatcatgtgccttatgctcaaaaatttgtgttttctaaaaaatggtttaaaatatatataattttgtattgacaggaattcagttggaattttctgttaaaattttgatatactatatggcaacattatataaataattttcactagaaaaaatatatagaggaaaataatcacctgtagtcttgccacttagaaataagcacaataattattttggcttattgtttatacaaacatactgaaatattttctggaataggaattataccatacacagttgtccctcagtatctacggggcactggctccaggatccaccaagaataccaaaatacatggaagcttaagtgtctgacgtaaaatgcaatggttacatttacacataacctacacacatcctactgtatactttaaatcatctctagattatttatggtacctaatacaatgtaaatgccatctaaattgttgttatactatattgtttagggaataatgataagaaagagagtctgttcaatacagatgcattttaaaaaatattcttgatccacagaggactgattccatagacatggaactcaaggattcagagggttgactgtatgccattatggaatattttcccctgatgacaactatatatttacacattttattttcagccacaaataacaaatatgaaattgaaaatttaaaaaaacttattaaaataagggaccataaatttgatgttcatgctctctctcaattcagagtccttgaatgtaaaatggtgcctattaccagtgttatcagtcatacctaggttagcagtgggctgtttcaatgtcaggatggtggggagtatattgagcaatggttctgtgtgacatcctacaaaatctctccctcagggtccaaagtgggtgaggaaagccctgggatagggaaacacaaaagagagggagttagggagggaaaattcttagctggccgctttttcaaaggagcaagggagggaaggcactccagggctcaggcattcagcttcctgcttgtgccccccaccccaaaccaagttgctgtagcgtcagccatcataccaaccctgtcagagaaggctgcgtgtgaggagggctcaccaactccctgagaacacagtatagatccaagtatccctgaaaggagacagggaggaggggaatatagatgtactataataataaaaatactgttcaaagaccataatacaatgaaaatttatatataataaagagatagccaaagtcccattgacttcctatgcattttaagctatatttactgctaaagtattcagtgaaacttgtatatccctttgctgtgtttttcatggctcttccttcaccagagtgagcccattgccgtcctatacaacaggaactgcagcttcagcacgtcatgggaatcttcctgagttccatatcctgccctctcttccgatgtttttagctggttgggcatccctggtgaccgtcatgacacctcaaagctaggttctacctctatatccagcccctggctgccttgctgtggaacagcactcccagaaattatacagtgcatagcggctctgcagcagccctgatgcactgcttactcggctctaaattttagtgtcactgcctagatgcactctctgagatgaccctcagttctatctgaatactctcaccacccttctctcccagcccagctcctcagacccccaacttgtccataacaggaattcagacaatgaaatgtaatgaaattttgctactttcattgagcagaggacagaattactgttacagtagctcactgaaatacaagataaaaggaccaaggcaaaaatattttatctagtaattatcaaaatatagccagttttcctagatagataggtggatagatagataaatgaagcttctcaaagttatttgctaaaattttgcccacataacaaatagaagaaaccagatgtaagcaaatatctttgggaatgaattttcgatggtcacagaggactcttgtcaaaattgttttctccagctgtcaccttcactaaaagacatttactgtttccaggaagaatggtctttcatttttgcttaataggcaaccatggaattctctctctctttctttttaaatcacccagctacccttcccatctctgttcacttccagaattttctgattgtagtctgggcctgaaaacacatttcatcttggctcactgaccacaactttcttaaagttggctactctctaaaactctgtctcttccatgaaattgccctgaactcagtggagttaaggtattgatttctcacagacatgtcttatttatgcaaacaattgccttatgccatttataatatgttctaccccacaacatcaaaatccaatgcacacattctattgttttgcaggatgttagccttgggggaaacttggtaaagggtacatggatctctctgtttcaattttttttacaactgcatgtgaatctacagttaattcaaaataagaactttaattaaaaacataatgcccttattttctctatcttcctccctttctctctttaaattatccttttaaatacacatgtaaaattttacatgtaaggataaaatttttcctctgatcctttaccttgtttactctcccaaactttccaattttttttttaatatattgtgttttcagaggggtagagactacgtttaagaataagggtacacattcggttgtttggaagaaattttatgatgtataaaacaacctcctatgtatcttggctgtttctcacgctatgcttgaaacaccagaaatccatgtaaactgtaaaacaaactgatgaaaaagccaagtccctttctccacttccatctcctattcgatccagccccacccactgtagagtaaggcagttcctgaggtcaaactcctcagtcacaagacctcacagactttagtgagtacagatatccaaaccaggctgataattccaaagtaaaagatgccctaaaagccagagaaaaacagggattttgttcactacattaaataaaaatctgagaaaaccagagcaattcctgccaagtataattaagatgctgggagaaatgactcaaaagaaatatacctgcctttctcattctactttgtattggcctttctgaactaaggtgctgacttgaaaatgttatactcttgctggaagtctgctttaactatcaatacaaatattcttcaatcctttacaaataccgattttcatgaagaataagatacattacaacaaaaaatcctgtaatctgtatgaccaggttagaactccattttttttttaatcaaagacttgattttcacactttctgtggaatcctagcatttattatatagtctgggccattgtttctccataataaggccagatacctgaggtctcataaagtcagaaaaaaaaaactcaataaaatttttcttgattttatgtaagtgtgttaataagggcagttcctatgtgttggaggttaaaaatgtgaaatgttaaatttaaaaataaaagtcacagtgttgccagccacaatgtgactgtgttaatacataatatctaactggcctctttctcaagtactgacactgagtcatcacacttcacttactttcccattttcccctggagggacgtttctgttttgtcaacctggaaaacacatagtttgctgtcatattggattcagatttagttgggtatgaaagtgatacatcaatattctagtatgtgaattttctttttatgggaaggaaatctcttatctttgcttgttcagaaagtctcaactcaaaaaaatgaggcattcatttttatccttgtactgtagttttatgatagaaactgtcctccttgttgttacatttataagcacctcctaagctcctttttaggacagcttcagtgctctctaatttttataatctatagtccagatcgatcagaatctgctggaccaagtgaggataaaaatgaatgcatttcccaattcagtgcaggatttgggatgcccagaattgaaaaacatagatgtgttaagcggatctgttttaatatccagaaaagtcatccctcagcctgggcaagatgatcttgtgctcattactttacttcccagaatggagatgatgcataaaccacaattttaatttgcttttttttgtgcatgtgtagaataagcgacaaaatttcagcggctgtgattattataatattgccataaacctctctaatgaaatgccagcaatgttgagacagctttattcaggcataggtcaaaatagccatgcatatcagtacagggcgataaatcctggactccaaacaataacactgggccagaaaggaagcagatattaaggaaacaattattttattaatatgcacttatgtaaggcactttagacacaggcaaggtagatgattacatgagttaattaactaattaattttaggtcatttagagtatgtaaggacatatgaaacacatttttgtgtcatcaaaaaactaagaatcccttgtgagaggcctcttatagctatgagaagataacttgtaatgcaaagtgataattgataagtgtagacaataagtgcaattggagttcagagaagggacagatcacttccagacagattaactgagctatatttcatgaagaatgtgatattttagttgaatatgcaaattaaaagattaaatgtttgtcaagtgcctattgcatgcagtgcctgctcctgagctctgcgtgggtatcaagaaaatttatgtcacagtcttgccctagtaaagtctataatgtggccaagaaaatgactcataaacatataaaacacaaataacaatcaaagatctatttcaaggcaacgctagaagtgatcatgacagaaggcagtcatgattagttgtgctcattagttatgcaaacaattaattgctttagacattagcaaaaggaggcactcacttccctgacctgttggcagcatttgacaaaaacagtgccttctgtcttccaggactctacacactctttgttctccccctaccactctggctgctgcttttcagtctcctatgctggttaatcctcatctataaacactaaagtaattgagggctccgcctgtggtcctcttctctcttttgtccacattagctctgttgcaaatctgatgtagttcatggctttaaatcccatctacatgctggtgattggcaaatttttatctccagcctagacattttccctgaagtcctcctttgtttctccaattccccactcaaatctctacttaattgtctacaagccatctccaatttaacatgttcaaaactgagttcctaatttcctctttaaaactttctcccttgtattctatctcatctcagaaaatggcagctctaccttccagttgctcaggcaaaaatccctggagtcatccttaactttttctttctcttaattcccatatcagatcgatcagcaaattctttagttctgccttcaaaatttatccagaattagaccatgtctcatctcctttcttacttccactctggttcaagaacctatcaataacctcctggatttttacaactgtcttgtgacccatctttcttcctctaccctgtttcaaccaagcagccagagtgatccttttaaaatatcagtcaaattatgtcactcttctactcaaaaccctccaatgacttcccctctcactctgattaaaacctaatatactcatgatgacctacaaggtcctacaggggctggccctcattctcactgatgtcatctatttttaccttctgacctcttcactctttcttgaacaaaccaggagcactgctgtttcaagctctttgttcttgctgttttctttgccttgaatgctcttccccaaaataacttcatagcttgctacttcatgtccgtcaagactttactcagtaaatccttccttcaccacctcaatctatcttagactggattcctcagaagcagagcctgataaaaggattttagatggtattgatttgggagatgataccctgaaatagcagtaagggaacagggaaatgagacagagaaagaagacaatatagggtacattaatgagtgggttaactctgtggccaaatagggctcatttcccactgggagcttggggaggctgtacagaacacattgtcctatgggaggagtatttaccctcctcaattcctgttagacattggctaagggatgctcctgggggtgttaattcctggcacttctaaccttgcctgtgtgtaggcagagcaggcatcagcggtcagagaaagcctttaggtagaaaatcagagatgcttacaccagaaggcccttcacatgtccaagaatattcagaatcaaggagatataagtaaggcattgccagtgctgcagcctccccaaaattccgtatcttccttttgctgtttttgttttatccctataacatttaaccctatatttaatacaatatattttccttacttatcttgtttacttttttcctttatgaatcatgaattttgtctcatttgttcactgctatatccccagcacctaatacagtgctttatacatgagcagcaataaatacttatggattgaaaaagaaatgagtggatgaacaacttcaggatgggtaagtgatccaggaagtcttagagaagggatgggatttgcactgagtaaacattggttaggtggaggcagggtcaggagagcagcccagcagtggagaaccacaggagcaagagtaggtgagctaacatagggtaagtttaaaaatgagttaattccttttgatagtagcagatggtccttataaaaataaaaataactggagtaagacgagataggtcttgtccaggcaaactgtcagactgaggaatttgagatcttttctgtaggcaactgggaagaaacaaatgttttaaaacagaggaatttaaactgtgttttaaacccaattaaacacgttttaggaagactaatctgaagttattagtaagctgatttggggaaataggaaataaaaatgagtgtagaagctttttcagaggcagaaactggggcctgatagagttttacaaagtgactaagaaaaggctaattgaatgttggagatagtgtggttaagctatcaagatcagggttagggatgacagaggggagagcctgcattgaccctaaggtctagagtctggaatttagtggtacagctaatagatgatgcacccaaagaccagtccccactccagggctcacgcttgtttccatcatcctgggcatacccagcaaaatccaaactcggctgagttttgagaatcttctggaactcaggtgacctaacattgatttgggcaccttggatttttgacaaaggtagttgttcaaaaaaaagagacaagtgagaaatttttagcaatttaaaaatgttcccagaactggctctgcttcctaaaatcagcactcactcctgctcccttccttatccttattgtctgtggttcttgggattcatactgcagcttaatgctgtggggagcatcagtctacctagtagtgcaaagatcccgccctgtctccagataaggactctggcagtcccatcattttacagatcaatgaacatctgaagcacttgtctagtttgggaactgcctttagcagctagcagtttggtcaaaattcattccacagttttcctaaaaacaacaataatagctacaatatattgagtacttattaggagccaagcattattctaaacaacttgtttatattagttaatataatcctcccagcaacttatgaagcaggtttaagtgttcctagttgactaatgaggaaaccaaggaacaaagaggttaagtaacttatccaaagtcacacagctggaatgtggctcctccttgacacctgctcaccagccagctcctgaccctcgggaggatgggtgaggagaggtaagggagggggaaggtgtacttgaactggtaccatcatagactagctttacattctttggattttctagatataataatgtggcactcttacaggtactttcctggcctttttcaggctattcccatgatggtggtgttggggagattctctcttgaaagccactagatccaattgcatctgtcccagttggtgatttgcaactctttcctgagccccgaggcatccagagtgtaccttcatattctgccattcagccttgcaggcagagtcatagatatgtttatactagcttccacacctcacagtgtctgcagctggtccataggaagcattcaagcatccctgacccccaagaactgtgggagtacagattcatcccaacatagccatcactttcctactgccacagctcctttaggtttctcaggtatgagctcaacagaggtgactttgaaacagttcactgaactttcctttgcaagttctgcatatggcaaaccatctcccgctcactttggtatctgatagctaagaaattgatgcctcaactgaaattcaggcaggaggtgtttgttttttaacctttttggtatgtttactatcttcatgggattccatggagacatcctggggaagaaaacatgatatggactagcatagtatgggccatgaaatcaaacagctcctggagtgccatgcggcaggaggcaaagcagaaaagaggtgcaaaggcaaggccacgaagagccccatgccagaagaactgacttcatgtgtgtggggaagggaaaccattggaaatttaaacagtaatgcttaacttagatgtcatgatcaagtgacattccccaagggaaaaaatgtgggaattacagtggtcaagtgattaaatcctggaaacaccagaatttacaacacagatggacttcatggatatttgttctatgttgtaccagtttcgtccgtaattcctgtgttactactcaagtctactgtcacacatctgcccaccacatctttttgagccttctgtttcagccttcttttttcctttcatttatcatctctaggaaatttttcttttcctttcttttgcaaaagcatttcctcatttttcaaattattttcagtgagttctagtttttattgtattattgaagattagaactttgtaattgtgtcattaagtctggaaaaaaatgggtgttaatgctaagtcatccctgatatcagtaatttctttcagatattgggcctaaaggatatggatgcttgttgaaaaagttatgagtattgctataagctctcagtttgagtatgtacaggaagaagaaataaacacacatgtacacacattcacacacaccctcacacagtgagtactcaagtgatcaaagcaaaaaatgtttaccccattcatcatgcccagccacaagcctttaaatataattttttggctgacatggatacattaaaaaattataaatttttcctataatctcactgattgttccaaaaagtttccaaattactttctctatatttcaacaatataaatcatagtgtttagtctatgctttctaaacaatttctgaaaagattacaaaatatactagccctccagctcaaaagacctattttttagcaggactgtttgtctttggaacatttcatataaaattcaaagtaggaaaaggaaggcaagaccaccccaaacctctgctgagtaacttcttttctgcctgtccctgtgtcaaggcagagaagagaaacaaaggcagagacctttagtcaactatttaccttttactcaaggataccaatataataactttgcttttctattactagtcaaaacaaattttctgttggacttttttttaattttaattttgattttaagttccagggctgttggacttcttaactcagggacttctcgagtttgaacccagcctctttctctggctttgactgttgcctctgtccttcctcacacacatgctgagatttctgttccagaactcccactcccctttctgcaaagggactaacatctctgtggctaatgtaggtctgtccacattagtatcttctggcctggaatgttttctggcagttatcaggtaacttaagcatttatctgcaagattagttaaaagacttgctgtatagctgtgatattgattcaactcatagtttgactcaattagccagtttcaaatccagtttcacagcaggaaatttcacacatacaaatcagcacttttgagaagcctgatgaaataatggctagtttaccctgaaacgctttgtaatctagaagccaactgtctcagtaaatgccatagtaatgagttaattatcctagcccagtggttgctggggctttctgccaacatcctttttttccacttgctgcaatttctatctcacaagcagtcctcttctcaacttccttactaaaaaataaaacaaaacctactttatcctctcagaatgtccccagtgagtctccacttctcaaatgtttggtaacccatggcagctttcttccacttccaccttactgcagtctcaatatcattgggttttgatggcttcagcattaataatggatcaatctaatttagaggatgcatccaggcctcaccaaaatgttgtgtgtggaactgtcctacagaaggagtagagggcaccaaggttctattagaccaaatcagatgatggccaaggagaatttgccctatattaattctaatgtaattactacataagttcagagcccagaattggggccctatttgaacctggatttactgcaaaactacaccaaatccaaacactgaagacttttctagaaacaatttccagaggatgatttggttggtggcaatcaccgtgacccttgaaagcagtgctgtttattttctcccttcttctacaattgttgtattaaatatatatgtcatgcacatatatatggaatttttaagttgtgtgattttgaccatcaaattaagagcccaaaaatatagttccaaattgaggtcagaacagcaatatccaattgacaattttaaatccattggttgtcagaagaaaaaagcaatgtttatttgttaatactttttaaaatcctttaaaaaattaataactttagctcagtgataatcatgagtgtgaataagactttagctaagagctgattataataatgaaaagcgtgatctatctagatttcaaaaatttatgaatggttaagtacattacagtatttccacaaaatgttaaaaatggtgcaattgaggaaaattactgacatgaacagatgttcatgttatgttgttaaggcaaaaaaaatttaaactatttgaagtatataattttttgtatggatgtacacacagacacacagagaaaaataatctagaaaaacatatctgaaaacattattagtggctatttctgtgtggtagaattacaggtgactgtattttctttcttttactttcttttgtctactcatccttaattttctacagtgacatgaactacttttataataatagcctaatttattttttcaaacaatgtttgttcctagacttctttacagtgttacttttagagatgttagtggttgggggtctgcaggacacctaagaaagtttggtttttcctccctgtgatggggttcaggccgattcatccagtgctcattaaacagaagcctataaacaggcatgtcgcaggtgtaaactagaggaagattggcttctgtcagcaaattagccagttataccaatggccaaactaagcaccccagtgtgcctttgcagataaaattaaggataaaattataaaatatccatgtaattgttttgaacaactagattggtaattttttccctttaaaccacttttgatctttgcatgcttattattcagagcctagtgaattgattacaaagaatattcatttttgactcctacaagagtaaatagatcatgtgcattgtacagattcaattcagttcaaatttttaaacttttactgagtaactctgcacatccccagaaccgtgttagacacagtagagtactcataaaggcaattcttagaggaattcacagttttgtcatagagacagataaattagtaaatatttctgataaatagaatagaatgggcttccatataagcagggagtaatacaaagcaagagtcatggaagtgagggagaaagagaggttaattctaactaaggaacaggaaatgtttcctagagaaagtaacattttggctacaattaaaagtgtattaatcttctttgggtcatagataacagaaatcaagttcaaactagcttaaataaaaaagacagtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctatttaaaaaaaaatgccataaactgggtaacgtaggcaacagaaacttatttctcacagttctggaagctgggaagtcccagatcaagatgccagcagattcagtgtctgatgagggcccgctttctagacagccatcttttagctgtaacctttttaatttgttgagtaacctccatactattttccataatggctgtactaatttacattcctaccaacagtgtgcaagagttcactattctccacatcctcaccaatacttgttttccttcatctttttaacagtagtcattctaacaagtatgtggtcatatctcatttgattttaatttgcatttgtctgatgatagtgatattgagcattaaatacctattgaccacttttatgtcttcttttgagaaatgtctatttagatcctttgcccatttttgtaatttaatttatttttatttacttatttttaatttttataaatatataaaacttgtacatatatgcagggtacatgtaatattttgatacaaatatacaatgtgcaatgatcaaatcttagtaattgggatattcatcccctcaaacatttatcatttctttttaaaatttattttcaaggatggtttcagaacatttataattttgtttgtgttgggacattccaaatcttttcttctagctattttgaaacataacaataaattattgttaactatagtcaccctgtatcttctttctttttttttaacttttattttaagttcatgggtacatgtgcaggatgtgcaggtttgttatgtaggtaaacgtgtgtcatgggggtttgttgtacacattatttcatctctcaggtattaagcctagtatccattagttttgcccatgttttaatgggattatttgttttcttactgagtagagctccttatatattttgcatattaacaccccttatcagatgtgtggtttgcaaatgtattctcttgtttcacaagttgtctctcaactctgattattgttttctttgctgtgcagaagcttttaagtttgatggaataccatttgtctatttttggttttgtttcctgtgatttggggtcatatccaaaacataattgcacagaccaatgtcatggagcttttcgcctgtgttttcttctggtaactttacaatttcaggtcttacgtttaagtcttcattttgagttgatttagtgtgaggtaagggtctagtttcatttttctgcatgtggatagccagtttttctagaaccatgcattgaaaagactgtcctttcccattgtgtgttcttgacatctttgctgaaaatcaatcaactgtaaaagtgtggatttatttctgggctctctattctgttgcattggtgtatgtatctgttattatgctggtaccatgctgttttgattgctatagctttgtagtagattttgaagtcactgaaaactacttaacattgataaaagaatttgaagaagacatggataaatggaaagatatctggtgttaatggattggaagaattaatactgttaaaatatccattctacctaaagcaatctatagactaaatgcaattcctattaaaatttcaatgacgtgtttcatagaaatagaaagacaaccttaaaatttatatgcaaccacacaagaccctgaagcgccaaagcaaccttgagcaaaatgaacaacgctggaggcatcacattacctgattttaaaacctagtaattatttaaatgtaatgggaactggctatttgaagtatatcttgcgataagtacttttgtaaagcaataaattaaattgccagttgaaacactggcctttaatctagaaccagaaataccatttgacccagcaatccaattactgggtgtatacccaaaggaatattaatcattctactataaagacacatgcacacgtatgtttactgcagcactgtttacaatagcaaagacatagaatcaacccaaatgcccatccatgatagaccggataaagaaaatgtggtacatatacaccacggaatactatgcagccataaaaaggaattggatcatgtcctttgcagagacatagataaagctggaagctatcatcctctgcaaactaacaaagaaacagaaaaccaaatacggcatgttctcactcgtaagtgggagctgaacaatgagaactcatggacacagagaggggaacaacacacactagggctgattagggggtgggttgggagaggagggaacttagaggatgggttaataggtgcagcaaaccaccatggcacatgtatacctatgtgacaaacctgcatgttatgcacatgtatcccatttttttcagaagaaaattttaaaaaagaaacattagcctttaatttttatgttttgtaagtctgaattattatatattgacttgacttagaatagtgtgtactcagactgtctttttttaaaaaaatgaattttaatccatttaaaatgtaattcaacttaagcttttagaacattacctgtttccagtgaatgattaataaatataaatacatgcttccttgaatttatatcagtaatcataaaatcatctatcagttttaaaagtctacgtgtaccagacatttgtttgttccttggcatagcaatgattggatatgaattcattttatgattcacagaatccccatgggctcatagtgatatgggcgtttgaaatcaggccaattgatgttttaatcctttctgtccttcaggaagaagtggaattaaaatctatgtttttgttatttagtatttgtggcactaagctaagattacagataaaatgtagaattagatccttgccaaatggattcataatctaaattaaacagatatacaggaaactgacctcgggaaataaattgtaggagtgacaaattggtgaaaaactcaggaacaaaccaaaaaatctaaacagagatagtaaagtactctattattaatatttcctggtaaagaacgaaggcatagaacaaaaaggccaatttctgaatccagttctcccctgaacttcttgcataagtttgagcatggctcctttcttcaccctgcattattttctgtatcttcaagatggttcatcctttacaaagaagttggagtcatgtatgaaataataaacatgaaacacttcaagtttctcagaataaagtttccagagcaaaatgaaataataacagggatacactgtatgatttactgctgatagtttatcttataaagcaagtaaattaggggctgaaattttatatattagaaggatttatttcaaaaatgattttaagaaatatacaatcagtaaatttgaactaaaccaatttataaaactttgattcatacacaacttttggaaaacatcttgcattattcagagttattatacctttgtggatttaattaatacccaacacataaggcaattctttaggataagtaatgtgctaaatcagtggtactcagagatatattacatttgagccattgataataatgaagtattattaaatgacaacttcatgttaactacttaataataaattattaaataataacaaaaatccatgtaactgttatatgccttttaaatattttctgtgatattaaatatactttctaatatagaaattgaaaatcttgaacctctctagattacaagcaaaaaaccacatgtgccatctcctattaaagtgaatgatcagttaaggaatattttgtgacactggattaaagaccttaagaactaatagtggttacaatgtaataattagtatggaattatagacaatttcagaatacataaaactagttttttaaaagttgtctaatcctatattgaaataaaccactgcatataatcatatgaatttgattacaaatgaggctgtgggttatcttgaggacaggatgaatgatgggaaagtgaaaaatttcccaagatggttgaaagacttgtatacagcaagaccatattgcataaaaaataactgacatagtcaccacattttgaaaaggtgccatgtgaagtcatgcttccacattcaatgacagaatatccttaccaaaataatattggtatccaatatggagaacagtggatgggacaatgtcaaaaaggaatgggatcaaaagatgagcaggttgctttcttccttaccccttgaatagaccccacacacacctgaagaaactgagtctgaaataatggaaaaaagctgtagttgttggcctttgtctgcagaattcctccatgtctcccttttatatcccttgttcccaattcccctaatttctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgcatgaaataacaaaatataatgaatccttaattagtagaatatatttaatgatttccatttacatttatatcaagaaaaaaaaaggaaaaagcaacccagcacatctacttatcatcacttttcaaacatctgtggtttaaaaaacagctttgaaaatcgttacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatatatttattttcttactatggtaggattctcaaaaataacaacagaaaatataatttgaaaagtattgagccaaatttttatgctctccatttcttgggaatttccaagggaatatgtgctatgaattccttaaaggcagtttgcacttcgagacatcatacagtgtcatgtaggctaagagttttttaaaattatcgtttctctatttcacacttaatatacaataactcctcattacaaaagtactaaaacaattcaggagcacgtagagtaacggtaaaatttcctttcatatatccctccaatgccactgccttccccacaagtaaccgcttgtttgatgtagatctttactttgagatacacacacaaagactacacacaaacactttatgtctttactgattatgtctttgttaccttttatttgttagagttataaaaatgtcatggaactggtcttgtttaatatttatagagaaccaaagtttaatgaggaaagctgatcaaagacatgaaatatagtgaaagaaatgactgggtaataaggccagcccactcagaaagatttcttccacagataggtttaaattcaattgttctttgtgatgaaatgtccccaacaaattgtaaaaatatttcctaaaagaagaactctactcattaccacactaactcattagtgtgaattcattggctattcatttattaattcaatcaatgaatagttatgaagtagcagcatattcacaagatttggtactgtaccacattgcttggtatcaaaaggtgaaagggctcatttctctctttcaaaaacattcaatcaaacagcttcttgaattgaaggtgtgggtataatacaccatcaaagcagtttctacactactgcaaaccttggaggataaagaaaacatttctagatggaaactccaaggattcttgaagatgttatttgggcttaaagtatagattctatttcaacaatagggtccatgttgaggagaagattccaaatggaaatgacagcatgaaaaacaagtgtgaaacaaatgccaaatgccaagtgtgtttaggaaatgaagagtgatcaagctggagtgaaggacagatgtaagcaagaaatgagaaatgaacctgaaagtgcagagtagggactggcagcatttggaaatgaagtttggaatttactgtacaagtaataaagagccattaaaagatttctggcaagggtgtgatgagacacaaaagtttctggagagagaaagatatggtaggtctgaacagcatgcagaggaggaactgagtcctagactagtaaataggttgttataagtaatataggcatgtggtaataagcattgagactaagggagatacagtgaaaatttttaaaaatggggtcatttcaagagaaatgtagaagaaagcataaacaagttgttgattcatgtgctgaagtcaaaaacaattccagatttaaggtgaccatgtattgtggtttgtctagagcatactgattttagtgtattacgtaagcattcagtccactttagcatttgtcatggacttttcctttttaaaaattattattattattagttgcatcagaagaggttttataagacctttacatcatacttcaacttctgacacaatctcttttagtagagtgtaatgtgcagttaacggttctcactgtaacacatggtaaactctgaaacatagtccatctctcgtatgccaaccttttctagtctcaaggaaagttctatctttctttgaattgccacatgcagggaagtggctgattaaatgatgctgtttggatatgaacagctagaaactgctaactcctttctgtcctggtggttgtggatgtgttggatgctgcagaccccgccatctactgggtgtagcagctagttgtgtcatgacccatgctgggtggcccatgtcatgacctatgagaggcatgaagccatcgggatgccagtcagtggggttaatgggacacgtttttacagaatagatgtaaataaaatatgtatggaaaatagggcctgagaaatcatgctacagagtgtctagaggctcttgctatggtaatttggttacctattgcatgttatagattgacaactcttttacaaattttttggttatgtttcattctgaaataaaccttttcagaagcaagaatttaatatattcatgtttgtattagtcagttttcacactgctataaagaactacctgagactgggtaatttatgaagaaaagaggtttaattgactcacagttcttcaggcttaacaggaagcaagcctgggaggcctcaggaaacttacaatcatggcagaagacaaaggggaagcaaagaccttctccacactgtggcaggagagagagagcacgccaagggggaagtgcgatgcactttcaaacaaccagatctcatgagaactcactcactatcacaagaacagcaaggggaaagtccacccccatgattcaatcacctcccaccaggcccctcccccatcacctggggattacaattcaagatgagacttggcaggggggacacagagccaaaccatatcaatgttttagaaaaattttgattttctttatctcaagaaagttgctgagcctataacacacaaaataccatccatcaaagggtcctcaatgctatcattgaccatagacaatcagaagatggaaatatgctgaagcagcggcaacatctatgtcaaagtttagtcattatttttaaaagactgtgctctaagcaagtgattaaatgcatgcagctgcttaaggtgtgtttacatttcactgcatgcagcatggcttctcatttaggtcagacaacagttttcctagattaattacattcattttttaattctgagtttccttaggcctatgagaaatataaaacaatggttactaatgagttgacaccgttagcaaaagagtactgcaaacagttaaatgatgacagttttatatcaatgtgagcagatgaatcgaataatagtttcaatagcagttaaaattttaaaaattcaattcacagaaccaaagaaaagcttttagaagtttatcatgtcaatggtgaattgtctgaccttattataaatgctgtcactttaacttaaaaattaaacattgtgactgcaaatgataacataaatacaaatattagtggagcacagcatcatagtaaaacaatgattttattaaaataaaaatctatagagcagacgtgtagttgaaaatgattggtgtatatatgatgaagttgtggaatttattaattgaagtaaaaactgtagtgaaaatttgcatttatttttatatacacaaaattagagtgaataacactacctgaagaataaatttgatattgaattaaaaataatcttatgtatgaaactatacactctctttcctgctggtcattaatcagtctttggaaatgtttgattctttgaagcaccactttacaaatcaaccagagtgtcctaacatggcattggactatttttgtaaacaaggcctctgaaattgaattgcattttgttaaaaatcagttggaagtctttagttaaggtattcatcaaatggagaaaataacttcaatttttaatctttacaaataacaattattaaaaacaaaattgcaaataggaagacattgaaatgtatccctatgaaaacaaggagtaagtttaaaaaaaataagcaatgagagctcatgtataaaatatttaattttgaaagtccataatcatgctttggaaaatctgacttatgaagagaagcctttgatggagctcctctttagtaggataaagtaatattctgtaccagatttcacaatctacatttgggaaaatattccaaaattacaaatagaaacaacttacttggtgagttttattttgaaaaaaagagagagagaatgaaagaaaacaattcaaatggaagcaaaaagataatgcctataaaaatatttcagctcaaatatttacttgttttaatatgtatagtaatgagagtaaagcttctatttaccataatttcctctgagctcaatagatatttccttgcttataaagtattttctcagttttaaatattatggtttacaaatttcagtagtaaaataaatatgctgatattgaattataacccacagaaatatcaatgagttcttgctgatataaataaatgtggagaaaggacagctgtccattacagattttaattaataaatagagaaagaagaacggctgggcatggtggctcacacctgtaatcccagcactttgggaggctgatgtgggcggatcacgagaccagcctgaccaacatggtgaaaccctactctactaaaaatgcaaaaattagccgggcgtggtggcacgcacctgtagtcccagctactcaggaggctgaggcaggagaatcgcttgaacccaggaggtagaagttccagtgagctgagatcgtgccactgcactccagcctgggtgacagagcgagactccatctcaaaaaaaagaaaaaagaagaaaatagaaaatcaaattcacattacataaacaccacagtcaactattgcagacaaaatctactggttgatgctatgtttagtgggtgaaagttagaggagaaatatacttttcatagtctcaaaactttctccccaagtaattattaacctcaaagggaaaggtggtaactttacattgagaaacctagcagaggccagccacctttatctagagatctagagttaattttccttctctgacaatcgtattttgatatgtaagatgttaatattggtgaagctgggtaaagagtatttgaaaactatttgcactattttttcaacttttctgtaaatcaaaaattagttcaaaatgaaaaattgaaaactatgatttacagagaaaactcaattgaagatgttcatactttcagattcactaatcatagaattccaactttgaggaaaattacagaaaattttatttaaaaaattaagacaatggggccatatttgaaaaagaatcagttggagtctcattttaatatccttatcctttgtatctgggctggccttgcgacttgctttgatcaatgaaatgaggcaaaatgatgttctacaacagcattatcacttctgccttctgcttgtgaggggagaggcccaaactgcccagccattcaaagcaacacagccaaggcctcaggcttgagagtaaggtccttgtcagctggccagctggcccccagccagtccaccaactgacgggaaacatagaagtaaaccccatcaatgccagttaaatgctgcccaattgttgacccatacaattgtgagcaaacgaacagttattgtcttaagcttttaagttttggagtgattcttttttttcctgtggtaattgctaactaatacagattaacaggtgagagactaacttatttcaactcaaatggtgagggaaaacttgatttggaagtggtttttgagcttgcacttgaaagatttagaaaagtggagattgggtgcaaaaggctttctaaatgagaaatagggtaaaggcctcaaagcaagagtacaggaaattctgaaaaaggatagcagcagccctatgtgactggagcatagtgccgagaaggcctctctgagccaaacgttgtagacagaccaaaatgagttcactggcaatttccattactaaaccttttaccaaagcactttcattccataagataaactgattgttggtgagatgtttccaaaattatgttatcacaaatgaaaagcacaggtgtcccatttctttgtccttagatggcacaaataagagtttgtgattcacagctgtagtgccaaagggagaattttcctgatacctagataaactatgaagaaaattttactcaataataacactggagtttggataaggtttaagtttaaacacaggggcatatgcttgcagatctgagagctctgaggaagttgtctgtactgtcatgccaagatacaaagtggattttaaaatcttgacttaagcacagtgtctagataggaaatgggttttcaatctttatagatgggagtatgaaatgtggctcttgtttccacttagatggcagtgtagagtttaagaacacatgggttttaatatcaggttgacttgggttacatctcgttttgtcctgttgctagatgtgcgatcttaggcaagttacaaaacctaattgaacttcagtttcttatctggaaactggaggcaatagtacctatcccatatggtttttatgaagatttgacaaaattatgtgtacagaatgatagcccagtgcctatccctaattaatatccaatagatgatgttataaattattatcccaagaatattagatttactcatctatttaaaatgcctgattttttctgtatgtaacaagtgaataaaatgtgactttttcttagaggtcctgatcatgtttttcaaacaagtcagatttgctggatgtgtgtgatttctagatgcttccaatatctatgcatcttaatgattcatggatctaatatggtgacatatttttttctgtgaagggagatttaacatatcaagtgtcattttcacatttggtagagtgaacagcaatggcagtaattagtctccaaagatggccctcaatggaccatgcctcctagttcacattgttatatgagtctagtgtcatattgactctggactggccctctgattcactattacaatgtggtgaaaatgacactgtatcagtaattgggcccaagccttagaaaagcctgacaatttctactttcataattttggaagcctgccatttaaaaagttgagataccttactggaagtatcatggagagagacagcagatgagactatgtagagtgagaaagtggcacagctatcccagaatcccagcagaggccagcctcccagctgttcctgccaaggcactagatttgtgaaattagtcatctcggacattaaaacccagataagtccttggatgactcagcctgagtggatgtcaagtgtagcaaaagaaccacagagttgagcccagtcaatctacaaaattgtgacagaaaataaaaatggctgttgtttcaagatactaagctttgggatggtttgttacatagcaataaataacccaatagcaatagtcctcttatatgtgtttgcatattataatgtttcaaagtattaaaacaagactgtcatgaacatgcttgagtctactttactggcttacctcatgcatagtgcgctgagaatcagactgaaagaagcttttgataaaggaattgtaatttcttgtatgcattttcctgagggtgactctctccttggagagaaataatttagagctttctgttctttgaaggtgtagtaggtgatgcactgttgttctatagcagtgctttgttttcctaaagcaatgtttcttgtaggtccctgaagtagaaatctgtgcctttagcagtgagtttgtgagaagagtactagttgctgacaattcatatcataatgctgtgtgggagatactacattggagctcacttaaatgaatttttcaggattattattgtgtgtaagtgtgtgcatgttttactcaggacacaaataggcttgacctggttaattttggccaactgggactggttgggagggtcctagacctgcatacttgaatgtatgaggtcagtgcggaggtttgggggacacccagatgcaacagttggaagatcagaatgcaaatgttagaagtaataggaaagctgtccgctttggagaaaatgacaatggggaaatggtattttcaggatcaaggatacaccaatcctcacaagaaagaaaaaatcagcaggaagcaggtaccaggctgtaacatgggggttggacttccagtctcctgagcggggtgaatatgggtcccagtgctgctaggacttatttcttacaataaaaataaaataaaggtggcttagtaaaaagtcttacagttctgatttctgaggaggatggtaagttctaggatgctatgctgatggagcctgccagtggaagtcagtggcttagctgtgccaggaggagtattggagagttgaggtcagatttgaatggacctgcgaaaagtcacatattgcgcaggatacacatagaaatacatttctaaatcccaggaaggaatgtaagagtctgtgagttcctgaacactttcccagcctccaggaagctaaaatgagaagtacatagaaagagtaacaaaccttgaagttgcccaatagcctggaaagagcatggcctttgaagtgaaacagatccaagtcttaatcctggctgtcatcactagtttgatggctgtgagcaagtcacttgagccagtgaggattcagtttgccttcctgtaataaaaagctggccaacagggtttgaccaaaaaggggtttatttttctcacgtcacaagaaatccgtaactcacaagtccaggactagtgcaactgcttgctgctccttcaacctcttcccttcacaatgctcagcatgtggcttttgatatcatcccttagatggctactccatttccaggcatcacttcctaaagacaatgaagcaaaatcacctcttcagaaggcttttgtcattttgggggaatataaccattttcccagtgacttctacatatatctcattctattttgcacacatgttatttcatttcacatacatacacacacaaacacacctttgcacacacacttggccatctaaataccagagatttggggaaaggtcaatatttttaactgggtgtgttaccagtccaaattctatgcctttggaagaaggaagaacagataagtaaatagcaatggattccacatgcatttgttcatcttttcaatggggacaacaagactcccatggcaggaaaatatcaaacactgggcataacccctccagaatgtacgctccatgagggaaggaattcttgtctgttttatgactgttgtgtcaccagcacccagaacagtgtctttaataactatttgctgaatggatgaaattagagataatagtaagcgtgcagtgcattggctggcacacagagggtccaggaggtgattgttgttactgtcgtcactgagtctgtctgtggtcagtgtcattgtcaaatgtcactttcaaaagtcaatgtcattgccagagattgctaagtaatatagagcaactagctacagcagaggcaagctttctcaagagaggtatttactaacgtgagttaaatggaaaatcatggattggtctaagacagggttttcctcagtgttgtcaaccttacattaaaaaaaagttatgtaccttttcctgatccagccagcaaaactttcactttctcagagaaccaatgttgccttaagatgtcagttgttaaagaatcctgacctggagttaaagtatctagaagtcaacaaggttcaggaagacatcgtgagctatcatcaaaatatgcagctgtatttttaaatgttagaactggactaatatttcaagagcatctattccattactgagacaaaaacagtaagagctgatttgcccaatttatattagtaactctggacactctcagaagggactctagctcttccaaatataggccagagctttttcctctccaaacattgaccctctccacagcccactagcaccccccagtttgtcctgctcagctgctagccacctcccatggccagatgtactgagtggatgccaccttagcttcagaacagccccttctttgagagccccaccacaattatgacattgtcttccctggcactggacacagagatgatcacgacaggttcccatcctccactctgctcttttcctttctctgtttctctctttagggtccagctcccttcattggtccctcttcttcatctctcattccctcctaaacccaaccctctaaaaatgctattactgcatcaccagggacctcagaattgtcaaatccaatggacacatattttttctgaacttatcttacgctagtgcttctgaaaaaaaatttttaccagaatattcccaatatcaagagagaaatatcataagcctcaggaagtgtggagttatgatctgaagctagagccacaggcgtgaaataatttggaagtcttattttgtcgtaagaattcatgtcagttttccagtctactcttctaggaaaccagagtttttttcttcaaatttcttaataaaatggatactcaagggatacacttgttttaatcccatggctgcatgtcccacctgctgcctgtatttggtttgaatattataaccctagccagggtctcttgggtatccacagcagcagttttatcccctaggctaggtggaagctaaatgagactgaaggcaagggagtgtggcttctttaagcagcatatactctttcagtttctttcttctcacttcctctccttgttttatgctcccttggagaacagaatgaggctaggaaagaaagggagaaagtattcagatgatctggcatttgggctggcgaatctactgccttgtttagtcatggcagctgggctcccatccaaggaggataagaagaccgcggggagcaacccttgaacttggggtgaaagctgccaggaaagctctttcactggagatggcataccatggagctttcgctcagctgtgtgtgtcactcagggaaatgacagtcagaggcctgtattgttgcacccagatctcagaccttctttccagagagtgggccatctctaccctctgttcatcacacccccttctctgtattctaaatactctgccttgaccacaagttttatttagaaccacagataacttccttttgggatatatctcaggccataatttatacatgagattttaactaaaattatttttgtaaacattatcttagttggtttttagaattgaacttactgcatagtttttcttgttaatacaagcaacatccaactttatatcctccataactaacagttcatgtcatattttcatataatttttaaatgaaatgtaaaaatgggtagtatagagggggccttaactcatcaggatttctcccaaaatattttcctgtcaaagagaaaacagaacaaaacacagtgagtagattagaattaagttcagctgggagaaacagaaacaaaaacaaaacattactagcataataagacagatgttgatttctctatgtgtaaaagtctgaaggggatgtgttctagagctgtacggcagctctgctccacaaggtgctctgggatgcaacctccttccagctcacagctccactcaccaagaggtggctgttatcttcatggacaaggtaaaggtattaatagtatccaaatcctaggtagcagatggagacaaggatgaagacagtgtaaaggctgagccagctgcctcttcaggaaaattcctggacattgtcatgggacactttcatttatatcccactgtgggctttaattacatggccataccaattggatgggagggtgggaaatgtcattttgatttggggcagccaaaacttccatttctttagaagcagattatgaccatggggagacagctagcaagctctgtcacccaccccaccaacttagtcaatcttggcagtatttctcattattttgttcttgtccttcctcatgctgatccttctttgtggctatgccttctcaggcttctctgcagtctctttttcttctataccatcctcaatgttagtgtttgccaccatctggtcctcaggcactcttttcttctcactctgtgaacactctcgcatggccacataaattcatgtcttatactacccaatttttacaaacctacatctttgtccaagatattattttcttaaatcctagattaatatatccaatttcctaaagggcttcactgcttgaatatacaataagcaactcaaactcaatacatctgaaattaaactcgtcatctttctcattaaactctgttatgccatcagtgtctacacccacatggtcacttaaaccacaattctgggatatgcctggaatcatctctcacacatgttcaatgtccatttttttcctttcctctgcatcctccttgcttttgctttgctttagttatagctaacatctattgagcatttgcatgtgccagcccctgatgcaaatatattacatattttaactcatttaatctgcaaacaaccctactattattatctgcattttacagatgaggaaattaaggaacagataagtaactttcccaactgtcacacatcgagtaaatggtaaaaccagaatttgaacccaggaagtcgactccagtgcactctctcttaactgcaataactttctgttttagcccctcattgtttatttaccttattattatagaagactttcagtttgtttatcttcttcaatctcaccaactcctccccgaaattccatctttcatacgaataactaccagaatagcttttctaaaacacaatctggtcagttacctaaaaatccatcggtgcttcaccatcactttcaggtgaaagtttcacctccttaatgttgcacaaggcccttcatgatctggccccagcacacctctacagtcccttctggaacttcctcacagacatggtcccatccagccacactagatcattccaagtttctgaacagatcttactctccacacctatctccttgctttttgcactcactcagaggtcctatgtcaaaagtacactgttatgagtgttgctcaaagctccccaagggctgaataggtaaccctctgtactttatttacttttcacatagtatggtaaacggaagttcagtcttctctctctcccttggtgtcctgtataatttccttgaaggaagagttggttctttgtatctacagtacctaccaaagtgtttggtgcatgatgatcatcgagtaattttcaaaaagggatgaactaaggaacacaactgcttcttcccttttatggcattttcctaaacaaaacccgggacaaggagatcccttgaaaatcactgactttacccttgtttacttacctgcaggagaaattcatcttggagcaggatcacaatactataaaggccacctggtttggtgtggcacatgttggggctgcacgtgagagtatggaaatagaaagagtagcatatgtttattcacatcagtaaagggaacaaattgaaacataggagtcatggtatccagacataatatcaatattttgggaagttatttttaatgaagataactaaggggacttaaaagggtgcattttttttctcctttgcatggcgattgctttttggggatgccaatgcagaaattcttgggttgtagaatttttaaaaagaagagcacactagttttatttattttacaggattctggtgcctttgtgacaggcaaccacaagtgaaattaccttcaatggtcttggcttagtccctcctctgctcctaatcatcccctcaaacccacatacattagacagagcggttgtccttcaccactaaagaaatgcagccgagagttatgttaccgtggaaacagaatcactttttgctgcaagacacactgcttcatctgcactattatgaagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagattcttctgttaaagtaagagctataaattctttcaaactacaccactcctgttaaagaaaatgcaagagaatttacaattaatgggttcattgtgtataaagataagtgttttagctcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatccatatgacctacactagttgaaggatgaactctataggatatcagaaacaaaacaagaatcctgtgtccttcagctccaaagatgctcacagttattgagttttcttataggcccccagaaagcactactaaaacaaacaaacaaaaatcttaaaacacacacacacatgcacacaaacacacacacactcacatgtgtgcacattatctcacattacctcagagtctaactataagcatataatcacaggaaaatcccacatcatgaaaaggaaaaatattttattggctgtaaataaattagaaaagaatgtgatactttaaaagtgttagtgttttaattctagaggtagcaaagcaaccttaagagacaaatgacaattcttgagcaactagtcagtggcgggcactttttatatctatcaccccatttcattctcaaatgaatctcaatggctactattatttttattttgcaaataaaatgaaggcactaagactcaaataatttattttaaaaaaaatcattctccgattgtataattcatccatgtaaccaaaaacgactagtaccctaaaagctactaaaattttaaaaagtcattctcaaattccccacacaaaccctaaattgtttctgatttcaagtttagtgttctttccaagtgcatcacctcatacagtgctcagcaaagctctgaattgggtggctggggaggggtatgtgctaaaatccagggaaaaaataagaatacagcctctaattctgcctttccacctctagacaggacttcgggaaaatcatttatttgtttcaaattcagatttattcatcctgaattaatatggataaataaccttttatctcttcatgcaagtaggaagttaatgtgtgaaaaacatgttgaaaatactaagggcacttttatttctgtggaaagaatgacttactcctgttaactataataggtccagattaataggtccagatcactgtcaatctattcagccatcccaattaattcagccaccaaatcattattagtctcaaatctgcaatgttttgagagctgaccctgtcacatattgcttggatatctgccaaataatttctatagtgttgggttgagtagtggatgcataatacttatctttaagtaatgaagtgtggatcaaatcaaactatcgtccaatatctaatttagtcaccagttatagaccctatttcatcataataccaaaaaggattcattaaatgcctggatacaattagtctaagttgctttacgaagatacagtcataacctttgttcatggtattaaactgatttttaaaataatgatctattttattatcacatagaaggaaatattttatttctctaaactccattgcttgcctttcagagagcctcaggaaatattagtggagtaaatattgaaaaatacttacccagcacttgaaatttcaccttctgtgtctcttataaattaacaaaaaattgcttcattttgagtatttcatatgtatttactatactatgaactttacaaataccacctcttttactttttacaatgactctctaaaattgaatctattggtgtcatcaggtttaaagagtaaaaataacttgctcaagtcaaagtgccagtctgtagcacagcctgactcaaatccgtgcacaccaactctaaactgcaactcttttttttttttttttgagatagagtcttgctctgtcacccaggctggagtgcagtggtgcaatctcagctcgctgcaacctctgcctcccgggttcaagcgattctcctgcctcagcctcccgagtagctggggctacaggtcgcctgacaccaagctgatttttgtatttttagtagagacggggtttcaccatattggccaggctggtctcaaactcctgacctcgtgatccacccacctcagcctcccaaagtgctgggattataggcgtgagccactgcacctggccacactgcaactcttaaccgcaattctgcacatcaaccttgtgtgtaaagttgcctttgagaaaaccagctttcttttgctgcccatctctgataacttgttcatcctttgttttataaaagaaaaaaaagaaaagacagaaaaagagaaggagcaaagaaggaaagcagggagagaaggaaaaaggaaagaaaaggaaaaaaaaatcactcaatgttttccaccctccctgaataacctggggataaagtagatcccatccaagtttttgacacgagtcgacattgttgaaaataatcatgtgaagtgccagctttgtctgatgatgtcattttgcctttgttttgcatttatcaggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttcactattagcccctttcttcttaataatcattttcttctgatattatttatatgtataaatgtgggtatgtgtttggattgattcttttaaatggaattggtatctttctgaatatgcagtttcctatcacatgaagcttaaagccaaaatcactaccatactccacatcttacccagtggctctcttacagactctcacttgtaagtagtatccactgtcaaataattttgattagaccaggaattaaacaaccacagagagctgtggtgtataagtcaatgtacacccgtctgatcctgtagcacacctcccccgtttactctgtgtgataggggaaagagggatccccaacggggatggggatggggatcctaacgtggtacaagaggtttttagctgcactaaattgaaatcatgatactactctggaggaggcgtttcccggctagaattgggtctgaaagtgagtttaaaatgagcccagtgaattttttttttaaataaataaaatttcaactttattgccgtctactggtcattaaattactgcagttttaaaccattcttcatgctatggaaaagaattcaagtcaccaaatcttaagcatttatttagtgtttgtgctgtgtcaagcgtagttctgggggctaagtatacaaaagtaaataagacttagattctgccctaaggaactcaatatgatcagttaagtcttaaatataagatgtaatgagcaagtagctctagttaattatttctattttcagtttaggttcagtgttagtatatcaattcagagaaacattcaaatttgaagttgtgttcattttaataaattcatatattagaagcacagtcctctaaatgttcagctgttttattctttgggaaaaaaaaggaaatggtgttatcctgggtttgaatgaacacctttcctaccttaaacaagtggcaagatctgatccaataaaagctggagccattttccttcttcgggttctagaactaagcgtgagaaatgtcacagaaagtgaacatttagcacctttgatcaaaccccacccaatgccagccctggggatggaggtccttgcctgaaaagaatgtggtgcctctactttaggcatgcgcttctaactgttcaccagaagtggagcagtctgttcagagaggaaagaacatcagtttactattcattaaacttttaacttttaagagaaagaaacagaccctgccagaagattccactaggcagtatagcccagtatcatatccccacaaagcagctaaaggcagaggtgattttagaacctcatgaagtctcagttactgaaaattattttcagacccaatggcttatttggtctttttctgcaagtttcaggtaattcccctggccatgccccaaattttgagtttagagctattctgattttaggtaacagttgcaggcactggaaggtgttaaggtttagaaagcaaaaaagccaaaagaagcagtattggcacaactatttcttaagggaaagaaaatcaaataaaatagctgaagttagagctattttcccaaaagttgcctttccatgaaaataaagttaatgatggattgtactggtctgcctgaaggctgagggcagtagaattattgacattactataatactgacctcaatcgagctaacctttaaattctgagaaacaggttttcaaacaggtttataggccaaagagagtctggaacaccctaagggcttggttttcctggccaagtaatcagtcaaagctattactgtcactctgccttttccttgtggctagataacacagcccaagtgcagttgccaatttctaatgaatactaggtgtggcctccattttatcctgtgcaaggggatattggaaatctttgttcgaagcaatatccacgagagaggtggcttcatgcctcagaagttaaggtggattttaaagcaatttaggctgctttttaaccaaaattacagtatgtttattgagggcctaataaatatttaataagagtgctaaataatgttgaaaatattttttaaaaatatataagcatagttcttgcctctcaggaacacaaaccctagttgaggagataaacaaaaccatgtggaaagtttaataacaatacaagaattaatttaaataacaccagaagctttcacagtggctgcagttcaagactaattcccaaaagagtagtagagatattacctggttctgtaaaagacccaagtttctaactttcaattattctttgaagccaattatctttcaaaagagagaataatgttgaatcctttcataacgtgagggcagtgtttttctgtgtggagttcccttgcgccagatccaccaggatggtgtattaaaagtacagattcctatgctctgcctcagaccaaaaaaaaatactatttctggtggtccagttcagggtctgctcttttaacaagccacctcaggtgattttccatacacactcaagttaagaactaaattagtgggagaaatcatacttgctgctttccctgaagcaggtgggttttttcatcaatatagatacaatctaagcagtaactacagagtttggagaccttcaaaaagaaaagattctaaggctctccaaaagcaaatacacatctgcatctatagcctacaaattggaaattagcaagtttttatttattcaacaaaaagttttgacagtcaaattagtgacccctaagattgtgtgaaatactgtattaaaatagtctccaaagttatggaagttatttgctaaagatcttattacttagccttcttggggttatttaaggtttctgatctgtatgaggaatgtgaaagatagcgtggctataaatgcaaatgtagctataattagaatagcctgtctgttgcctcctttttctgcttttccatttataaataccactaaagtccctgctgcatttcagaggccccagagatctgtttattttgtaatagaaagagaatgaaggggattttctaagtttttgatggatggaagacacatttctagcttcatgtctagttgttataaatgtatctgtatttttcttcttgctaatcaaggccatcatccccaggaggaaaacttctaacttctagtcatctgggcactttggctgctcacattactcctggagcttctccattcagggaggaagctaaaagctcatgcaatgcaaaatccaaaggaatacatttcaatttgttcaccacattttatactcattattctaatggagtgttccaagtaaaaattaaaatcacttttggaaagcccttcagttccttgttatatggcatcatgtttgaacaaagactataatccttaaggaatagtcacataaaaacttgttaattgtgagtcaaagtataatgtgttcatgagggtaggaggtatagtgataaatatattaaattactttatcccataaaagggtaaatggacacattttaaattcttccttcctgaattgcccttggttgggattagcttctgcaaagtttcagcctaaaagagatttttttaaaaatgatgaacaaataaaaagatgttataatatagtgccactactccacagattgttgttttatcctactggaaaatctctcagattccctttcataaagcgttatactacataaacacaatgtttaatttatgttatgatatttaggttttacttggctaaaataaatgaaatagaaaaaaaaaccccatgttttctgtaggagttaaaagaataaccttctctttcaacttcaatgtatgtgttttgattcctaaatgatcacattattcacttattggtttgcatgaaaaattgcatttttatttttattcattttcttccccagattttctgacctatgacgcacaaagcatatctggcaaataaaatttccctttagaagaggaaagaaggaagcatgtgagcttaaaggaaatgattggaaggaaatattgggcaggaggtggtggtggtatttctttcattgcaataggagagttctttaaacagtcgtgaataattgcctaaaattatagcagctgctgattttaaaaaaattataattctgtgcttgattcccatctaataggtcttagactaagcaaaacctagttatgttaggatgtctagcaattcactcatatagcatgtctggagattgaggaaacaattgcttcacacatgtcccccaccattttccacatatacaaagtactgagattaatggaaaaaaacttattaaatccattaaattttacaaaatgcagcttaggcacttattaaatttttcctcaatcactgaatgtaaaaagaccatctattattatggaatggatcttaaaatttttttatattgaaaacatttattgtactccaaatggttggaaaccaaagcccacagtgatcagataataaacacaggatattattttatttatccatagccacttgaggcttttagataaaaactttcatcttctttatttgttagggacatgattataaaataatgagactacttctataaggcattcatgaaaattacttattttattttacataagaaaatttaaaaggatttataatgtttgtatattaccttaaatatacagatttacatgaatttactttctttttcttctcttacaggaaaatatacatgcaagagtaagtactttttaaaataatataaatcaaatataaaaatcacgagaaaatgcagctgactgttcctgtccaaatcagaaattctgatttttctaatcatgagtattgcttttaataatccaggattgcaaaggcatttaccccattactggtgcatattttacttattaaattattatcacatatactttaccaaaccttttagaagaatcccaacatataatttactaagtttgctgatgccagaaagtctttgggaactgctcatcatacatatgtttgggaatcttaatgtgtccaaaaacacttctttctatgaaacatattagtctttaaaaaatctcagattaatatcataatgcatttgaagtttctatagattaatgcataagaaaagattattttatgaaaatattagatttcttctaatttcaagtcttgtatgatttatggagaaaaaaatcatacacattatagcatgaaaatgaaatattaaggtgaaatagttggttactaggacaatatagaaattattttagaaaaacagcgtatacaaacactctgaaagaggtccattattctagaagaaaatgtatccaggctgattaatgctgaaaggatgaaattgacttcaatacaaactccaatttatttaccaggcacatgtttggcttatgatgagcaactctttaaggtcccaagcttctagtgtgtgtttgcttgtgtgtgtgtatgtactttaaattcctaagagtttatatgaagaaataaagagcttacaaaatataaattatattaatgtaagcagcaaatatctgtcattcatattttggtgcagagcaacagtgagaacggaattctggaactgaagtgaaggagtcaggcatcatacagatctgtagaccagggctgtatatctcagtcaagttgagaagctgatttttgagacaccagacaggcaaccagttctctcactttatcagtcttttcttttcttttcctttcttttttcaaaaggaaaaactatccgacagtataaacagatatgagtagatttgtcttatgagtttccaattctaggctcatttgaattcaaagaggtgcatcggcctcctggcttctcttcaaagatagttgatgggggctgggaaatggctctgcctcattatacagcctgtgtccctggcattgtgccaaggactggagctttgcataactgagtggttagagaggaacttcatgtgctacaaattctgcttaggtttccttttctaaagcttgcattaggtctttggaaccaagaaacaagaagagaggagagagagattcagaggagaaaaagggagatattcttcttagtacaatttgcatgcacggacttctacatacagaatacttaaacagttcattgtattgaaacacgcttaaaaatggccctagcacttgctgcaatcctgctgtgtaggagttagccaggttgtgtctgctccctctagactattctatacatcaagaactaaaaaagaagagcaatcccagcatgtggctggatgcacatcaaagccaagtctgccatgaattattttccttcctgttcctttcattcaggtcatgaagcacacatactgctacaggaaagggcaaaaggcaatgtcaagtgctgtgtaattgttgggttctttagtggcaaaggccagcaatgttgcagccaaaagggcatttaagagtacaagatgtgggtttttacatggcattcaataatccctcacttatggcaatcaaaaattatccgttttttaggttttttttacaacctaccttcttaaaaatacaaagtgaaagatatttgtaatttctaaaatgtttactttgaattataacctcacgcaaacatcagacagtattaaagtgacagcaatcatagaacttcccactaaaagcaagaaaaaaatgcctattctaaacacagctatcttcagaaatgcagtgttttgttatctttatgctttcactcttttttttatgtgttccctgtcagattagctattctcaccttggatttcaaggttcctattaatcacaaaatattataaattattttctcttttctttgtattttaaaaattattgaagaaacattgcaaaaaaaggaaaataaaaatgaggacagtaaagacaatcagcagtcacattccaaagctaactattgtagcattgcagtgagtccctcacttcaccatacttttttcttcacacacatacattgactaaaataggaacactatacgtttcttgtatgtcgacttgctacctcattcatcatcaatatgttgtgaatatctttccatgtcagtaaatataaatccacattgttttatacttgcataatattctgtctgatatatatgccataatttagtttgccaaacccttactgacagttgaattttgtctgtcttattgatgtcataagtttatttttatatatgatcttggtacaataatttgattttttggatcaatttctgaaagtgaaattgctagatcaaagggcttttgatacttattgtcagaacatttcaaaaaaagctgagctaatttatattctcactactcttatgtcaattgttcatttatccactacttgccaacactagatacaaataatattgatatctttataacttgtaatgtataggcccaaatagtatcctgttattttaatttgcatttttcctatgtatttaactatttgtatttcatttctaacgaatgatgtttttaaatgattattcacttttactgagatgttcattttttctaatacgtttgtaatgtctctttaattagtgcatattaacctttgtcttatgtattatatataatttttccagtttatcatctgacttttaacacagtttatggctgtttcaggctgtttttaatctataaaattttacggagctaaatttttaaatagacatcatttttttctactgtgcctttcagattttgtgtctgccttagaaattccaacattagtttataaaggatgatcctatgatttcttcaaattcttatatggtttaatttttagatttaatatttgacctatctcgaaattattttagtgtaaagaatgaggccaaaatccatttttattgttttatttatggctagttaattctcataacatctgatattgaataattcactttttcccactgaataggattgtcaaatttaccatgtactctatttctatacatatttgtatctatttcttgattttctattttgtgctactcatttgtccataaatgtatcaataccaaactgcttttatttttgtagctttataatatattttaatattgagtatcattagtctcagctcagtacttttcttttacaattttttgagtattcttgcatattccctttttataaagaactttttattaaaaatgatatatagccctgtttcaatagccaaatcgttctgcaagatttgtcaagaaaaatagtaatcccctcttctcctgccagcccctaaattctcattagaatacattactttcacatctttagctgtctattttggtatttatctttattactctaaaaacatgcttggttgtttcctttttagatactatctttaactttctcctgtagaagacaagaatttatttctctttcctatccctatctcctctacacacaacaaacacacacacaaacgccttttccatttctccattccccctaagttgttacgctgtaattttgttagagcaataatcaatgtctgattattatatctaagtaaacttcttttcagagctaaaccttaaagtgattacttatttttctatgaattaacaattgttgattatcgttttcattgtgccctcctcctccacttcatctactttctctgctgcttcttgttcttcatttacttagttttctttgtattaacaattaatgccaaactcacagccagttaactaagtcatctttcaagacaaccagatgcattatgtatgctatcaatttcatctccccaaaagagccccttccagagtctccagtccagttggactggtgacaccaggtgcagccatcttgtaggaattcccctcccatcatcctggagattctctttgcttctttcctgtgttggttctaactcattttggtggagtacatccttcagtagtttcttctattcctcacagaatgcatgggaagtaaaatgttaagaactttgtatctgaaatacttttcttttactctcacgcttggtttatagtttgatttgctatcgaattctaaattggaaaccattcaccttcagaatttagaggtaattctttatcattttctagctttcagagttgctattagaaatctgaaacattctgattcctaattatgcatttatacctatgtgcttatttctttttctgaaggattatagagtcttctttttgtccttagcactctgaagttcatgaattccaaggtgtgactccatttcttccattgtgctggacacttagtgagttcttttaacctgcaaattcctgtctttttcttgaattatttcgctcactatttactcctcatatttgctttgttttacctttctgtgattcttattagtagatgatgaagttcctagaccagtcatctaattttctcatttttttttctattttctattcttttgtgtgtttgttcttctctttggaaagtttcaagacattatctccaacacttgtaagaattagacactttcttaaacagattttcaatggaccctccttattttggtatccagcccctcattccctatttccatgggtaaccagtgactgtaattgattaacatttgcaaaatgattaaacattgcctcaccatttcactggttctatctggtctgttacatcggttactattcatttatctcccttatgtattctaatttaataattattatgatgtatttattttcactattatcttttatttatgacaaatgctgtttatttgtgtaacaatatacagtttcctttaaaattgacttaggtattttaaaaggagagtaaattgaaaaaagtaacagcataaatgcttgtggctactgtaaaataaatattaaatttaggatgcttgtgatcatgaaataaaggaaattcaaagtaatatagttaatagttacataattattcttttttttatgtattttttccttcccattaagaaatatagatgcgctgcatgttgaatatctaatttttttttgttttccagcataatgtttatattatttaaaaatcattttaattttcattgtacttttttcttgtatttgatatgaaactctgcagcaaaactggatgctgctaaaacaaagccagctgtgtttacttgactttgtaaagacccaaaaataatttgtaatgagattagtgtagctacttttggcactaaatacttgccaaagtatttatgataagacagaggaagatgaaatagaattacaaattaataagtagtttagtttttggcccaatatatatgagcaattgttacacgtttgtttacttactgtggggagtcatgggataattgacttcctggctgagatgggttatatcacacataggactcatctgcctcgcatggttaccagaactgaatcttactgtgggagattagatggggtgaattttgtggcactgaaagcatggagtattattatcttataacactccctctatcttttctacgatattgcttgtctgtgcgatgcagttttctgaatatcattgctcatcacttgggcaactctctcaagtatatctccagacacaaaagtgtctgggagatttctcatttttgagaacgccttttttaggatttgtatttatgacttttttaggagaaacaacaatcatgtataaatactattattgtcatttgaaatataaaagggagagatagaactttaatcccaaagagtgatgaataaaaagtaatgatacaatctagacacaacagagcctaagttggttttttgatagatctggataagaaagaaatgagagcagttcttaacatttaaagttaaagttcttaacattttacttcccattcattctgtgaggaatagaagaaactactgaaggatgtactctatcaaaatgaggaagaaccaacacaggaaagaggcaaagagaatctccaggatgatgggaggggaattcctacaagacggctgcacatctgggtttttgttttttataattaaaaataagagcatatatataacaaaagaccacactaataaactattttattaaagttgaatttatattgatttaaatgtttgattatattttgatagtcttttagtgattttcaaagattaaataagttagcatttgataataaaaattcaaaagaaattctgattatattcatgtagataatatgatttcctctaatcaagttaatacctttcatatccttgacttgtttcttatttaagggaattatttctactttctacttaagtgactaaactgttgtattattgaagaacctctgcttacaatatataagaaaatgtccttcatatttaaaggttttgctactgatacaccatcagttagaaaatatcttttgggttttttgttagtttttttttttcagtataaatactgaaaacagttttcagtatttataatagatttatttttaaaatctacttcactcagtcgtcttggaaaccaataatccatctctccttccctccctctttccgagtctctctttttccctctttctgcctccttccccctctgtcactttctctccttaccttcctctttttcttccttaatagatttggtgcaaataggtatgaagtagaagatacagcctattaaagcaactctttactcccttgcagacctttaatacttattctggttttctttttaaaaaaatgttgcctttgggtttgctttagtctttgtctctcttatgctatcatcattttctctgcatgtgaacaaaattcctcagccatttattcacgtttttggaaaaaacgttcggtataagataaaagtacattacagaaaatctgagaactctatcatttctcagtccacaaatatgcattgagagaatactgtatgccatgcaggaggtagagtggagacagggaaactgatcataaactggcaaatagggaaacaagatgattccagatagtgataagtggagagatgtgatagtgactagtgtatgtttgtgaatgtatgtgcatgtgtatttctccacattgtgtgcatgtacatgtgataatacattcttttgtttctcatttatcaaatgaattgaattagatggtctctaagatgccttcctactttttttttttttttttttttttgcgacaggctctcactctgttgcccaggctggagtgcagcggctcactgcagcctcgacctccccagcttaagcaatctgcccacctcagcctcccaagtatctgagactacaggtgcctgccaccatgcctggctaacttttgtatttttttctagagacggggttttgctatgttgcccaggctggtcttgaactcctgggctcaagtaatctgcctgccttggcctcccaaagtgctgggattacaggcccaaaccactgtgcctggcccccgaccctttctaatgatgcaacttttctaattttgttcaacatttttatagctgttttactattctaataatatggtcagtcatttatccatagcaatactttaaaaaattattgaagtataaaacatccacctattgggatttgaaaacagtgtctgtatttcctatctacagtgtatctttattggtctctgcataaagaggcttttagaaatcactgccttctgtctgaatgatcaatgagagtgggctagacaatggcatgaccaagcttgtagcttcttcccctcctgtgaactgcctaaccagttggaacggctccaacttcgtctcagaagctgctaaaggaaaagtcaggcatgagtctcacttttgtgtagtcatttgaagatttgttgactaagaattccacatggaatgtcactgtgtgatagcaatgattagtgatagggatagtaataataataactaaagaattatcacatttatcagaagtcccttttggggactgtggtagaacctacaaaacattgtaaatgcaacttctcaatttggtggaagagagaggccaagacttccttttaactatacctttgcaagcctctgttaagatttttaaatggttattctcctcaataataatcaccaaaatgccatcaggaaaatgcatttttctttgttgtcatggtaaaatacgttctgaaattgtttcccattatattataaagccaattataaaaaaccttgtaaactgtacatggcatatggatgaaaatcatgctttgagacaatttgatggaaagttatacttgtttcttttaggtttttgtttcatagtagggtctttcagatttgcttctttctgtcgtcttttgctcttgcttttatttagaaattttagatatacaaatgaaaaaaagagaaaatgttttagaagtaatcataaaaacacacaaaaatgaaaatgtgttaataaaacatatgtttgtgaaactgatattatttatctgtattgtagaggcaaaccaaacttattggacatgggctctttgatgatcaaaccaattcaacgtgtgatgaaataccccctattactgtgcgaacttcggaattccacccctccctctcacccagattacagagcactggacgatgcctttgctgctgtgaaggacattaatgttaacatcaatgaacttaaaagaaggaaagatttaggtaggaagagacatgatgaattggttgttttccattattggagtgtttgctttatgtttctgagaatcagaatgtttaagtagttatagcagctgcagtgaactgatcatttgaaatctacaattagaagctggagagaagagtgtggttttgccttgtcagctgggttaaggagaagattaagaggcacaagaaatgaaattaaaaaataaatcaagcagccatatgctcaacttcattggaccactgcaatcctggtgacatattgtgggctgaagaaacccattgcatatagtcctcctgtcactggagatatgtgtggtaagaaagagaaatggccacgttgcaatagcagtgggaagcaaatgcagaaagcacccaggaaaggggaagatctaggtgacagaggccatctagtcttttggattcatctggttctggcacacagagaatggagcttttgtggcaataatttctctactgatgtgagcaagtatacttctttctagaattagcaaattattgttaactatttgtaagctaaaatataaaattagtgtttaatgtaaaatttcaaaacagaagggataattacatggttcctatacatcccagaggtagtaatgcattgagctaggctgtgggtcctccctcagtgtgatttgtgttcacataagttcttagttggtgttgtactgctattattaaatctcagtttgacattaaagccacagcaggactttagagctaaatggtctaatcactttatttatttttgttttattttctgatgtttatttcaaaagtcatatatttgtattagtaaattaaaaagaaaggtgtagaataaaaagtaaatgttatggagtaagaaaactccgtgaacaaaatgaagagatagtatacaaaggatcactgtccagactatataatcactgacattaaatcaataaaaaaacattgtaatacaaaaaggttaaaaataaaaagaagcaattcacagttttaaaattctaatcttcatttatactcagggaaatgtaatcattgaaatcacactaacataccatttccagtccaagagactggagggaaaaagtaatgaatacgctaaatgttgaatctcaatctacaggtgagaatgtacttggaatcactagtttagagaacaacttgacaatacctagcaaagttgaagatgcacagaccggagactcagaaaatgaatttctaagtatttgcccaagagagactcttgcccatgtgctcaaagagaggtgtactggtaactagcattgttcataaatgcaaataaaaaagacacattaatccagatagtggataaactgcatattatacactacaataccacaagaagataaaaattaactaaataaaaaagtaggtgtatcaatgggttaatctcaaaaacacaatccagagggttttttttttaaagtaaatttgcaagtggtagaagaatatgtgcaatatgatactattttataaagttttaaaacattcaaaatgtattttataattccaaacatccacagtaaaagcataaaaatagatacagatattataagccccaatatttaggataacagttccctttagggatcatacatggagatcagggtgcctcaactgttaggtgagttgttttaaaaataagaagactggaaacaaagcaaaatgttaagactggacaaggttttagataatggctgttacattattctttatatttttctgtttgcttaaactatttcaaagttttgaagagtaaaattcttcccttcccaccatgattccagtttgcatagctaacattttattgttttcttcagacgtactctgtcttcttttctcttttcttctgtctttctctctctcttcctctccctctctcccttttccttctttccatacttcttgcaacatatatggtactatagtttgtttttttaaaaacttaatcgtatatcatgaacattctttcaattaatattgccttctttttaatgtttccatagcattttatttatgagtatatcattatttattaaactatttctctaaggataaatatatagatgttcctaataccttgctgttagaaaaaaaatactctaacaaataaaactttgtatacttgattatggaaagcagattctctgcatgaacttcctggtaatagactatgaatattttcctttttgttagtttctgccaaattgttttctacaaaaatgtgttggtttaattctcatcagcagtctgtaagattgtccatctccctacacttttaccaacactgaatgttagagacatttaatgttttcaacattatgaaaggtgaaaatgattgcaaagataaataagtgaagctcagagaggttattcagcttgccccaaatctctcagccagtgaagaggtgctctaggatctgaggtctccttacattgggcacagttgtcttgtcttttcttttctatttttttttttttttttttgagacagagtcttgctctgtcatccatgctggaatgcagtggcatgatctcggctcactgcaacctctgcctcctgggttcaagagattgtcctgcctcagcctcccaagtacctgggactacaggcacgcaccaccatgccaggctaatttttgtatttttagtagagacgaggtttcaccatgttggccaggctgatctcaaactcgtgacctcatgatccgcccacctcggcctccgaaagtgctgggattacaggtgtgagccaccgtgcccggctgagttgtcttttcattagttagatcttgattccccattccagaggcctcagataataaatgtattatctgagacgagagggagaacttttttctagtatcagggatttctttaatattgtagataaatcaaacttaatccttgaggggcttttgtccttgtttctggaggtcagtggggtgggtgcctgactgggacatgggtggacagtggggctggagcatatggcctctgcagcagaggctcaaaaatcatatacatatttatcttgaatataaatactcgtcttgaaaactttgggtgaagtgcacactttctatgctgcatgtgttcagctacgttattacattcttccttttcagttctaaaatacaagaagaatgacgaggatgaatcacttaaagacaaattgtctaaactaaatattcattcaattagcaagaaatcaaaaagagtgacaaatcatctgaagattctgaccagaggagaatcacaggtaatttttcttcttggaccacccaccttttcccagggaacatgaatgcagatatttttgtgaggttttgttttgtgaggactatttctagaatactgagaatcaaggtaattgccctatgctgttctcttgtctccctctctctctctctctctctctctctctttctctctctctctctctctctctggaaaacaggggtgggagtgggaataggattgacactgtcttagctgtggtgcttctactcaagaaacagacaaaagagagacacggacatgggacataaggttgccccaggagtcctgatgctcatcatcaactagcacatattctccctcaaggcaatgcccttcttccatcctgttttacttctgctcttaaaagttgtacttttctttagggttcccttgatattcattttctctttatttcatctttataaacaaagtgtttagaggcataacttagtgcaattattttttctactccttatccccttcctcttccctcactccccagatgcacattatattagtgagtaacagtcctgtgtcagctgtttagcctagcttgagccactgtcatcccaatccctaataaataatagatggattagcaaagactcttaaactttaatgtgcattaagaattacctaaaaagcttgctgaaagacagattctagggttccacttgcctcaagggtacaatctagaagtctgtatttttgcaaacactctaggtattttgaagccaatgattttaaagtaagttatcaacagaacacacttgcaattctttgagaatcacaagatagaaagttcatggtcctgagatggtaatatagtgggcttctaaccaaaattagggaagatagttcttagtatactatctagtccttattttttccttctcatttgcctgtttttatcactcatgtattaatatctctaagatttttagtttgaacaagaggcagctgtatggtggttcatgttggtttcagatggctttggcagctgctgtggtcttttctccttccgttaagtctttgcagctttccaaccacttaggtaaaagcagccccttcttcctctggaaagggttaatatattgactctatatttcaatcttgacactattcatatttgcaggagtcagcacagggaagaaattaagaacaacatctttgaagttatccaaacctgggtttgaaccctacctctgccacttagtaaatgtttgtttgggggcacataacaaattcaatgtaatcatctgtaaattcggattctcctagtacttaacaaatgggatggttgtgaggattaaatgagatgatgcatacatcaagaaaacacctaacatagtgtgtaagcactcaatatactttagctgtcattattatcataaatttaatcattattattttatatcatcaccttgtatggttatttacctttgaatgtgcagacttttcttcctatgtgatgttaagtccttcatacatggtgtattaatcgtattttttactttctgtattttgtaatgttttgacattttaaaatacctttctggctgagcagactgcccttctagggctagccaattcttagggatagcaaatggctggaacacaactttcatatgcaaaccaatcaatcttgagtatatagctctaaccacatccttatctaattcttacacaccaagccaatatctcccctgccctaaatcatttcagggcccagtaccagcaactagagattacccctatatcccaaagcccattggagttatttaaaatagccagtcctaaactctttactctgcccctgcctcaccttttgcaaggaaatcccaacagaggttctggtctagactttctctttactcctatcttctgccactgcaccaaaacctggtgctttgcctctagccctgtgtggcatgtggtgactcctctctctgggacctgtgagtataataaacttcttccttccaagtcatgttcttgtttcttcttgtgactgtaccaaatttaccaacatgtacattcttagaacacaaggcttgaattatttttgtatttactccttaatatccttctaggggctaactgggtccattgcatgtaagaggttcctcttctcaacgtggaactataatgtaagaagttggggacatttatgggatatactcacatatctgagaaaggacaatgaagacatttcaactaaagacaaccatattaaaatcaaattggaaatttatttaagaagagattgtagccataatagagataggcatgtgtaaatgtagggcaaacaattccccccccaagtctttgggattttgcttctgactcaagacaattctattgaggaatagtaggcagcctctaattctgggctggcttttgaataagctgttatattctttaagacatttatcatcaacttcttatatttctcaattgtgaactaaaagtgaattgtagttaaagtagcctgaagggatattaattagatttttccccttaatcttttgagaggatgtcctgtcagcaatgaagcattttactgttaatcagaaaatcagctgcataggctggacgggaaaagagataaatctcaaatcaatcaattttgcacttgtcagcagctcaggtgaaatattggtagagttagggtataaagctattaccgaagaggaagattctattcaattcatcatacatatattgaactctcttgtacccagcaccatgttagagattgggactacaaagatgaacaggtataggttctgaattcagactgcttggggttgaatcctgatcctactataccgtgggtaagtttctttaactccccatattaactagggtaaagacaacatatctgtcacaaagagattccaaaggcatagtaggctaagtcaggtagttgtttatttctctctctctttttttaaattttttagagacagagtcttgctgtgttgcccaagctgggctagagtgtagtgccattatcatagctcgctgcagcctcaaactcctgggctctagcaatcctttcacctcagcctctcaagtagcgcagactacaagcgtgtgccactgctcctggccgctctctctgttttaagagtcctgagatgtgaatccagatgagctctgcttcataagatccttcaggaacccagttcccttagtgatttttctaaacatattgttttcatttgcctggttgaagctgtattcctgccatgtcttctttcaagtcccaaagaaatgttataaggccaagactcagacatgaaaacaaggcttcatccacatcctatttgcacaaacctggttaccagggcagagccagctgcaagggagtttgggaaatgtagtctctagcagggcagccaagtgtccaacttgaaatagaggtgtggattctatcaataaagggacagtaggaggaatgttaacaatctctgccatacctcctgaagcttctgtttctttatctctaaaatgggagtaatcataattccattatatatgtgtaaggattacaatgagaaaatggaagaaaggttttggcagtgtctggaacacagtcagtgtttaacaaatgttcgctattattttcattaaaacaacaatagttaatctgaaacaaccgaaatccatcagtggagagaatcacttaaatcattaaccagggttatgagagcacataggagagagcaattaattttctacagtgggaagaataggagaaaagggaggatttatagaatgggtgacatttgaactagtccttaaaaataaacaggattttgcaaggcaggaaacgaacagcagtatattccagcaaaagaaaacagcatggaaaagtcttgcttataggaaagtagaattgggcaatatttctcacagtgtgattcttgaaccttctactttggaatcatctgggtcctagccagatgatatacaaaataaaatatctggtgacgcctccttggaaactgcatttaaaaaaaaatctgccccagcatattgttatacacactagactgagttggagcatagcaaccctaaggcacagaatgttggattttgtggggattccaaagaactctgctgcctatttaatcaaaagctttgtagataaacaatattaagaagtttaaaaataaaataaaatgtcaccatttttgatacattgagttctaatatcaaccctcttaaatttaaaaacagatgaaccaagcactgctatggttatcacccagtgccaagcttaataatacataccctattccatgaagcatttgcacgttcacacagattttgccaggatgaggctggttccgatcttgttttgtagccattttgatagccaagaaatactgcttgctattaatagcagcaataaatgtgtgctcctagaaattgtcacagcataaaaagcatatctttctgaattctaatggatgtacatgtaagatgacaaaaaaaactgaatacatgtgacactatcttaagtctgctgagttatcttaacagaaggactatttttgctaagattatatattatccttcaagtttgagttgataaagaattttcacatttcttttttttttttttttgagacagagtctcgctctgttgcccaggttgtagtgcaatggcatgatcttggctcactgcaccctccgtcttccgggttcaagcgactctcctgcctcagcctcctgagtatctgggactacaggtgcacaccaccaggcctggctactttatgtatgtttagtagatacggggtttcaccatattggccaggctggactcgaactcctgacctcgtgatccgcccgccttggcctcccaaagtgctgggattacaggccacatttatttaaccatgaatctaagaatattttctaaataagcactgttaaataaattggaatgaatcatacgaacaaaacaagaagttctagtcaatagatcaaatgtggctattttataaacccaaaaatgtaatatggtttgcgtacatacataatatatgccattaaaaactacagagaaagttttacaataccacatctactgtgacatgggtgaagttatgtggaaattaacaacagcaatttgagttataggacttggctttactacactaactgagcatcagttgtgttatgtaccaacagagaaagtatgtgttaagacagacagcatgtcatcaaatgttttcatatcatcaaagaattttcttttgtaatgtgctggaccaatatggtctgtgctattttaaaaaatatctgtttcatttgagttatgaaaataatttcatatatattttaggttaaagacaatacctttaacagagaagaaaagctgtttagagctttagaaaagactgtgaggctttgtgtgaagaacatttcactctgtcttcaacacatacaggtaggtgagacacaactgttttcagtgttctacaggaacatctgatacaaaccattgatttccatggttgttttgaagagtaaatgtgactgttccttcctttatgttatgacaccggatcaaaattggaaggctgcaaactgctggtaaaggaagccaatatatagaggtgttttgctgtttgacctcttacctgctccactctctccccagtccaaatagtcatattgtgggacttttttgctcagatgattgcttcatggactatcagcatgctttctttgcaacagagatgagttcattaacacaaaattgcaagagacagaaaatttgtttgtttgtactaacacatctctttctagtacctaaaataagtataaaaatcaatataaaggaaaataaattgaactacaaaatcctattaactacaatatggaaatgctcccatgagattatgttagaaaacagaaatactcccagaaatttccaatcccataagaagttgtcctgaccctttgagaatcactgatttcaaccaactaattggagtacagtatgattatgctcggtagaaaaaccagtcagaggttttttctaatcgatctcataaagaggaaacagtgtccttcatgccaccttgacaatggctatgaccatgacacatagaaagttagtagtgttacatgtaaatcagttactaaattgtccccttctatattccagaagtttttctcctggatatcttagatatccgtttctggaagcagatgtttgcactcttagataaaatatcagaatgatttggagacaagtttccatgtacatgtaccattctgttcttatttattatctgatacaaagcctactttacaatccggtttgctattttcttcctaaaatgctgccttctgtgaaaagaaaaccaaaaacagttataacagccagagagtagtgggaaccccatcctttatgtatctttcaaggagtaaatgtctcttgggaacatctacaggaaagtcttctatttccactaatagattcaacaaaaaatgtaagcattttctcttaaagagagcattaaattttctaaggaaaactgatgaatttaaatcaaagaggagtgatttttaaaataagaaatttgtaagaattgcaagctaaagaatagctaatgagggaatttaagatggactgtttaatcaaagagggtcgtatacagagtactatgagaaagagacataaggaaaatgtaaggaaatatattcttacaagcaacctgattgtacagagcatttataaaatgtttgttgttcctttttaaataacctctcagtgataattaagggttatgctgatgaagtccacatttgggatatgttaattatactgacctcaaaacttgccttttttgtaactttgttcttgggtttcaggatgccatgcccctggctctgcagagtgtgatggaccttcaggagatttcatacaacaaagacgatgagatggactattctgagaccctaagtaatgccttaaattcgtgtcatgactttgtaagttatttatattcacagataaatgcaaattaaatagtgaggttgaaaggaaagctgctttttgtttgtttttctggagtcagaaataaaacatgcactaaagcaaatattaatgtcaaaattagtagatttaaatgggatttttttaaatcatttaatatttttaaagtggattagtgaggattttactatgatggaaatttaagaggaccacagattgtgtttctaggggtagccagtgtcagtgcagcttttaaaattaatatttagtttaagtctgcatgtgaaatattaagaaattattaagttagaaagctttgcttttctttttcttttttcttttttctgggacaggatctggctctgttgcccaggctggagtgcagtggaacaatctcagctcactgaaacctctgcctcttgggcttaagcaatcctcgctcctcagcctctcgagtagctggaactaaaggggcacaccaccacacctagaagattttttgcattttttgtagaggcggggtttcaccatgttgcccaggctggtctcaaactcctggggtcaagtgagctatgcttttcttaaacaagtctctggaaatgccttgagtccttacagaaagagcaaaggtactcactgaggatatgacacttattaacatgctatatactggaaggcaaagacttcctattgagaaagacttttatttaagagtcatatgttatttattttgttccacggtaaaacatttattttgtaagagttctataaaatatatcttgggaatcataaaaacatgcttgagccaataacacattttagtagtaagttactctgggtaatattaattttaatttagtgccttgtgtttctataggtattattatttcatagtagtatttcaagaattatagagaagatagactgatcatcttgaaagtggcattttcgtgttggcattataggcattttgggtaagacaaatcttcatggagtggccttttggtggaggatgttcagcatttttggcccaccaggctcaaaatctcagtaacatcccctcacatcaagacgttgtgacaaccagtgaagagcctcacataattccaaaccctaggaagtcatacagcccccgatctagtagaaaaaccaggcaggagcattttgcttttctggcactggggaatggaaagtcaggcttacatctgagctaatatgatagagaaacaggtcaacgacagatgaatggatggatggataggtacaggcagatagatgatggtgatgatgagatagatagatgatagatagatagatagatagatgatagatagatagatagatagatagtttttacagtatatgtttaatggaaaaggtgtggctagttctttatgtattttctgcatttaattatagagagcacacattctagaagtctttaaaggtttgctctttagcttagttccaatacattaagttaatatatatttattgagtaccacctgaaagtgtgatatgtagcttctccctcagcaagcatgctccagactttgatggaaagaagccagaagtgtcctgcataccttgcataaaaccacaagatgattaattaggctaagttaaaaaaattgtgagaaggctcaatataaaagtaacttttatggataacatatatagaactctttttaaaaatcaaatattaagaactcaaaatctgtctaaaggcagagcagttattcttatctaaccatgagtaatacatatctacacttttttaggacaaaataataaagtctaattcttatttgttctaacaacaattcctaagtaaaggtgaatcattttgtgtctgtgagtcactggatatatatatatatataatactgtaattagattacctgtagaatccagtcaagtcacaaacatagtaatttatcccagatacagtaaatagattctttgtttatcaagggactcattaaacagtctctaggtgtatattgactatctcataagctagacatcaaatttaatttgtgttggctattgctggtgccaataagagattggtttccctctcccctagatttcccatgagttcagaccaacttaccaggggccatttaagttaattaatacaagctgctgctcagatactgattccctaggatagctttcgggttacaaaagagaaacctacttccaaattatcataaaatatcatataagcatatatgataaagggtaaagtagggcagtcagcaaatgtaaaacagaagagaaatagaagaaattaaatctaggatgatcaggttatgtcatgaagttgggcagttctatgaagttcattttcaatgactcaggccaaaaagtgtaaacaatttaagacacagaaacagcatcagcttaatcctttaatgtatttaaaacagaatgtgtaggccaaggtgagaggattgcttgagcctaagtgctcaagaccatcttgggcaatagagtgagaccgtatctctaccaaaaattttaaaaattagccaagcgtggtgatacattcctgtagtcctagctattcgggaggctgaggtgggaggatggcttgagcagaggctgcagtgagctgagaaagtgccactgcactccagcctgggcgacagagtgagaccctgtctcaaaattaattaattaattaaaaataaaacaagttacaactctgtggtcatttctgtttcaagattaaaatacctttattaaggggttactatctgtataggggatataattccactatcaaacataagcctccagggtagccagggatttggggctgatatgggaagaatagggtacagtctcctatgggatgaactatattccttttgctgccagcagaaggtgggagcgatatggtgaatcttttacacagtcttggtagtcaaaggctagagattcccccctaccctcaagtgctggctctgggatgagaaaggaggggaatgagaaagtgttgaaggagatgacaatgacaaaaccaaagactgtagagaaaaaagtggagttatattttgggtgagcaggctttaacttttgtattcctcttcctgctcactttttaggttcaatgttacaacctagagctcctgttttaagtctttgaataggtttagccagacacaaaatgatcagatcctcttttaatctgggtaggtgctttcctgttttcttttgtgcttctcgtgggggaaaaggtaaacctatggatagcagaactggacaaggtatgggctgatcctctctctgaaatgggctcattttttcttttggcaggcatctcacttacagagactcatcctgacccccttgtcagccctgctgtccttattcccagggcctcacaagctcatccagaaacgctatgacaaactgctggattgcaacagctacctgcagcgatcaacgggagaggagtcagacttggccaaaaaggagtatgaggccctcaacgcccagcttgtggaggagctccaggcattcaaccaggctgctcggaagattctgttgaactgtctatgcagcttcattaccctccttagggacctgatgctcgtggcacagcaggcttactccacacttgtgccggtaagcacagcaccaacacctagctagctaccttggcctactggatctgctagaaaccacacccatacgaaagccctgttcagagtgtgcacatgtatgccgtgtggtgtgtgtgtatttattttaactaaatccagtcagatagtctcctgttccttatctgtcttatccatgggaaactcaaagagggtttcctagttcaggtttactgtgacttacacatttgtaattcttttttggagatgccttttcaaataccaaacacctttcagccttgctccacctgcctgatgcaacattgaagcttatcaacaatttatattttgtatttttttctgatcaatagttcttagatgttaactgtgactatttaagatgtggctctaaaaagaaggccatctcagcataatgaaagatgcaggataacattcaaaccatgctttgttttgatttcatttttccccaagaaagagaagcctggttttgtgtgtgtgtgtgtgtgtgtgtgtgtgtgtgtgtgtgtagcttcgcctcccattaggatataattttataattattttcctgatgaggaagaaagatatttacaacttatatcaacttttgaaaaattagcttggtttcttggccctacgtttcaactacactagttctcatctgaatgagatggacagctattcaatgggtaacacctggagcagaaataattgtccctactttattttctattgtgcattaattaacttttaacttatactttgaattaaattaaattgaataaacgagggctatgtttacagggttcaaaagccaaaactgtgtaaatgtataatcagtctcacactcatacctgttcctctagcatcccattcgccactctcatccccatttttgttagtttatttttatgcatttagtgctttctcatgccagtaacaataaatgcaagtatatatttttatttcttaaaagtaaaaaacagcatattatatataccattctgcacttgctctttaacaatatattctgagaatgcatctataatagtacataaagagcttcctcattcttttttttttttttggtggggggggatggagtttcacttttgttgcccaggttggagtgcaaaggcccaatctcggctcactgcaacctccaccttccgggttcaagcgattttcctgcctcagcctcctaagtagctgggattacaggcatgtgccatcaagcccagctaatttttgtgtttttagtagagacggggtttctccattttggtcaggctggtctcgaacttctgacctcaggtgatccactcgcctcggccttccaaagtgctgggattataggcatgagccactgcgcccagcctgagcttcctaattctttttacagctttatagtaacttactgcatggctgtataataatgtataaccattccctttttttaaaataactttattgtgatataatttgtataccatacattccacctatttaaagtatacaatttgattatttttagtatattcacaagagttgtgcagccattgccacaaccaattttagaacattgtcgtggccccctaaaggaaccctgtacccatccacattttttcctaacctccccagctctaggcaactatcaatttactttctgcctgtacagattttcctattctgggcattttgtataaatgaaatcatacagtacatggttatttgtgactggcttcttctatttagcataacatttcagggtttcttcatgcctagcatgtttcattatttcattcattttatcgccaaataacattccattgtatgaatataccacactttacttattcattcgtcagttgacgggcatttgggttatttccattttttggctgttattagtaatgcttctgtaaacattcaagtttttagtggatatatgttcccatttctgttgattatatacctaggagtggaatttctggatcatatgttaactctatgtttaaccttttgaaaaacaaccagactgttttccaaagtggctgcactattttatcttctcagcagtatcgactgagagtttcaatttctccacacctctttattattattattattattattattattattattattattattgttatagctatcctaatgggtgtgcagtggtatctcattgtggtttttatttgtatttccctgatcagcactgttttaaaactcattaaattgaagtaataacttctatacattaaactgcaccagtctgaactgcacatctcaatcaatatttgcatatacacatctgtgtaactaccacccagatcaagatataatccctttccagttccccataaagatcactcatgaccattcccaggcacctaaaggtaaccatttttctaacctgtattaccatacattgtttgacctgttttgtacttcatataaatggaatcatacaatatgtattcttttgtgtattaacctgtccctattgatgagtatttgatctatttccaacgtttttttattacaaataatgccggggtcatgatacgtggacagatgtatctgtaggacagatttatagaaatgatagaagtgggatctctgtgtcaaagggtaaagacgtatgtaattttgctggatattgccagattccctgcttaactatgtaccattttggattcccacttgtaacatgtaagaaagctggtttctctggatttttgccaatctaataggtttcaagtgtaattttaatttgcatttctttaagtattagtgagattgagagtcttcacatatgagggctatttatcttcctgtgagttagttgttcatgtgttttactcctttttctttgggttcttggtatttttctccttaatttctagcagcaatgtatatgctagggagatgagccttttgttgagataaaaattgagactactttttccaagttaacctttgtctttgacttcacttgtgattttttttcatgctaatgtttgtgtttttaaaaaatgcagtcagatttattaatttcattttatgacttctagattttgaatcttataaaggacttccatattttaaggctccaaataaattcagcagtgtttcttctagtatatttagggtttcatatttttttatttaaataatcaatccatgtagattttatcctggttcatgttgtaaaatatggatttaattttatctttttccaaatgactttccagttgctccaacactatttatttaaaaataatctcttgttactgctttctcaatgaaacacatttaatttgcaaattatttcgataatttcattctgaggtcatggtagaaggtgggttcataagttcagaacaaagttgagctttggcaggaatttactagtcagaaaagacatgttattttaggtatctttgatccccactttgaatcatgtgatttttaaaggcattttcagtttctattttaaattatctgagtatctttcacattgcagtccatagccaaacaagagcatagagatgctttgtttttgagaaatttctagtgtcttaaagtaaaaggcattttggagaagttatcctcattaaaatgattttattctttattttatatgttctgtatatttaaactttttattttgtgatacttagagattcatatgcagtggtaagaagtattacggagatcctgtacaaccctcacacagcttacccaatggtaacacatcttgcataactacatgtatttctgaaaggcagaattgaatagtgattagagaacactagagtaccttgttttaatacctgctcactgctatactacattgtgtaaattaatgtatccttctgtttaaattttctcatatgaattaaaatgagaataataatgtaaataatttttaaatttttaattgtataaaaaaccacaatttaccattataagaatttttaagtgtacatttcagtagtgttaagtatacttatattgttgtgtaatagctctccaaaacattttcatcttgcaaaactgaaactatactcattaaacaagtccccatactcccctcccccaagtccctgcaaccatcattctattttctgtttctacaaatttgactactttaaatacctcatgtaaatggaatcatacagtgtttgtctctgtgactgccttattttgcttaatataatgtcctcaagattcattcgtgttgtagcatgtgataggatttctttcatttttaactgtgaatatttcattatatataaaaaacacattttgggctggatgtggtggctcacgcctgtaatcccagcactttgggaggctgaggcaggcggatcacttgaggccgagagttcaagaccagcctagccaacatggcgaaaccttgtctctactaaaaatacaaaaacttgccaggtgtggtggcacatgcctgtaatcccagctactcgggaggctgaggctggaggatcacctgaatctgggaggcggaggttgcagtgagctgagattgcactattgcactccagcctgggtaacaagagtgaaactccgtctcaaaaaaaaaaaaaacaaacaaaacaaaacaaaaaaaaaccctaaagcacattttgtttatttactcatatgtcaatgatcatttgggttgtgtctatctcttggctattgtgaataatgctgcaatgaccataggtgtgcaaatatctcttcaagatcctgctctcaattattttggatatatacccacaagtgggattgctgaatcatatggtaactctatctttttgaagaattcaaagctctatttttaattttcatttttattagagttatacatacacataaagattcaagtagttattcaggtttgatgacgaaaaacatttgtccttcgctccctttattccatttctcccgcctcagtggtaactactttccaactcttttagatgattctcttggtatttaccttcatatttaaaaataagactcttgtgttgtcatttcattattaatacactttaggtataatacattccactacgaaaaatgaggatttagctctctcttctctctatacccctacatttgctatagtcagacacactctttctatacccccttcaatacagttatagcatagatttggttgagttcacattaagcgtgtaaagtatgtgatttgtgtattagtcatgattccagtaggaaaaacataatgcattcaagttaggcatttggagaaaactttaataactatttacaaaaatgtgagtatggcacaggaaaacctttagaaatagtgccttgccctgggcaggcataggggtttggggtacaacaacatctaggttcaaagaaatatggggagggagcagtcatagcaatgtgtagagagagaggtgtgtggagagggtgacttgataggagctgtgtatttctgtcaatactactgaaagcaaaattaggaaataaatatccttatctcattttcttcccccattctaatttcctacaggtgctccttaatgatggattgattgaatccatttggaagccagagagcaagaaagctgttttgttgttgctgttgttgttgttgagacaggatctcactctgtcacccaggctggagtgtcatggtgtgatcacagagctcactgcagcctcaacttcccaggtccaagcagtcctcctgcctcagcctccagagtagctgggattacaggcacacaccacctcactgggctaattttatttattaattattattattattattttgtaatttttagtagcaggccaggtgcggtcacttatgcctgtgatcccagcactttgggaggccgaggcgggcggatcatgagatcaggagatggacaccatcctggccaacatggtgaaaccccgtctctactaaaaatacaaaaaataattagctgggcgtggtgatgcgtggctataatcccagctactcgggaggctgaggcaggagaatcacttgaaccagggagtcggaggttgcagtgagccaaaatcgtgcctctgcactccagcctgaaaaaaaaaattttttttttagtagtgactagttgcccaggctggtcttgaactccagggctcgagtgatcttctggcctcagcttcctgattagctgaactacaggcatgtactaccatgcctggctaagatttaaaaatttttaagagacaaggtcttgctacattgcccaggctggtctcaaattcttgggcacaagcagtcttcttacctcagcctccctattggctgtgattacaggcatgagccactatgccagacttacccagtttttgaggggtagggatgtaaactccatttctttgtaggaagcaatgttgaagaatttgtttgaaaaccagcacaggctcttaatcagtgctccttcttttagctgctttcccttgccaccatcctaccccaccacaagggaggtacctactgccatgagctcctgagctttttttccaagacttcattgctattttttctcttctgttctttcatttggcttgaaacttaaaaaaaaattcctatcatgtttgtggggtttctagagacaataaattagaccatatttatctagaagttctaaagttgccctaacttttcacaatggagctaccatatacctcctcaactgttcatcacaactcaatacatttaacacctgatatgattatctaggtgtctggaaacaatgccatattatttctacctatagatgccactgttggtttcaagcatttctgagattcagaatcaagtactagaagagatccaaaatttgaattgtgtgaaagaaaacagtgccacctttattgagaggaaactcagttttgaaaagaagaaacctgtgcagattctggtgagtttggcagcattcatgacaatgataactttcacctctttgccttatccaagttgtagtatcatattattttccagatcacttatctcattctaatatcctataatttacatatgtgtagaatttcttgtacatttctatcctatataccataagctccataagatcatggattttttttctactttgtacatggcgtatccccaaagtgcctaaaatgactaaaatggtgcttgtcacaaggtaggaggcactcaataaatatttgttgaataagattttataaagataaatcatatagtccagacatttccttttctacataaggcataccaggccccagagataagtgggtttctcaaagtctcttagggcccgagctgagggggggagtataagcgtcttgattcttgtctaatttgctgatgatatttcccagataaagacatgtacatgtacaatttacttagctgaatacttaatatgcaacgggttgtctgcagaatggcaaagagtttaaaatggttgtgcaacatccaagagggattagaacctctgccttcttattcttgttttttcttctctacaacactgccctcctgtgcttactagaaacatttttccctgaataactcagctgggtactttacgataatagcctgctctatgcctgcaccttgaaataatcctctaaaaatatatgactcctacgttttaaaaatctccagggaaaaaatatttaccaactccatgaggattttattatgtatctgtctaaaccaaaacttctccttatttctcccagccagaaatgccacatcaaactgacattcatcgctccaaacttctatccacatatagtgcagaggaactctatcaagctaagcgcaagtgcaatgctacacaagaatatgacatcaatcttctggaaggagacttggtggctgtgatagaacagaaagatccactggggagtacaagcaggtggcttgtggacacaggaagtaagtttttccccagaactaccactcttctttaaactgagatttttctgagggcacatgtttgggaagagtatacccatgaacttggttcttctttctttttatttcctatccagatgtgaaaggatatgtttattcctccttcctaaaaccctacaatccagcaaaaatgcagaaagtggatgctgagaacaggttctgtgacgatgattttgagaacatcagcctcttcgtgtcttcacggccagctagtgacagtgtcacaggcacctcagaaagcagcattggtgatagcagctcatctcttagtggcacatgtggaaagtttgaaacaaatggtactgatgttgacagttttcaagaagtagacgaacaggtaaaaatttgatgtaaaaatatgtggttgttcaaatcatgaaagagtatctctctactgtactctataatactgtaacacttggtggaaaagtgccagctttgacatcaaggagacctggctctattagcacagtggatctttttgtaaggagtttaattccctgagcctgtttccttaaatgaagcaaagaattagagataaagtgtgtatgtaaagtagccagcacaaagtagacacacaataaatgggagctattactattactaccctgctgttacatacttacagcaaagtatctttttataccccctccatcaaagaaaagtagttcaatactgaacagattgctgccatcaatagcacatgggaaattgcccatgattcctctaagagcataatcttcattgagctatctagtaattggccagttttaatctcatgtataataccacacactatatatggaaactttttctttttttcttttttttttgagatggagtctcactctgtcgcccaggctggagtgcagtggcgcaatctcggctcactgcaacctccgcctcccaggttcaagcaattctcctgtctcagcctcccaagtagctgggactacaggtacacgtcaccacgcctggctaatttttgtatttttagtagagtttagtagggtttcaccatattggtcagactggtctatactgaaacttgtaagagctatatttccctcactgcactaatgcaaaagctactggtacaatctttttgcaaaatggtaagttaattatagtgcaggacttgtttttgctatatcagaaaggttcagtatacttaatggttcattccccagtggtgaccatctaattcctttatttatttaccttgctttttctttagtgttctattaataatttatttaaatttatttttatagaggttatgtatatgtatatgtgtagatagatagatagatagatagatagatagatagatagatagatgatagatagatagatagagaagttaaaatagtagaaaagcatacgtaacttaaaagtaagctgggcttggtggctcatgcctgtaatcccagcattttgtgaggctgaggtgggaggattgcttgggctgagtttgaggacagcctgggtaacatagcaagacctcatctctactaaaaatcaaaaaaattagccaagagtggttgcccacatctgtagtcccagctactggagaggctggggtgggagaattgcacaagccggggcggttgaggctgcagtgagccgtgatcatgccactgcactccagcctgggcaacagagggagatcctgtctttagaaataataataataataataaaagtaatggtttttagtcccttctccccttgtcctgtgcttcagagacaatgcttgggtatatcctttgtatattctgtgcatatacaaacacatttataccagtgggaaacatagcatgtatggtatatagggtttttttccatgtaacaatatatcttagacacaattaaacctaaatagctatcttattccttaaaaagctctacacagtatttaattttatgtatataatttatgtaactatcagcctaataatagatacatagaacgttttgggcttttaaaaaatttcaaacaatatttcaaggaaggggcttgtccatctatttttgtgcatttgtatgagtatataagtgtaaaacaaattcctaaaatattagagggccaaaggtatgtacatttaacgtctttatagacattgccatactgaccttcaaaagtatggttctattcagtttctttcattaacagttattgattgctgtccaattcatgacttcttttttttttggtttggtgttttttttcaaaagcagcttatcaatatcttatattcatgtcatataattaatccatttttaagtgtacaatcatgacttttagtatatattacaaagttgtacaagtttagtatatttacaaagttgtgcaaccatcactttaatccaattttaaaacatttctttcactccaaaaaaccctttgcacccatttgtagtccctcctctttcccacccctaaccccagggaaccactaacctactttctgtctccatacatttgccttttctgtatcttttgtataaacaaaattgtacaatatgtggtgttttacagctgctttttttcacttagcaaaatttattgagagtctttcatgttgtagtatgtatatgtactttgttgctttttatcgcctactaatattccattctgtgggtatattttgttaatccactcaccagttgatggtcatttgggtaacttctagtttggggctattgtgaattatgctgctatgaatattcgtgtgcaagtctttgttgtggattttatttctcttgagtagatacccagaagtgtaatttcttattggttttataagtgtatgtttaaatttttaagaaactgccaaactgtaatccaaagtgggcgcaccattttagattcctaccagcaaagtgtgaggtttatgggttgcagtttcttcacatccttgtcaacactagttattatttgtctttttaattatagccatcttgtgggtatgaggtggtatctctctggggttttaatttgcatttccctaatgattaatgctattgaacattttttcatgggctcatttgccattcttttatttcctttggtgaatgtctattcaaatatttgcctatttaaaaaaaactgggtcattttccttcttattttcccattgtaagagttctttataaacctgagtgcaagtttttttttaatcagatatataatttgcaaatattttcccctggttataactgactcttaacttgtctggacattactatttgttcttattacccttctgtcttgatgtttcaaaacactatttctctattacttgttcactctgttgtttattcagtttctaaaaaacatattataatgctaactaatgaatttttatcagtgaaatctatgtacctgattaaatgtcctgtcagactttgccttgtcccaataacctagatggacagaaatctgagggccaaatttatcagcacactctaaagctggcttgatgttgagttcttgttcttacttggctctacagggactttggactgagcacctcacacagactttctgcctggtgtttgtagtatgagactgcatttagttcctactagctggtacttcaaagcaattttctccaagcaatcctatcaatatatataatgtgaattacatccattagagatttccattaccaagagaggaaaaaaatgagatagtatttcaaaacaaaaaatatattaatggcatatcttcataaattgttatttgctttctttttcctctgcatttggcaccaattcaaagtaggcatagcatcaggaatataaatataagcacatataagcattattactaataaaactggattgaagatgcatcttggatcggtagcacatgggatccctgatactttccctcagagtagaaatcatctaactcaaactgaaggtgaaccctgtgcagggaaaaagtctgtcccaataaacttactgcaagatgaggaagaggatgcacctgttggaaacttcactacaagggagaagagaaggccgcatggaaatatctcccttaatgtcttaactctagccaatagatgcacatgggccagtggtttccagactccccctgtaatgcataatgcataatattgaaaacagagagaaaggagtatattatgtgcctaatccttgccccagggccgatgtttctattctgttggctttgagaaattgtggggagaagaaagtgattaacctctgtatttgtgatgtgatagtataagtcaatacattatagaggtccctgtaatgtgatcaaaagtggaagaaaattatatcttctttaccaacagtgagaatacagtacatattgtaatatttcacatttgcggtatcctacaaagcaattttctgtgtggctatttagactttcgttcttgattttattttattatcaggaacatcagctgaaacttgtactggcttaattggatgccactttttgttatcatttatttccctctcccttcctactgtggtagcactttttttatttcttccagaattgctatagcatgtttccaaggggtgttgtaggatgtagtctggatttattgatgggtctagtgggccctgacaaaaaggacaggtggcctctacctcatactcagggggtatctttgggtctctaaagatcattcacatataggcaatttcaaacttagattctagtggctctgtgatttttatactagagctgaatttttaacctggacgcgaagacctgaagtggtctatgaatgagttttgggaggatttaatgagtctcctcaaatacattggaaatattgtgcttatttgcatatgtacacatctatggtaaaagaagtctacctttttaaacagacttttaaaagaaaattttatctaaaatgttagaaatcactgctgtagagatttaacttgcttatccattctctacctcaagtaagaagagagactgctacaaaaaagttcccccaaattatattctggagcctttgttgaataatggggatgagctagtggatattcacaacctggcagtactgatttataccaaggtccttaatttttaagttcttcattttgttttttgctatatcgaagaatataacaaaagcattcacgtaaatatgccttcccattctaatgtattctctccttttgtccatcaaatagtaatggcatgctctgcattagtgttccatgctgcataacaaattaccacaaatttggtggcttaaaacaatacaaacatatttctcaggggctgttgtcaggagtccaagcacggtttagctggatgccctgcttaagatctcatgtagctgcaatctagctgtttgctggttgtattgcttctgaaactgagggttctcttcccagctcatggtcattggcagaattaaatttcttgttctggtcggactaaggactcctttttcttgttggcaattagccagagaccactttcaacaacctgaggctgctctcaaatccttgccatgtggctgtctctataggcagtttacaacatggctgtttgcttcttcaaagtcagtaggtgagcatctctctggcttcaaatctctcccttcagaggaggcctgaatgcacttcaaaagtctcatatgagtaggtcaggcccatccaggataatccctcttttgactaactccgagtcaatttcctagggactttaataagcacctctgcagaatctctttacctttgctatagagtgtagcctaatcacaggagtaatagcacatctattaagaagttccagtcacagtcaaggggaggagattatatagaacatgtacaatagggggtgggattcttggggtccatcctagaattctgccttccagagtgtctaagatgccttgtttggcaagcagaatcttgtccttggcacttctcaaaaaggactaggtttaataacggctaaaacccagttttggggggcagttcagtgtctgagaatcagtgttgttttctttttccacataagtaatattgaaaatataatttttgacttctaaaaaaagtagtcgttttgctaccaatcccacgttcatagtctggcccttcatctttacattttccagctacctatgatgatgatgctatatacctactgtgtcattgtttagaaagtgcttaaaaaagtcagcttattaacatgaagagattttcaaaaatagtatgaggtaaaaaacagcttgcaaagttatgtatactataagtccatttttattaccacttcaggtaggtaggtagaaaacaaaaatggaaggaaggaaagaaggaagaaaggaagagaggaagatgggaggaaggaaaagaagatactaatagcagttgggtgggttttgttttgttttgttttgttttgcttaactttacttaaaatttttttcttcatcgaaattgctcgtgtaattaaaacatataattgttaagtgaagaacatgaaagcttgctcctgaagggtaagagagaataatgagcatttttcatgcaatacaactaccttggtttccagagatacatataatgtaccataaatgctgattctgtaccttttagttttagaacagaagattaacatatattatgacttttgttgctgttaattggagaattgggataaaaataaaatgatattcagtgaagtcaggtaatgtggctcacggaggaaggaaaaatcaaatgcacaaatatagaataagggaatgccaaactgggaatgttaccacagggaaagatctagtggttataagcagtgggtaataaattaggtatgagtcaataatacagtgttataaaaaaagtaagtgtggtagaaaactgagttgtattcacagaatactgcacctaaaatgagtcagagctttatagagtagaaagaagcaatcaataaaatacattttaaaaagtgccaaggaaaaacagaagaagattaggtgattatggctcaaattaacaacattgtaattaatgtgcctggaccaaaacatattagcatttaagattagaaagttacagactgaaacaattaaaatgttgaagataatgagaaatctttcagttcttaaatgcatgacaggttaaaaatttataacttgtagtctaacattaaggagactaaaaatactaaaaaggagacttaaaaaagagactgaaaatagactgctgtctctttaaaagcagcttacttccattttgagtatataatatatgcccccatttaacataaattatataaaaactaaaaagtgctcatcctaaacaaattttgggtcatgattatctaaagcattgaaagtatataattttgtactttaaatttacaatttcatgagaatatattttaatatttagaatataaactataatttcataccaaacagatctagatggaagagtttatatttcgcttgagagaattgtgctaaagtaaaaaactaccactatttagaaatgttctattagtaggcaatctaacctgctaaaaaaatctatagttgcataggtaaagcattacctattatttataaaaattataaaagatgattaccaaccactaatgcaggctcttacagatgtttcagatgtattatagtacgttacattcccgaatacttttgcaaaccaaatcttccattctgttcctgtggatttattcaatgttttcactttctacacagcaaaacaacaccatctacaatatactagaaactccagtccctctccgcaagaatacactctgtacatacttgctagaacaagagtttggtctctaaagcattatgagaaatggaccaagcacaggatttgaagttagaagatattggtcatagcagcaccaattagctctataattaaaaatatgtttcttctgtaagacataactcataaggttgttgaggacaaagcacatttaacatataactgccatgcgctctgtaaaaggtgtttattattgctaccactccattgctaaagaatttatagtacttttaattttcttctttacttaaaaaaattatgtaataatttgaccatgttcatcaatctcttgtatgtatcttttatgatacaagatgatgtcttgtatgatatccatgcctttcaataaatatttgaatattcctactaattttcaggtcaaatcaataaatatttgaattcctactttgtaccataatgtggtcaatggagaaaagtttaaatgtgtgtcttagtgcatttgggctgctgtaacaaaacaccataaactggttggcttataaacaacagaaatttatttctcacagttgtggaggctggaagtccaagatcaaggcaccagtttatgtggtgtttgctgaggggcaactttctggttcatagatggcaccttctcattgggccctcacatggtggaaggggtgaagagtctcttttgggcttcttttaaagagaaaccaatcccattcaggaagttgaaggctaatcacctccccaaggccttacctcttaatagcattaccttgtggattaggctttcaacacataaactttgaggggaaacaaacattcagtccatagcaatgtggttctttccttggggagcagctcatattagttgataaatcaatatcccaatcaattgaatcaaagtttcaccaaaagttaaataacagtttaatatttaaataacaacttcagctacagctatagtctcctttccacactacgcattctctttctctgcttaatgaagtaatgaagtcatcttatttctcatagtttcccttacctattgaatctcaagtttgagagttaatctgcttgtcttttcctatatgttgttttcatgtattcatctccgtaccttcaaatatgacatattcatgccttttgtcagctttgtcatttatgaaagataacttatttcaaaattcagctcaccattagctgatgtatcatctgtgtgtagagttgttgctgttttggtgtgttttgttttgttcactggcattttcttttcctagctgagttgtaagttgtccaataaaataataaccagcacttagtaggtacttgaaaaattttcattaaataaatgaatgggaataaatattgcttaaataaatgaatgggaataaactaagccagttgcttaattttatgccataactaaacatttttattatcaatcttatgattttgttggaagaataaagacttattttggggcttcttacgcacttaataattataaattgttcttttgaggtcagagaaaaattcttttgactgaaatattgtattattctaggccataaaataatttttaaattataaatttaatacattgtcattataaaggtttgggaaataaagaagggaacaaggaagtaaaaatgaaaatcagctataattgtaccattcaaagaaacaataatattagacttatatcgtacatctaattttatgttctttttaaggtttactattttatcataagtgtttcccatgttattagtctcagaaagcatcgtttttgttgttgttttgtgttttttctttttttttttggagacagagtctcactccgtcgcccaggctggagtgcagtggcgcgatctcggctcactgcaaccaccgcctcccgggttcaagctattctcctgcctcagcctcctgagtagctgggattacaggcacacgccaccacgcccagctaatttttgtattttttagtagagacggggtttcaccacgttggtcatgctggtcttgtactactgacctcgtgatccacccacctcggcctcccaaagtgctgggattacaggcgtgagccaccgcgcccggcctgcaccgtttttaatgactacaaatctccttagtatgagggtctggaatttaactatttttctcttgctaaacttatagtgttattcctactactctcccacttttcgccattcttatgggtaatccagtaacattgttatgcaaaaatttctgccgatgtttctgtagaagagattcttcaagctattttgattcacaaggaattaacattttaacattattaaaaatcttttaatagaaactgccaagttgccttcaagcatggacaatttatattcctcctaacagaataataggaatacctatttcactccattctcacctgggttatattttagcaaaatacatccaatagaaggagttggacaatgtgactttggcaaaacaaaaaaactttagcattgcttctaaaagcttggaaacttttatgatgtttctcttaatattcaggttccaattccaataatgtcttttgtttctttgtctagattttctatgcagttcatgcttttcaagcacggagtgaccatgaactcagccttcaggaataccagagagttcatatactcaggttttgtgacctaagtggcaataaagagtggtggttagctgaagctcaagggcagaaaggatacgtgccagctaactaccttggaaagatgacttatgcttaagaaaataagccttcaacttttattttccagcaagttgttgattgactacctcataaaactgacattacaaaactttggaccagaaagcaagaaacctctgaactacagaaactgatactgtactgggttttcaggaatactgtacttcctaacaggattattgcatgaatgtattataaaggatacatgttgaaagaaatactaagccaacagaaatagcaaagcaaatgacccaagcttcaactatcaactatttaaaagtgaagatcttttgaaggagtaattatattcttttatcatcaagaaaggttggatccaaaggtttttcaatttacttttttttttactgtatgatgtattttgccttaaatgtttttgtttttcatattgctctcttgcaaatgcatacatgtttatatacatacatataaaccatatatattatgtagctttatacacgtatgtggataatatgaattatacacctatatgtataaatcagagtatacaccaaatatacataagaagaatataccaccaactagaagtctttgataatatattttgttaatgtttcgtttatatgttttgaactaaaactgaataacttgatattaacatgtaacattactgaatgcacactatatgccagacattgttctaagtgctttatatgtagtaacttgtttaatattcaaaacattatgaagaaaccatggcccaaaaaggtgaagtaatttaatccaaatcacattgctattaagtggtgggcctggacttaaacctaggtagtgtaaaccaaaaataaaattctaaggcttccaaccatctaaatagacttccccttcagccagggcttttttctttcttttcttgttgtttttttttttttttaaagagacaataaaaggaggtttttttattcaaaggtataactggataagtagatttgtttacaatcattcttgtgaaatacttttttaaaaaaatacgatcaacttctttgcaaatagtagacacatacctcaacaatgatgacctaatttttgatccataatgtaagattaggtagaaataggcaagctcacactgctaaattaactatcaaatactcagtcaaaactccatttgtggcccccacttcttgatctatttctgttccacttcgtcttctaccatcttgccgactttcctgagcaactgctttgtcgactctctctacctgaccaattgccagatcgacaacctgactggcctgaccagccactcctctgtctggaattaaaagatgtttccatcataatattctttaatttcaggtaatttagctggcactgagagtatccagccggaatcatgccactttgcctgtaacctttgactcaattggaggaatatcaaagcaaacacccatatttcctttcaggaggcacactctggtaatctgagacactgcattactattcagctttctaagttctttccaagcacagctgacatcctgtatttcctctaggctttccagagtcatggtcacaaaccccttatcagagttgattaaagatcatggttcaaagcttgatacaccagaaatgtgggctaaagctgcagccaatgcatctatcgcccctttctcttctatcagtatctgagctgatggttggaaaaaaatcaacagcagcataagaaatggaagccagagaccttatggcatccatgcttttaaatttaactaaatccattgtagaaggaacacctacacatttaaaagtaatttgtgttttttgttccacatgtcttagttgacctttctcttggttgataaaaacatatacaaacccctgtctgtccagctttacccacgcatccagagagatggatataggactcaatatcctgaggaggagaactttgaatcaccaggtcaactacaggaatgtccaaaccacgaggagccacattggttgccaccaaaactttataattacctctctgaagccttttagtgtaatttctctttgtgactgtgcaatgtccccatgtaaacacagtgcattctgttttgtgcggattcatggccatgtcagttacattcttcttcgtctcacagaaaataatagccctcccttcagatccactgtagacttgaaggacatctcattttcatctgtgttttataaaggaggaaattgaggacctcacatggagggactggaatttaaaaccaggtcttctgactttaaggcctttcttttagtgttttcccttttcttttccttaagtcactaaaatctgtagttatataatcttacataaagcatatgcaaaatagaaaaatgatagtcaccacatatctactaatgggattaaaatgtacaatcctaaaagcttacttgttagcacacttgcttatctgtccattcattcattgaaccagtaagtatttattgagagttagtgggaatacaatgctgtgcaagacaaacaagatccctccattcataccacttaaattctagtggggaaaacatctgcacataacaaactaaataaaatgatcataaaataataaatgctatttatataaaactggctactttcattactgctcagttaaagggtcttgtagctcattttatgacatgaaaaaaatcaaggtctaaaagctccttgagacaatttaaactctaataccaaatatacctctataaaataccaaactgagctaaatacggtatatgtgtacttatacatatgtacataacctaaatatacgtgtgcacacattatctatacaaagagccatactcagtgaaagataaattacctcctaaactaaagtcccctctgaggtacaacagaaattaaaataattgcttctcttctcaactctatgtagcacgtattttccatgatgggataaatgttttcatttcaagtgccaatgtgtgaactgtaataaacattactgctttc

SEQ ID NO: 1595 - DNA, 79061 bp, Homo sapiens
agtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaaggtaaccaaaaagaaatcaattgtcccagttactgcactcccagctccatttctgctacgtttccaattgcaaagaaaacacacaaggcagaggggaaaattgaataccacctctccttcccacaaaataagaagatgaaagtaaatgtgacctataaattatagggaaaaaaatttattacgtgattcaatgttaaagagtcaattccgaattactcttaatattgctgtgtttttcttttttttttcctggtgagggtaatcatttttcttctaacttcctcttttcttctcccttctctacccaacttaagaagtgggaaacactggaaagcaaatgagttagaaacctacaaaagattgtttatctcaatgggtagatatgtgatattacaccatgagatatatctaggtaatggtactgaactatgattgtggttatcttaaataggggcatgaaactataatcgtgtctgtgacaaagaaggaatgttatagtcagagagacggtataaaaagatttgctgaaattcacttaggtgattatttcctttgagtaaattgaataatactcaaatatggtaagaaatgtttagcatgcttattttgaatgacatttgaggaaataacttcagtttattttgtgatggtacaaagataatttggcacagttatgatagcacatcatttgtttcagggccttaatctatatcctgtcctatctatcctttctttctctcctgtttcctgaaggtcatttgttctagtaaaatttcattttgatgttgatattgggcagcattttaagtcttttcttcggtacttgttatgtggtcctccagaacttgcctctcctgcttttagcacaaggtgtgtctgaactctcatcatcccactgtgagctgtcgttttggatttaaaaactgtgatgaggtcagaaagaccgataggacatgcttatatttaacaaatctctttccacaaatatgagcttagatttagttatgcaaattaattaagttaaataagttaaattaaatgcatttaaattaaatctaaaaattattactataagttaatgtgtaaaaataaaaaaaaaattaccagtagttcagcactaaagcacagcatcaatcttatcctcaaatactttttttttaaaatgagggagagcattgtttaatctttgaaattaatttttctccaagcaatagatacattggaaagaatggatgtcttaaaatttcaacttttattttagattcagggggtatatatgtgtgtttgttacttgcgtattttgtgtgatgctgcgatttggggtacaaatgatctcatcacctgggtactgagcatagtacccagtaggtggtttttcagcccttgcctctgtccgtttctcgccactccagtagtctccagtatctattgttgccacctttatgtccatgtatgtctaatgtttagctctcactcataagtgagaacatgcagtatttggtttgctgttccagcattaatttgcttaggataatggcctccggttgtatccatgttgctgtaaaggacatgattttgttctttcttctggctgtgtagtattccatgatgaatatgtaccatgagaatttaaaatcatacacatttagtttctaaacctggttcttcaacttactaccaattagaacttgagcaaattacttgaaatatctgagcctcaattttcctgtctgtgaaagtgggactaatgatacttgccacatagtgttgttgggagattgaaattagataattacaaaacatctagtatactggctgataaattttaggaataatgggtaccataatgataaaacagaacttgcccaatattaatcgaagtttgtataccttatttctctttttcaattcttttttgtcctttgataaagagaccacatctagaaattcaggaaaagcccattgctttatccctaatgacatgttttttctgtctgagtttcactaattcagcatctatcagagtctccattagcaaaataaaaacagaaaataatttttgctattcacaaatttttgcttactaaattttcctaaaaaaataagtctatgaccacacaagagagcagacatgggttggttactttgcagaagacctcagacttcttacgcacttcatttgatttgtggctttcctgtgctctgttggattctttgaaggtggaaggcaaaactcagcagttaatacatgcttctagtctgtgcttgagaaaaatcaccaagaagtatagaggagcacataagccataaagataggctggcctcctgagaagtaacatcttaaaaacgtaacccttaaaagaatccaagtctgattatcgaacgcctaatagagcttttagcatggttcgactagaacagggaaggcgacaagggaaggcattttctcattaatgttcaaagcaatcagttctgtgcgtttgttctctggcctgtacgatacccattattatgcagatgagtcctaaatcaccttaagaagctctttattattcaaatgccgagagattttcctctccctttcttggaactggtggtccctgggaggcactgaataaacacctggactggttagagccctcagatagatggcctaaagctcttgtgaggtcaaagagtgctttcaaatactggaatttctggcaacaccacattcctcaaattatttagctggttatttaattagttatttaattggttgtccttcaatgctatattacctgagtaaaattcactgctctaactctctggggaagcaagttctctgggttccgtaaaatgtaagatttttctttggtgctcttgagcttgtcttttaactcatgatacctagtctatctgttcaattcaatttctcacatcactttagtagcatgaaacttaagttgtaataacaattttaaaaatggtacactggctgaattaaaacgatagaacatggctctaaccaggacatcctaaaacctttgcagaagattgtgatcacatcaacatagtcattcctactaagcctggagttgtataataatagaaaggccacccttaggctcccttactccttgaacagattaattcagttgactagcatttattgaatatgttataccttgttctttgaaattaatttttctcaaggcccttgatacattggaaagaatacaaattgtaaaatcatacacatttggtaaattgacatttattgaatgttttagatgctgtgtcttgagggttacaatgaacagcaaaaacagaatatgtgccaggaattacaactacaaaatcatcaagaaaacatgtctgacctttactccaaagaggctcaaagtctggttgggaaagataagacaggtaaacaaataaatacaataaagtggcatgatagaagtggaggtaggatcagtgggtccacaaaaggaggaaacggtctattcaggactgcatgaaggaggttgtcagaaaatggtgtctctaagaaatggtaagggtagggatgagggaaggtacaggtaagagaatggcattttaacctcttcactgtatttagctctgtctgaaatggtttttgtttccttgtttatcacctgttattgactgttgttcccctcccttttctctccctccccgctcatacaccatgaaagaaaccctatctgtcttgttaactgttgcatctcagcagcccagaatacagtaaacactcagtaactgttaaatagagtgaatgacttgaatgatcaggcccaagcaggaaactggtgtgaagaaagacaccatggcctgaaataagagccattgtatttatctaaatatgtgaggacacatgtttctatcagaaagatgattcttcagttaaatgaacatcagagattaaaatgtacagaatttatataataagtaattcttagtggaagcctgtttcattcccaactcgacctttcagagcacacaacaaccatatttcaaaaattcctcttctattagtgacaagagccatcttaacttccactagctcaattcctcatttccattctactgggagccatagaaattacctaaatacaagaaatttagtggttgagttgtaaaaactcagaaagggtttcataaatacttatatacatgatctctacatttgaaatatgcctaatttaaatagttatacagaactgtgtctgtgcatatgcagatatatatgtgtatatatatgtgtgtatatatatatatctccagtatgtagatatagatatacatgtatgtacttgtatgtgttcgtgtgtgtacttgagacacttttttgcaatgattagactttttattgaaagttactataaaatttgaagaacaaaaagaacaaaagtttactaacattcaggagtcttttctgaaaaccatatatgaattatatcactgacattataggtttcctctcagtatgggtactatggactgaatgtttgtattcctctaaaattcctatgtgaaacctaatccccaatgtgacagtattaggaggtggggtctttgggaggtaattaggtattgagggtgaagctttggtgaatgggattagtgacccttaaaaaaaaaaaaaaaaggcaagagagagcttgcttctctctgctctcagccatgtcaggatacaagaaggtggccatgtgcaaaccagggagtgggctctcagcaggaataagatcttccgcattaggaataagatcaacttgattctggattttctagcctgcagaactgtgaaaaataaatttttggtaaacttaagccacctaatctctaatatatttgttatagcagcccaaaccaaccaagacgggtcgattacctttatcctctatggccacactaaacttctggttaattttctggccagtgcatatttttgtttatccaacaccaggtgaaaaggtgagaatacatgggtaaaatgctattacccattaccactgccggtaacacaaggcaaaaattacgtctccatttcttagtgtgtctgtggtaccttctatttttgcaaaggctattgtatcattctaattaagaaaggttatctttatgagacccaaagttgtcttaatatggtgcgaaagatgaaccaccctactgtatgaactttatacaaaataacagattgtgccatgtggggacaagtggctcaaataataaattagacttggtaagactatgagggcatttaatttaaaatgttttttaagaatatagacagtctgtcagggagcagaaattaacactggaagacttggtgagttttgttcaaggccaaatgaagaatggagtaaaacaaattgtccagcttcctgtgcatgtttctatcccagtgctacaaaccctttttgttcgtgtctgttctttgattagtgagtagctccttcccctttatctgccttcatacactctacagtgaaatgggaagtatttgaatcagtaatgtgacaccagtacaaacaggtgtgtgtcatagtttgaagggcaaatctttctaaaaggcaagacgctttaaaaactcagtaacttttgtcttactgcatatatagaaaccagtgtaaaacacggtattttactttcctatttttttcagtagagacatcttgcagtttttagaaggaccatttgtgtcaaataatgtgtgagtcacagaaattgagactgtttgagctattctactactaccatattgtgatgggcaaatttattcctatgtttgaccgatatgactttaggtataactttcttaaaagtagcaaacacaatttctagttgtgctttttttttttgtttataaaaattatgggtttatcaaaatgagacatcaagaggaagaaggaatgaaagaaaggaaggagagagagaaggggaggggagagacagacagaaaccaagcaagcagcaagaatgaatagaaatataccttaaaatagtaataaagttggagaaatgatgggagagagaaaagcacccaagccacattcatctttgtttctgttgacacaggaaaagaaaaaaaaaaacctctgtttacagaattactttttcttgatgccataatcatattagcatcagtacctttatgaatattgatttcctgataaaagtagaattattgcaagagttgctaaatttataagcagtatcgttcttagaaccagtcaagactcaaagttatggcttatttgggagtcctaccttcacttctagactgtttctgagactgtggaattttctgttcaacaggcctcagtactggctccaacatttgcttggaccgcttcttatcccatgctctcaagggcagactgtggttgctggtgtgcatgctcttaggcctaaggcacaattgatgatgggggtgtttctggagcttgatcatgctggagtgttcagatcatgtctaccaggttcctctgggtgggaaagctggtagagagaagagtagggattcaagcctcaagattaggtaggagtgcgtgtgtcccatggtcccctgccaaattttggcataaaactctgagggatatgagaaatctaaattagaagttggcctttcagattgttataaaatatatttatcaagacagaaggaaatatcacattttatttaatagtttgccagcttcatttataacttttaaatatgtagatctggtatgctggcctccatctgtatccttgctccaggtcccacaaaggaggcagctatgtgtggtttttgactgtaatctatttcaggatataacccttcttctatactaggttgtgaaagtaagagggaaggggagggaaggaagagattgagtattagtgttatgttatctgctaggagctatgctagccagatgctgtcacacacactgttactgaatcccaacttctcttctgttcagttctgattttatcattgagaaaaataggtggtaggccttgggtttgagatgtcacatgcttgaaatatttgcaaaatggaatgaatttaactagttgactcagtaggtattttatacatatgatttactaagaagtcaaagccatttgatggttgcagcacatgttttgtaatgtgatgacatttctctgctaccataataaagcttaacttgctgtttttcactttggaatatattttctttcttttgacttatagtggcatgtccctgccagactgtcactgtttaataaatactttttttgtttagttgtcggggaacaaaattacaaaggtaggttaagcaaaactgtcttatagtaatagcttaatgatctccatttcctgcttcattgcgtatcttgacactgaaactcatctttctttaattttatgcctgttgtcatttatttgcatctcaataaaacttaatatatatcagaataactgagagtcctattctacagcaatgagaggagggaatacatttgcaaatgaaaagaatggaattatgtgtgggaaacaagcaactttttatctggataggtgatatttcagtagaattgtatgaagtcagcttaaattgtgagtcataacttaaatgcagcaggaacacagagtgctatgatttaagactttgtccaaggttttctgaacaatgtttttcttgattaatgaatcagagaataaatgaatagtctaagatacctgcactgaagccctcgatagaggatgcaatcttagactgacatacaattcttacttaaagaagaaaacttaaaggtcatgtcatctagctactactctaagtattgtgagtcattatagcacttcacagaaactgtttttcctgaatgcttcttaatgttaggtctccagtgtcactacaaaaagccatcacagatttctccttctgtgtttgttgtgaaatggttgatgaagacattgtttacctctctcagattttattcaatggaaagctgactctccttaagaataaaaacacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataatagaatagaatagaatagaatggaatagaatagaatagaatagaatggaatagaatagaatagaatagaatagaatagaatagaatagaatagaatagaatagaatagaatagaatagaatagaatagaatagaatagaaaagtttctttccccagatctctgcaagagcagatttttatcactgaagtctctgttcgtcttttttgggagtccctccctgaccatccgacctaaagtgatgtaggtaagggaatacctttcctctaccctcttaaattctgtgactaggacctgtgaattgtatagacaaaagacatactaacaaaagaaaaagcatacacattttacttgaggttaacatttttatgtgtcgtaggaggctttgtaggaagaaagaagtaaaaacctcaaagaagcagttagacctaggggtttacataacattttaacaaaggtcataaattgtggagatatgacaaagccaaagtaaaagagtttagggttggggaaagaaattgtggaaaagtgactaggaaatacatgggagaagctaatggaagataagggttatttttgtaagatttgtttgtgtagattcatctctgtgtcaactccctgtctctgatgatgagaatattcccttcttggtgatacagggagggcacttttctcatggtaaatttacactctgcttttaagtaaaaaaggaaaaggcagagagcccttcctgcatctgctattgagcatctccagctcaaaataatcagtatcccaaagtggcatatttagggatggtgtgttctgatccccctcagtggctttcataccatctattactctatgaaattatactacttcattctatttttggcttttgctgtcatttgaatataattctccttggggaaaaagacttagcatttaagcaatgcctggtatacagttattctgctcaatgactatttattgaatgactttaaaatatccagtgaataattacaactatattgatccttatgacatacttgcttttacaattctgtcattttcacttacccactatgtaatggtagttaactttcagttaatttctttacattctttttctgtaaagaaagattataaataaataaatttaattaaagaagagactagaaagagtttcctggccaagaaaaataggatctctttttaaatgaatttattcaacaaatatttgctaggtattcgtatgtgccaggtatgactaggtcctaagaatgttttttaaaatatcagaagcacacccagcccactgagtgagacaggttgtgaacaaattattgcagtaatgtaacaagggcctgaagtatactgcaaattgggtttccgacttgcaaattctgaaatagagattcgggtggaggggaattattaggcaacattctgtgaccaccacctggggaagaaaagggaaggacataagcctgggcacagggagaggccgagctgtgatgtggtctcattggaagctttagccaactctgagggaagttctgaagacagatgattttttggagttgtctccagtgttgtgaaggacctgggcccttgtatcacactttacgtttggggatgtggctatcttgggaaaaggcatggcctgagaggtgctttcatctgagataattcctaaagagggcatatctgctggttgcactcccggcagctgaaataataatttatcccttcctttaaggggaacgggtgctaacatggcatccaccacatattaagtggttattattattagagacacaaataaagcaatataggagctatgataagaaagagcttaattgcacctctgaaatgccaaaagaaaatacactgaaatctgaatcttgaaatccaattaggacttttaggggcagaagccattccaggcagagggattatgctggtcctcatacatggaacaaggtaataatactaatttttgtatttggggatttctaaatggaagagcaggtacaaacaccaactgaacatctgtagtaggcacttaggtgcagtacgtcatttcatgctcttagcaactttgcaaataagttattgccatatatttatagatgataaaacagaggttaagagaggtataagcattctcccagtggtcacatagctattaatagcaactggtgaagtcagagttttcctgaggtttgcttggctccaaagtcagggctttttcaaccatcatgcagttttcctgttctaaccttagtttttagtagtagtacctgttttatggtttgctcttaagaaatcaactgattttaataaacttttgaacaatactcacaagcatcaagagaactgtaagttctgccaatacattcatcggcaatcttgaagtgaacagtgaccaacaagtatttttcagtagctgtgttattttatgcctctcaacaaaatgttctatgtgcttggaaattagaaagatatgtacttgcattgaataaggtccatacttcacagaaacactagaatattctgctctaaaaatacaaaactgattatctgaattatctagtctttgaaaactccttgtcatcactaactacagagtacttacctggattagggtactcagtgaaaaactgggtcagaatgtcaaactacatggctcctttgcttaacactcctcattgcttttcatttttctatagctagcagcagtacccaaagaggggaatatataaaccccaggagattttacagacaatctattgtgcaaagaaaaaaataggtttgtttttcagtattgctctttgaaaatatttattgttgtgcatgcttcataatatgtatgatacattaatatgatacgtatattagaggtgtatacacagaacagtttaactgacacaataaaaacatttgcagtaaaattctgacacgctactacatggatgatcatcaaagatattgtgctaactaaaataagctagtcacaaaaggacaaacgctatatgattctacttatatgagagtagtcaaattcatagggacaaaaagtagaatggtggtttccaggggctgggggaaggaggaaatggggaattattgtttaatgggtagagtttcaatttgggaagatgaaaaagttgtaatgattgcataataatgtgaatgtatttaatgatactgaactgtttacttaaaaatagttaacattgtaaattttatgtcctgaatattttaccacaataaaaaatgataaaaaagtttggcggcccttggtttacaatattaaaatggaatgtaaggcttttcccaatttgactctatctcatctctggcctggaggacagtgttacttttgtcaatgaaaagagtcaaactctgtgaaatatttgaagatatttattctgagccaaatatgagtggccaatggcctgtgacacagccctctggagatcccgagaacatctgcccaaggtggtcagccagcaacttggttttatacattttaagcttgggtcaggaaaggtgggacactcatcttctgctaaagactttaaataaaaacattttctgaagtacccatttatttaactcctcattgctctgtctgtgctatgctgatcactgtcggagcctgtaaattcaaaccaataccacttcagtatttttcaagacaggtaagctttgtttaattcctttttgaaatccactaatctactttctatgccaattagcagtcagaggaaataaatcacatgcccttccaatgaagataaaatattcccagccccagtatttgagctttcaaattcagagtctcagagggtctgttcctccacattttcacttaatacctcactggctcccctccaaaccctgtctgacatgcaattattttcaacctatttcacagaagtctgctccattcatctttctgtgggtcagatttccattgaaactgattttaaacgataaaagattttactgtgtgaaacgtatgttggtagggctcgacgcaatgctaagccaagatttttttgggtttattggggcagatatgaaattggcagcatggagagggatgaaagaacatttataatcatatctgggggtttcgtaatgatctgtctggaataaaactgtatattgaattatgggtgggtgtttgcactatacgggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaaatctagttcagtggaggccaaagtgatcttgctaagagaatctaatcatgtccctcatttattaaaaaattcctcattgtcgagatctgtctcctgagaatttctctagacttgtccccttttcacaacctctatcacttgtacttcagctgcactaagttgttttcgcatctttttttgccaccaagcctttaaatatactatttcttttgctcatgacacttttgcatttctcttcaccttgtgctacctgtttcagatttcaactgtgtcacttctccataggactgatgtccaggctgtgctatgcttgcatgggtcacaggttatcataattctatttatactaactacagttttaatttttttatttttaatttttgtgggtacataataggtgcatatatttatgggttacatgagatattctgatacaggcatgcaatgcatagtaattccatcaggaaaaatagagtatcaatcacctcaagcatttatcctttgtgttacaaataacccagttatactctcttagatattttgaaatgtacaattaaattatttttttattatagtcaccctattgtgttagcaaatactgggacttacttattatttctaactatgtttttgtacccgttaatcatccccctttcctccactacatcctccagactacccttcccagcctctggcagccatcttttttttttttttttaagagacggagttttgctcttgttgcccaggctggagtgcaatggcacgatcttggctcaccgcaacctccacctcccaggttcaagcgattctcctgcctcagcctcccgagtagctgggattacaggcatgcaccaccacgcccagctaattttgtatttttagtagagacaagatttctccatgttggtcaggctggtcttgaactcctgatcttaggtgatcctcctgccttggcctctgaaagtgctgagattacacacctcgcctgccatccttttactatctatcttcatgagttcagttgttttaatttttagcacccacagataagtgagaacatgcaaagtttgtctttctgtgcctgacttttttcacttaacataatggcctccagttccatccatgttgttgcaaatgatgggatattattctttttatggctgaatagtaagtactccatttacaccagtttttaaatactgaccaatattttaaaatgcaaagtgatttgtttgcagaatctttctggaataattcttaatcttttaaatttgtctcattcaactcctaatataacagcagtgctttggcaacttgactttataaaattatgtcaaaacattaaagcagttttcacagaaacatacacatggtattttaccctcatatttcattaattatgtaagtttcgttaaagtaatataattacaaagaagtacaactgacataatgaagtcagctgttgaacacaattaagtcttgaaaaatatgccccttgattgttaagtggagaagtacatagacatcagtttgtgtatttaagggagataatggaaaatgttgatttatctcatgacttcaataccctgtctttacttctagattatacatatcttgatggtaagagctgttgtttattcatttaatatacacaacacaaagcacaatatcaactcaatatccaatatgtaatttaaaaaattaatattaaattagatataaggtttttttttcttttattattatactttaagttttagggtacatgtgcacattgtgcaagttagttacatacgtatacatgtgccacgctggtgcgctgcacccactaactcgtcatctagcattaggtatatttcccagtgctatccctccccccctccccccaccccacaacagtccccagagtgtgatgttccccttcctgtgtccatgtgatctcattgttcaattctcacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtccatcacatgaacagacacttctcaaaagaagacatttatgcagccaaaaaacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggtctataaatcatgctgctataaagatataaagttttttaactccaaagactatggaatttgtaaaattgttaacttaccttcaaattctaatattctttgatttgtatgtaattataaacatatttgtgttgtgatgaaattatatattagttaatggccagattcttgtgttgtattatctttgtgttctccacagtcaaatgactgtgaaagttgctcaataagtaagtatcaaatggtgtatgtgtgcctgcctggttggttgttgggagtatgagaatgttccaacattcttgaagtatgtctttgttagcagcatgagaacaaacgaatacatactgcattttgtttataaaagtgcatattcctgaaaattatttttagggtgagggcaagtgctgttaagtaaggcattaaacaaaaccttaagcttggtatatgaaattattcactacaactattctttactaagagatcagtaagatttcaatacaattaagaaaatctaaattcaggattatttattggtagctattgaaaaacaatatcagaggggaaccttaatctaaataaacaatgacttagaattttacaagtaataataagctgtgtactttagcaggacacagctgtttaatcatctccttgcccattaaacttgtttgagaagcacattctcagtgactgctcagaaacttatttgcattggtgatttagctttggggtaaatgattcagatttttaaaattcagatgttattatattatgctaaacaacatgccagggctatatccctagctcatttgaatttagcctgaataatagcagtgcacattaggcctggtgttgaaccgactttgtagcagtctttgctgtttttgctttttccagccaaggagggcaatttcctgatagatggtcaatctcccctcttgcccttggaacatttccaaggaaaagaaaaagagggaaagcaggtgtagccattcacaaccagatacagaataatggcaagtaaatcatggtcgtaaaaacaatgactgacattttttgagaggtttctggtatgtcagacattgaattaagcaattttcatgctttatctcaattctcacaacctcctagcagtgagcagtggttaacatgcaggttcaggagccagactggcttaggtttgaatcctggccctccactttcagtggtgtgaccttgggcaaactgcttaacctctgtgtgtgtcagcttctgcatgcgtaaaaggaagggaatatatatacatcttattgtgtttttgtgaagattgaagagaaaatgcaaaacaaactcagtatttgcactaaaaaatgttagcttttattatcatttaatattactattattctttttctctttctacagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccagtcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaagtggttgctcttattataggcttatcacaatacattataatcaaatataattgcagtaatagtgtataatgctttaatatcaaaaataatttgggggaacatacacgtttataaacaaaatgcagtatgtattagtctgttctcatgctgctgataaagacatacctgagactgggtaatttataaaggaaagagatttaattgactcagagttccacagggctggggaggcctcaggaaactcacaatcatggcagaagaggaagcaaacacatccttctcatggcaacatgagaaggggaactatgagtgaagagtggggaaaaggcccttgtaaaactgtcaaatcttgtgagaattcactgtccaaaaacagcagcctaggggtaaccatccttgtaaccatccttatgattcaattacctcccaccaggtccctcccatgacacgtagggattatgggatctacaattcaagatgagatttgggtggggacacagccaatccatatcatggtatatatacacaatggagcatcatcagccttaaaaggaaaggaaattctgataacatgatataacatcaatgaaccttgaggaaacatgatacaacacagatgaaccttgattacattccgctaactgaaataagccagacacaaaaggacaaatactgtatgacgctacttatatgaagtacatactagtcatattcatagagacaaaaagcagaatgatggttgccaggggctggagggaggaagaaatgcataagtattgtttaataggtataaaatttgcttagaaagatgaaaacattctggagacgtttggtggtaatggttgtccaacaatgtgaatgcatttaatgccgctgaactgcacacttaaaaatagttaccattatacattttatgtcatgtatattttactacaatgaaaaagttggagaaaaaagaatatatccatctacgggaggaaaaatttgttattaaaattattgaaataagaattgcagtcctaaaattaactcatacctcatcctttttttttctttttctttttttttttttttttttgagacggagtctcactctgtcacccaggctggagtgcaatggcgcaatcttggctcactgcaagctccacctcccaggttctcgccattctcctgcctcagcctccggagtagctgggattacaggcgcccaccaccatgcccagctaattttttgtatttttagtaaagacgggtttcactgtgttggccaggctggtctcaaactcctgacctcaggtgatccgcccgcctcagcctcctaaagtgctgggattacaggcgtgagccaccgcgccctgcctgctcatgcctcttcaggaagatttttgatattttgcgttgaattcctctaagaagtcatttcagtctttatatttcacagtagtgagaaggagtgcatgactgttcttacccacacatatgttccttttcgaattggcagatgagtattcatcaatgtagattctaacaatactgtcagaggagaaataatattgttgtgacaccaagagaacatttttattgtacacattaccttggaataacatttttgccaggaaatttgatgcagcatacatatggtgcctgatagaaagaagccaggcgaaagtacattagtcctgtgtgttgtacatgatatatagtcaaacagcctgtgagatagaaggatatcattaactatgaaggtcattccatcatcagtataatgtttggaacaaagatatattcagttatgctgtttactctatttatacttcaactctgcatctttataaacctacctttctatgtgatttttaaaactcacagaagacttttttttaagaagagaagatctgttttgtttaaattgccttgcactccaaataaaaactattatgaattttaaaacatgacttcttctgacattgaaactcttcttttttttccaatgactatataactgttaaaattttggaaaaatattttagtatgcccaggaagccttgctatgtctattctatttgcatttgtttcatagtctcattaggttcattttccccctaatttttcatttgtggtaaaatgcacataacaacatttaccatcttagccactttaaagtgtacagttccgtggcattaaatacattcataatgttctgtaaacatcaccaccacctccagctctcttttcatcttgtaaaaatgaaactctgtaactattaaacaataactctctcttccccccaatcctcagcccttggcaaccatctccactttccgtttctatgatttcgactattctaagtacctcatacaagtgggatcatatgtatttgccctttgtgcctggcttattttacttgccataatgtcctcaaggttcatccaggttataacatatgtcataattccctttctttttaaagcttgaataatattccattttctgaatattacacattttgttcatctatttatccattaatggatacttgggttgcttccatgctttagctattgagaataatgcaatcctaccaacaatactcaagaattccaattccaatttctccacatccttgccaacacctctggcttatattttaaaatatattagccatccttatgggtgcaaagtggtatctcactgtagttatgatttgcttttccctcatgattagtgatgctgagcatcttttcatatgctgatgggacctttgtatattttctttggagaaaaatctattcaagtgcctttgctcattttttattcaggttgtttattttgttgttgttattgttgagttttggagctctttctacattctgggtgttaatcttttatcagatatacaaatattttctcctatgctgtaaactgcttttttattttgttgatagtgtcttctgatgcacaaactttaaaattttcataagtccaacttttctgtttcttcagaaaagaagaaaaaagcctgagcctttgtcatatccaagaaattactgccaaattcaatatcatgaaatttttgccctatgttttcctttacaagttttatatttttagatttctgatccattctgagttaaattttgtatgtggtgttagataagggtctaacttcattcttttgcatgcaaatatccaattttcccggcaccatttgttgtaaagattgtcttttccccataaaatagtcttggcacccttgtaaaatatcatttgaccatatatgcaaggatttatttctggttctttattctgtttcattagtctgtatttatgccagtaccacaatatgttgatttcctgtaactttgtagtaagttttgaaatcacgaagcatgagttcctccagctttattcttctttttcaagattattttggcctattgttgtcccttgagatgccatgtaagttttaggatgggtttttttttttatttctacaaaaaaaaattggaattttgataaagattgcatagaatctgtaaatcactttgggtagtattgacggcttaacaatatcaagtctttccgtccatgaacatatcttctcatgtatttatatctttaatttctttaataatattttgtagttttcattgtacaaatctttctcctctttggttaggttaagtcataagtatttcattgtttttgatgctactgtgaatggaaacactttcttaatattttttcagattgttcattgctactgtatagaagaaatgcaactgatttttgtgtgttgactttatattctgctactttactgaatttattagttccaacagtttttggggtgaacatttagttttccacacatgagatcatataattttagaacagagagaattttacttcttttttttccactttggatgcctttatctctttttcttgcctaattgctccagctagaattttcagtactatgttgaaaagaagtggcaaagaccgggtgcggtggctcacacctgtaatcccagcactttgggaggccaaggtgggtggatcccggggtcaggagttcaagaccagcctgaccaacatagtgaaaccccatttctactaaagatacaaaaaaaaatttagccaggcatggttgtaggcacctgtaatcccagctacttggaggctgaggcaggaaaatcgcttgaccccaggtggcagaggttgtagtgagccgagatggtgccattgcactcccgcctgggtgacagggcaagactccatctcaaaaaaaaaaaaaaaaaagaagtggcaagagcaggcatccttgtcttgtttctgatcttagaagagaagccttcagtctttcaccattaagtatgatgtttgctgttaattttttatatatggcttttattatgttaaggcggtttctttctatcccttgtttgttggattaaaaaaattttttatttctatagcttttggggtacaagtcttttttggttacatagattgattatatagtagtgaattctgacattttagtgcacctatcacctgaataacgtatgttgtatccaacatgtagttttgtatcccatatagaataatggtgtccagctccatccaggttgctgcaaaagacattatttcattcttttttatggctatattccatagcacatatatatatgcacacacatatatatagcatatatatatatgtacacacatacacacacatatatacacacacacacacacacacacaccatattttctgtatccactcactggtcagtgggcacttaggttggcttcatatctttgcaattgtgaattgtgctgcaataaacatacaagtacatgtgtctttttcatataatgacttctttcctttgggtagatatccattagtgggatggctggatcgaatggtagatctagttctttaaggaatctccatactatttttcatagaggttgtactcatttacattcccaccagcagagtagaagcattctcctttcattacatctacatcaacatctatcattttttgactttttgataatggccattcttactggagtaagatggtatcccattgtggctttaatttgcatttccctaacaattactgatgttgagcattttttcatgtttgtgggtcatttgtatatcttcttttgagaaacgtctatttatgtcctttgcccacttcttgatgaggttatttgttttttccttaatttgtttgagttccttgtagattctggatattagtcctttttcagagacatagtttaaaagtattttctccactcttgattgtctgtttattctgatgattatttctttggctgtgcagaagctttttagtttaatcaggtctcatttatttatttttgctttttttccatttgcttttagggttttagtcataaatactttgcctaggccaacgtccagaagagttttttcaaagttatcttctagaatttttatgctttcagccctagacttaagtctttgatccatcttgagtttatttttgtataaggtgagagatagggatccagtttcattcttctacatgtggatatctagttttcccagcaccatttattaaatagagtttccttttcccaatttatgtttttgtatgctttgttgaagatcaactgtttataagcatttgactttatttctgggttctctattctgttcccttagtctatctgcctccttttgaaagtaccatgttgttttggtaactacagccttgtagtataacttaaagtccagtaatgtgatgtctccagatttgttctttttgtttaggatcgctttagttatttgggggcttttttggttccatatgaattttaggattgtttttgctaattctgtgaaaaatgattttggtattttgatgggaattgcattgaatctgtacattgctttgggcagtatgatcattttcacagtattgattattccaatccattagcatggaatgtgtttctgtttgtttgtgtcatctatgctttatttcagcagtgttttgtagttctctttgtagagaattttcacctccttggttaagtatattcttagttattcaattttcttttcttcttttttttttttttttgcagccattgtaaaagggattgagttctttatttgattctcagcttgctcattgttggtatatagcaagcagcactgctgatttgtgtacattgattttgtaacctgagactttactgaatttgtttatcaaatctaagagtcttttgaaggaaaatttagggtttcctaagtatagagtcatgtcaccagtgagcagtgaagtttgactttctcttttccaaagtggatccccttattttcttctcttacctgtttgctctggctaggacttccagtactatgttgaataggaatggtaaaagtgggcatccttgtctttttccagttcacaggaggaattctttcaacttttcttcctcagtgtgatgttggggtttgttgaaggtttttatcataaagggatgctgaattttattgagtgcttttttctgcatctattgagaagatcctatgatttgtgtttttaattctgcttatgtgatgtatcgcacatattgactcgtatatgtttaaccatctcggcaacctgggtatgaaacacacttgaccatggtgtattacctttttgatttgctgttagattcagctagctagtattttattgagaattttgcatctatgttcaaaagaaatattggtttgtagctttctttttttttactttctttctttaattttttttattattattatactttaagttttagggtacatgtgcacaatgtgcaggttagttacatatgtatacatgtgccgtgctggtgtgctgcacccattaactcatcatttagcattaggtatatctcctaatgctatccctcccccctccccccaccccacaacagtccccagagggtgatgttccccttcctgtgtccatgtgttctcattgttcaattcccacctatgagtgagaatacgcggtgtttggttttttgttcttgcgatagtctttttttattatatcctttcctgatttttgtatcagagtgatgctggcttcatagaataatttaggtaggattccctcttcctctatcttttgtaatggtttcagtaggattgatgccaatttttctttgaatgtctgatagaattcagctgtgaatccatctggtcctgggtttttgttgttgttgttgttgttgttggcaaatttctagttaacttctcccatctcgctgcttatcggtctaatcagggttcctatttcttcctgacttaatctaagagggttgtatgtttccaggaatgtatccatttcctataggttttctagtttgtgtgcctagaaatgttcacagtactctcaaatgatcattttttatttctgtggtgtcagttgtaatgtctcaagtttcatttctaattgagcatatttgaatcttctctcttttcttggttaatcttgctaatggcctatcaattttgtttatcttttcaaagaaccagctttttgtttcattgatcttttgtatttttttgttttaatttcttttggttctgctctgatctttgttattcctcttcttctgctagctttggattgagtttgttcttttttctctagttccttaaggtgtaacattagattgtcaatttgtgatcttttagactttttaatgtggtcgtttagcactataaactttccttttagtgttccttttgctgtatcccagggctttgataacttgtgtcattatgatcattaatttcaaagaatacttaaatttctatcttgatttcatcagtaacctcaaaatcattcaggagcagatcgtttaatttccatgtgtttgtatagctatgggggttccttgtggagttaatttctagttttattccactgtggtctgaaagatagttgatattattttgacttctcaaaatttattgagacttgttttgtggcctattgtatggtctgtcttggaggatgttccatgtgctgatgagaagaatgtatattctgcagttcttgagtagaatgttctataatatctgttaggtccatttgttatagaatataagttaagtctgttgtttctttgttgactttctgtcttgatgatctgtgtagtactgtcagtggagtattgaattttcccactattattgtgttgctgtcttaggtctagtagtaattgttttatgaagatgggagctcccgtgtaaggtacatatgaatttaggattatgatatcttcctgtcgaaattatccttttatcattataaaatgacctttttgtcttttactgttgttgctttaaggtctgtgtgatctaagaataaccattcctgttcgctttggtttccatttgcatagaatatctttttccacttttttaccatgaatttatatgaatctttacattttaggtaagtctctggaagacagttgatatttggtttgtgatttttttaatccattatgccaatctgtatattttaagtggagcatttagccacttacatgtaacattgagatgtgaggtatagtttcatttatcatgtcattgttacctagatactttcagtttttctcattatgttactgttttataagccctgtggattttatgctgtcaagaagttctattttggtgcatatcaagcctggctgttcttggtgtataggaatgctagtggggtttttttggtatgttgattttgtatcctgaaactttgctgaatttgttcatcaactgaaggagtaccaggactatggggtttcctagatatggaattatgtcatctgcaaacaggaatactttcactatttggatcccatttatttctttctgttgcctgattgttctggccaggatttccaatactatgatgagttagagtggtgagagcgggcattcttgtcttgtgccagtttttaaggggaatgctttcagcttttgcccatttagtatgttgttggctgtgggtttgtcatagatggctcttattattttaagatatgttccttcaatacctagttcattgacagtttttaacatgaagggatattgaaccgtatcaaaagccttttctgcatctgttcagatgatcatgtggtttttgtctttagttctgcttatgagatgaatcacatttactgatttgcatatgttgaaccatccttgcatcccagggatgaagcctacttgattgtggtgaattagctttttgatgtgctgctggatttgatttgccagtattttgctgaggatttttgcattgatgttcaccaaggatattggcctgaagttttctttatttgttgtgtctctgccagtctttggtatcaggatgattctggcctcatagcaggagttggggaggagtgcctcctcctcaattttttggaatagcttcggtaggaataatatcagcttttattcgtacatgtgtttgaatttggctgtgaatccctctggtactgagcttcttttggttggtaggctatttactacttactcagttttggagctcattattggtctgttcagaaattgaatttcttcctggttcagttttgggagggtgtatatgtccaggaatttatccatttcatctagattttctagtttgtgtgcattgtgtgttcagaatagtctctgatgattgtatttctgtgaggtcagtggtattacctcttttgccattgccaattgtgttcatttggatcttttttcttctttattagtctagctagcagtctatcttattaattttttcaaaaaaactagatcttggattcattgatcttttgaatggttttcatgtctcgatcttctattcagctctgattttgattagtttgtgtcttctgctagcttggaggttggtttgctcttccttctttagctcttttatttgtgatgttaagttgtaaaattgagatctttctaacttttcgatgtgggcatttagtgctatatatttccctcttaacactgccttagctgtgtcccagagattctggtatgttgcgtctttgttttcataggtttcaacaaacttcttgatttctcccttaatttcattatttacccaaaagtcattcatgaacaagttgtttcatttccatgtaattgtgtggttctgggcaattttcttggtcattaattctaattttattgtactatggtctgagagagtggttggcaaaatttcaaggatttttgtacatgtactgagcataattatatgtctgattttgtggttgatttcagagtatgtgccgtgtggcaatgagaagaatgtatattctggtttttttgtttgtgtctttgtttgtttgtttttttgagacagagtcttgctctgttgcctaggctggagtgcagtgacactatttcagttcactacaacctccaccttcctggttcaagcaattctccaccactaagcccggctagtttttgtatttttagtagaggcggggtttcaccatgttggccaggctggtctcaaactcctgacctcaaatgatccaccaacctcggcatcccaaactgctgggattacaggcatgagccaccaagccgggactattctgtttgttttttggtggagagttctgtagaggtctagagggcataatagagactgtaaggaagaagcattatttgaagtactccttgtctgtttaactcaccccacctgcaggagtagttggaggccaagaacaagtcccggtgccccgtagccccatacaggattcccagctttctctgccttgagcccagcatctgtggcttccttctgtcccctctcaatgccttttctttgaagatttactaggagtgcaccagtcttcccagtgttttggtcacttggtgggagatgtttctcctgcttgcatgtagttggccatcttggaatgaactcaggaatagcatctttcaaaaattctgaaaagctcccagctttgagcacttcaaataatgttcttccttacattctctattataccctctagacctcctagtaaacattagttgaaccttcttattcaatcctcaacatctcctaacctctctcacatattttacatgtctattgcattctataaaattttcttggcttgttcattaatctctttaactttgtataatttactatttagttcattatacaactcaactatttattcaacttagccatttattgattaaacaaaataattaaattttaattattatgagcttttattttaagattctgtattatcttttaaaatccacttgatcatttttatattctcttgtttcttgcttataatttcaaaccattacttgttttttaaacctattaagtaccctttttatatctctaataatttcagtaacttaagactttgtggatataattatgctatcaattttattttctgcatctgactcatggtatcgtgtttccgtgtgtgttttaggatttcttaaaatctcgtattcctatggccgggtgtggtggctcacgcttgtaatcccagcactttgggaggccgaggtgggtggatcacgaggtcaggagctcgagaccagcctggccaacccagtgaaaccccgtctctactaaaaatacaaaaaattggctgggtgtggtggcgggcgcctgtaatcccagctactcaggaggctgaggcaggagaatcacttgaaccaaggaggtggaggttacagtgagccaaaatcatgccactgcactccagcctgggcgacagagctagactccgtctcaaaaaaaaaaaaaaaaatctcgtattccttgcaatgtagctgcaaggaacagttgaagcctgacttgagtttctattcaatttcattaagctttgttcttaatttcctttattctattttcttttggcttattgtatttttttttttttacttatttagttaagagtcaaatcattttcactcttgcttcttttcttgtatatgaatttaagcctataaattttctgtaagcagtgctttacctacattccacatgttttaatttgtaatatttttcttatccttataacagatatcttctattcactttagtcatttcttctgtgacccatcagttattttgtaggttttggttctctattaattccaaaacaaatgagtcctaacattttatttttgttatttatttctacattaatttcatggtagttgtggttctcaatttactaattctttgaaatgttataacttaatttataatgtatttcttcaagtgtccttaaaaatactatgtaatctctaattattggagtaaatattttctgtcctaacagtctatcagttactgacagttatgtttaaaatatcactattaagactgatttgtcaaattctaccttcaactctttcactttttgcttcacatgttttgaaatcatgttatttagtacatacagaattagaattttcatatcttcctaatgaatgggacactttatcactatatagtgcccacttttatttttgccttaaagtctattttatctgtgtaaaatagctatatctcacccttcctttaattagtatttgctcagtatatatttttgtactttcatcttcttgtgtgcttatgttctctactataaatggcatatagttgttgttttttgaatacagtttgataatatggtcacttgagttatgattacacatagatttgaatcgactgccttatatttgtttttctctttcggttttctcctttcttcatttgaactgctttctctcctctactggttttgaaattttacatgctattttattttaatggttggccttgaaattttaacatatatccttaatttaaaaacatctaaagttcattaatgtctttagcttttctgcaatatcacaaaaatgtttaaatgtttaaaatacttagaagtctccacaatctctcccaagctgtcctgtccaccaaatctcttatcctctccccagcgtcctcctacctggccacacattgctctgcttcctgttccttaaataggccatgcacacgctcaccttaaggttttccactgaccagttcatctgctaaaaaccacctctcccagatatctgcatgactctctcacctttcaactctatttcaggcctttcctgccatcttatttaaaattgcacacgttttaagctcttcctagcagctttcatagcattatttttctctatatcacttatcaccttttagtatactaaataacttgtttaaattatttatgttcttcttccccaactagaagtaaagttccataaggaaaggaattttttttttattgctgtatccccagagcctaagatgattttgggctcatagtaagcccttactatttatttgttaagcattcaataatttcagatctcaaatccatatgagagccagttagtgtccttgaattgttaagggatgctatttttttttctattgatcaccaccaaggctgagacaaatcattttattgatgtctctttctttggagcattatttttacttagtgtgtttccttttctgatcctttatctggatatgtttcctgagtatgttcccttttcccactcttgatttaaaaattgcccaataaataaatatttttatctatttatggttcagttcatgaaaaacaaataggagaatagatactgtgcagacaacagcagtgtctgacacaattatgctgttgttacaaaaaagatccccactatatactgttatagttgcaaaagcaagttgcagaagaatatgtatatgagcttgttactgttaaaaaataaaacaaaaaactgaacttctgtaaatatgtgtatttgtatgtgcatggagatattttgagaagcctatacactacactagaatacaaccaataatacagtaaaaataatattacaattaataaatagggattgcatctaataataataaaacattttcaagatatccagtataatgccaggcactgttacaagtgttttacagacattaactaatttaatcttcgaaatcactttataaggctttactaacgttatccttaacttacagatgagaaaattgatacaggaagagctaagtaacttgtctgaggtaatagatctaataaatggtagtggtggagtttgaacccaggcagtctggctcccaaggctatgcacttaaacctctactatatctacatctctctctctatctgtatctatgtctatctatctatagctatagctatttctatgtctatctatatataacttagatagatattacaattacatattattttataatttacaaagaaagaaagaaagaaattacctctccttaaatccaccccaaaatggcagtagtagtagcaaaagcaagaagaaaggaaaaacaggataggataaattctaagcaaaacgtggctatcagtgaagattgtcttcagtcctcccccaacacccctttgcctttgggtgctgttgcacttctctaagagatcgaggttctccccacgcatatacccaagccagataaactgctcaggattctaaaccccagctttgttctgactttcctccgaaagcagcatccctattttttttcctcttcctcttccaactgaactagctgtccacccactttagagtcatgcatttttcttgacaagttggtaaccacaaaataatgggataattgtttgctctagatggtggaagagtttgagactgtagagaaagtaaccctatttttcccattcccacagaaatagttaacatttgtattgttttaaagatctcaaggagcttccacatggagctgctcatttaattcagtcttcatgatcacactgtgatggttttcatgcatagtttacaggtaaggaaaccaaggctctgtgaggataactattagttattagtctactgtgttctcacagctgagtggcagagctgatctcaagtcagattatccttttcccaaactgcaacaacctctttttatataaacttccttggccaggaatctccacatatattattaatgaattttgtggctagaatagtaaaaattcacatcaccactggaaaaataaagcttgagtgtgaaagaaatacagagtgaagtcaattacatggtactgctttaatatacagctgcatatttctgttatagcaatctgaatatccttttaaccttagtttcactttggctttgacattgtattttattatatgcaaactattgggaaacatttattcttaaaacaatttttccttctttcctaaatagcccctccgttgctttttttttttttttttttttttgagatggagtctccttctgtcacccaggctgaagtgcaatggcactatctcggctcactgcaatctccgcctggtgggttcaagtgattctcctgccttagcctcccaagtagctgggattacaggcatgtgccaccacacccggctaatgttgtatttttagtagagatggcgtttctccatgttggtcaggccggtatgaaactcctaacctcaggtgatccacccacctcggcctcccaaagtgttgggattacaggcatgagccactgcgccaggccccctcggttgcttcatccagaaataaaagacgggctatagctgactgctgatttgggcgatatgtgttggcaatattgttgagttccaaatacttttatatataaaagctaagtataactaaaagataaaatgtttaaatgcagagaaagatcttacaaaaacaaaatgtgtccacaatgcattgcagagtttgttggtttaagaaatgcaaacatagaaagtgtttagaaacctgaccataaaatgatgcaagtgaagtttttgttcctacaataaacttgagtcaaaagagcaaacaaagatatctcataaggttgctcaactgtaaattctctgagagatttttacacctgagggagaagttgagtattttcactgacactttatttcacccaccttgcccccacaaatttgttctcaacaagttgttgagcagtattggaaaacctaagcattttttaattgacaaaatctgatgtagtacattttaaagtgcagcaactgaaacgtctgtgaagcaggttaagttaacattgtgattgagtcctggaatttagaactaaaaggaacccaaatgcatgttttagggatattcctttgtcgacgatcaggaaaaacttccttctccttgctaggatcccaaataattcatagattaattttataaggcatagaaggtttagaacctggaaaagcaatgtcagagcagtttttcatcagcatcatttttattttcaaggaaacattaagtgataattgggcagtgtccatactggtttgtcagctctcttacgcatgagatttcctcctgtgctctatttcacatactccaggagtaaaggacgtccctcacacctctctgccctcagtctcccccacccccacccaatcatttcactatgtataatacatcaaaatattatgttgtacatcttgaatatacacatttttaaaaagaaagggccacaatgcagcctcctcactgcagctcctctcataaggtgtcctgtcttcctctttcatatccaaaataattcattgtaatgacacgtgattgtaacttgctttttcaaatctggggcactgagaggcaggctgcttctactttccaatgcaaatattacaaattaggctggtgcagtggctcacacttgtaatcccagtgcttcgggaagctcaggtgggaggattgcttgagcccaggagtttgaggctgcagtgagctgcaattgcaccactgcattccagcctggttgacaaagtgagaacctgtttctgaaaacaaaaaacaaaaaaacaaattagcaagcacccccaaattctcataatatagatcaggattggagggctacaggatatctcatgcattcattctctctccttgaatagattatctgttcttatatagctcatgtggattatgatttatgattatgattattattttgagacagagtctcattctctcgcccaggctggagtgcagtggcacgatctcggctcactgcaagctccacctcccgggttcatgacattctcctgcctcagccttcaaagtagctgggactacaggagtccgccaccacgcccggctcttttgttgtatttttagtagagatggggtttcaccgtgttagccaggatgatctcgatctcctgaccttgtgatctgcctgcctcggcctcccaaagtgctaggattacaggtgtgagccactgctcccggcctcatgtggattatttccttagcactaaatagcccaaatctcataaaaccatgtggttttggatgctatttgtcaaaacttcctgctttcctgatgaaggagggattggtaggcgataaatggttccaaacatactcacctgtgggtctggattgtccaaagatcaacctagtatagcttccaaactgatgctggaattactctccacagatgtttgaatattgagtctctgccttaaatgctgaagttagtggaccagagagagagctcattactttttaaagtgtctgttcacattcctggggcagtctcttgacatcacaccattaactcttctgctatattgtttctccagttgtcttagctttgttcccggagtcagccaagaaaacactgtttattttcactttcatacattgtgacctgtacatttattttttactgtacagactctttataggcccttttgtaaagtcccacattctcagggaatgtgtcaacattgaagatgtctcatataccagttactagaatcatgttaactttaaatgaaatataattacttctgcaactgcagagactaagatgaaaattaagcttcaagcttgaagcaaatccatttacacacactcttacatacacagactcacacactgccctgatgtttatcgccactttgatttcatggtctgtggtctggtttgtggcttccaaaattttacattgctctggggagctcgtccttgaagatacttagctttcttacttgaatacttcatataaacttttgctatgtgtgaggcttcccatttatctcattatctccccagtactgtgactttttaaattaaaactttctgttcgacagttcaagaattttgaaataacaagatatgcttggtataaaagatgaaccatgaaaaatttcagttgaaatttatttaatccaccacttcttcactcctcatggattctgatagtgaattgaaaagaaaaactccaatcatgcaattgttttccatttcattgagatttggatattacccactgagaatgagaggtaattgtttttaatagcagtgacaaaattcattttcatttactaattaaaggcatttcatttactaattaaaattcttcccttgatttaaaagcaaatgtgaacggaagttgtgaactgttttttttatacatttgatctccaggctgaataccggctttataggctaagctacaacaatgggatattttaaagaagccacgataattgagtatcatttaactcacttgttagaggaagttcgctcccacttttcttcttgcttatagttttgtaggggaatgtccatatatcacttcctaagaaaacatcatgaggataccttcagcctttttccttgttaacaaagtccttcgaaggcgttgtttgtaatgaaggaaaaagaaacctcagcagaatgcctcacctgtatatgttttcatttaacagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaaggtaaatatatatttgagatttttttttctctcccatatcataaataggatcactagcaccatgaaattgaagcactcaggtgtatcaatgggatgatgtgcctttctccccaaaacagcactgttctcagctctggggttacagtttagtacaaaacaaagtcctgcccttgtggagttcactttctagtgcagaaaaggaggagtcagacaatacacaataaataaataagcaaacaaaattaagatatgttatatggtgtgaagtatggctgaggaaactaaagcagggaaaaggaatgaaataaggggacaaggccgggtgctgtggctcatgcctgtaacccagcactttgggaggctgaggtgggaggatcacctgaggttcggatttcaagaccagcctggccaacatggtgaaacctcatctctacaaaattacaaaatacaaaaaattagctgggcatggtggcacacgcctgtaatcccagctacttgggaagctgaggcaagagaattgcttgaacccgggagacagaggttgcaatgagccaaatcgcgccattgcactgcagcctgggcaacagagtgagactctgtctcaaaaaaaaaaagagagaaagaaagaaaaagaaagaaagaaggaaggaaggaaggaaggaaggaaggaaggaaggaaggaaggaaggaaggaaagaaagaaaaaaaagaaagaaagaaagagagagagagagagatggggacaaacgagtggtcattctatttcaaatagagtggcaaatgaagacttttccagtggaggacattgagcagagaactgaaggaggtaacagaatggtccaggcaaagtggaatacaagggcaaagactccaaggagtgataactcatcattagggttgtaaatacacaaatcaaacaatatagaaaaacagaagctagaaagtgaaaatgatcagaaattccacggtcaaagaaaattaccattaacacaatcagacatatcccctcagacatctatttgaacacttacatatacatatacaagcacatatatttttacataaatgtgatcaaaactacaaataatatcttgtaacatacttgtttcatccataaatctgttacatgtatctttttatgagtactaatatttttcaatatctgtctactattacagtggttgagatgttttggatgtttgtttccttatatccttagaataaattcctagaaattaattgttaggtcaaagggtatgcatatttaagattttgaataaaatggacaactgccaaacagaaagtcaatatgattttaatattcattcctattaataatgattcagagagcattttctctgcatcctctttaatgctgagacttgttgatttcataaatgttcttttgattccttctgataaatatcttctcatatattcattggccttttctgttattcatatccatgttttttgctgttttaaaaaatgatggtttaatatttttcttattattttataagaactttctgtgtattagagttattctttttccatcccacatgttgcaaataatttttctggtaagtcttttggtttctaaccttgtttaagatgtatgtttattttgtttttgccatgtttagtcaaatatatccaactttattgattctgagacatattttaatattacccatgattataaaagcattgctagcctgtcatgcccccaactatttacaacattcaggagcagattttatatttcttaacacagtactcttctcagatttttttgttttgttttgttttgtgacagagtctcgctctgtcacccaggctggagtgcagtggcgctgtctctgctcactgcaagctccgcctcccgggttcatgccattctcctgcctcagcctcccgagtagctgggactacaggtgactgccaccacacccggctaatttttctgtatatttagtagagacggggtttcacagtgttagccagggtggtctccatctcctgaccttgtgatccacccgacttggcctcccaaagtgctgggattacaggcgtgagccaccatgcccggcctcagaaatattttttaaaaaaccatctggcctacatattagggaaaaccagtataggtcaaggcacttctgacacaaaaattgttttttggtctaagacaatgtataaagaggagtagcaaagaaggcatggaagccttttcttacacaggaagtcatcttcagtttgcctcatgacttttatttaatgcttactatatgtcagatcttgctccaggcacttcattagcattctcatttaatcccccacagttcccacgccagaattaccagacactttctgaaaacctggaaatttcttattcatgatgtaagagtagaagtaatattgatggtcgtgataaaaatttgctctttagtgtcattgctacgtatataaatgttttctgctgtgttttctttattttattaacatataaaccagatgtatttgatataactgctattctggcagatatcaatggttactaacatgttcatttacatacttattcaaatgttgattttaaatgcacatagcatcagactctgtcactacctttccttatggtacagtcctccctgtcaactcttattctttgaaaaatttggaacctagcccactgtgtctatgtattctcactctctcgctctcctccttaattctgacatcttttttaggtaatttcaatattcatgcaaataacccatgcaacattcgggcctctcagttctttcactttttcatatccaacaatctttcctcaatcccattcagccactcacgccagggtcataacctagaacttgccattaccaacaacttcatcccctcaaaatcagaatttcaagcttactattctctgatgcccaagcctactcccactggtacgatttctgacaaccttctgatggcaccgagacctccaaactatggacattactaccatttctctcttcatcgggcccaaagatgctttaatttctatgggtccttcattataatcgctccttgcacacgacctcaattcctttttctctctttctttccatttacttccctgcaacaacttactcgagtgaagttcaatttttcgtctacttcacacctttacctgtgcagcagaattaatctcttataaaattcatgaccactttctactggggcccccagtaatgtttctgaggagattctctcacattcttttcctcacatgtcaaacacccctttttcttctctcagcttatgcccttttccatcatttcataaagaaactagaaacaataagatgtgcacactcccaacaccaaatctaccaacttactgcatctctacctatataagttggcttcctcctattaccggaagcaatggttcccgcttctaatgaaggatgacctctctctgctagtgcagtggattctatcccctcagactgaaaggttttactccagtctgtgtcctttctctctcctgaataattagtttaccctccttatggaatcattcatagcactattatctactatcttaaaaaccaaaatcaaacacaaacaaaccaaaaaaattgttttcctcgatcctaaaggaatcatctatattcattgtctattttaaaattaaatataaaatatttactaggtataagaacatttgtgactaaaacatgtttcaaaataagcacaatttatcaaaaatctgtccctgcgattggctaatgatcaatataaaaaacagtaaaaaacacgcccagttgcagtggctcacacctgtaatcccagcactttggaaagatcagcacaaccaggaggattgcttgaggccaggagttcgagaccagcctgggcagcatagggagacctcatccctatttaaaaaaaaacagccaagtgtagtggcttgcttctgtagtccaggctactcaggaggctgaggtgggaggatcacttgagcccaggaggttgaggctgcagtgagccatgatcacgccactgtactgcagcctgagagacagagcaagaccctgtctccagaagaaacaaataaacagacagacaaaaacatcaaatatacaagaaaagtctttctttgaattcttagtccacatttgtatcaaatggactaagtttaccttatatgaaaatgttgccaatttaaataatctgctacattggtgagtcaaactagccccgctaaaatgaatgtcattgatagctgtattcttatatattttctccaattcttttttgtgcttttactttttgttatttttctttacttgtttttggcttcctatgaaactcttataagcagttctcagaattggtgtcttagaccatgccaggtaaaacttttccattatggtaacatttatggtcgtttatttggcacatttggcttttgctctcaatactgtgaattacaattctcaaaattctaactcacattttctaggttgttttatttgaattgtttataggttgttgatttttcacactttgaccttgttatttagctatctttcaatgctgtctgctctctgccttcctcattgtggactttaatttcattctattagttctctccactaaggtaatagcaattctcttaaggttctcagaattctcatgtcagatctgcctttttcccacttctcaaaacttttaacctttgattaagtaaataaatgttcgggtactcatatgactcttatcagcgtttatatgagtgctgaggtagttagttgacaccaccagttcattcagttcactaccttttcaatgttcgttagttctttcctgttctcacttcccttctggacatttaactaccagtgtctttgagcacaaaccacctgtcatcactgtcaaaatgtgtagattaacacatacagttttcagataactatagcaataatctgtaaaccaagcttagctaaacctggggcaacataaatattttacaactacaggttaagctaggagagaatttgggtatcatcggattcatcatcttttctctatacaaaatcaaactcagaccactcccagtaaaaacaaaacaaaacaagtcattttatttaagtgaaaattggatgaaggaagttgaaaactgaggaaagtaccagaagttcctggcttaactgagtcaccttgtatgagtgaatcagtgtacaaatgagtgattagatctagcccttgactgacaactgttctgtgacaatcgtgctgtaaactttaatcttaacttcaaggcttttctatgtcagacctttaccgaactgataatacatcaaactcagcagttacacatcttctttaatagcagcactgtgagaggttttgcaaagaaggcaaacgttatccacatcagttagtgttgaaacatttagtgggaaaacaggttctagttatttattatccaaacagggcagtgagagatactctatgtttttggctataagtcaaagtaaatcaaactagagtagactaatctaacaatggaaagggcaaaaagtgattgaaaggaatagctggaggaatttgagtactgtacttatttttatttttctttgttttttaattattttcagttgctaaaattcacatagtgcaaatctaccaaagatctcaagggggctatagaattcctcagctactcggtttcctcccctagaggcaaactccattaccagcatctttttacccatccaatgatatttcaagtgtatgtgtttgaatgcacacttggtagattttatttctataacaagaaagttatgtgtatttattttgaatttactcatatttggtttaatcatgtgccttatgctcaaaaatttgtgttttctaaaaaatggtttaaaatatatataattttgtattgacaggaattcagttggaattttctgttaaaattttgatatactatatggcaacattatataaataattttcactagaaaaaatatatagaggaaaataatcacctgtagtcttgccacttagaaataagcacaataattattttggcttattgtttatacaaacatactgaaatattttctggaataggaattataccatacacagttgtccctcagtatctacggggcactggctccaggatccaccaagaataccaaaatacatggaagcttaagtgtctgacgtaaaatgcaatggttacatttacacataacctacacacatcctactgtatactttaaatcatctctagattatttatggtacctaatacaatgtaaatgccatctaaattgttgttatactatattgtttagggaataatgataagaaagagagtctgttcaatacagatgcattttaaaaaatattcttgatccacagaggactgattccatagacatggaactcaaggattcagagggttgactgtatgccattatggaatattttcccctgatgacaactatatatttacacattttattttcagccacaaataacaaatatgaaattgaaaatttaaaaaaacttattaaaataagggaccataaatttgatgttcatgctctctctcaattcagagtccttgaatgtaaaatggtgcctattaccagtgttatcagtcatacctaggttagcagtgggctgtttcaatgtcaggatggtggggagtatattgagcaatggttctgtgtgacatcctacaaaatctctccctcagggtccaaagtgggtgaggaaagccctgggatagggaaacacaaaagagagggagttagggagggaaaattcttagctggccgctttttcaaaggagcaagggagggaaggcactccagggctcaggcattcagcttcctgcttgtgccccccaccccaaaccaagttgctgtagcgtcagccatcataccaaccctgtcagagaaggctgcgtgtgaggagggctcaccaactccctgagaacacagtatagatccaagtatccctgaaaggagacagggaggaggggaatatagatgtactataataataaaaatactgttcaaagaccataatacaatgaaaatttatatataataaagagatagccaaagtcccattgacttcctatgcattttaagctatatttactgctaaagtattcagtgaaacttgtatatccctttgctgtgtttttcatggctcttccttcaccagagtgagcccattgccgtcctatacaacaggaactgcagcttcagcacgtcatgggaatcttcctgagttccatatcctgccctctcttccgatgtttttagctggttgggcatccctggtgaccgtcatgacacctcaaagctaggttctacctctatatccagcccctggctgccttgctgtggaacagcactcccagaaattatacagtgcatagcggctctgcagcagccctgatgcactgcttactcggctctaaattttagtgtcactgcctagatgcactctctgagatgaccctcagttctatctgaatactctcaccacccttctctcccagcccagctcctcagacccccaacttgtccataacaggaattcagacaatgaaatgtaatgaaattttgctactttcattgagcagaggacagaattactgttacagtagctcactgaaatacaagataaaaggaccaaggcaaaaatattttatctagtaattatcaaaatatagccagttttcctagatagataggtggatagatagataaatgaagcttctcaaagttatttgctaaaattttgcccacataacaaatagaagaaaccagatgtaagcaaatatctttgggaatgaattttcgatggtcacagaggactcttgtcaaaattgttttctccagctgtcaccttcactaaaagacatttactgtttccaggaagaatggtctttcatttttgcttaataggcaaccatggaattctctctctctttctttttaaatcacccagctacccttcccatctctgttcacttccagaattttctgattgtagtctgggcctgaaaacacatttcatcttggctcactgaccacaactttcttaaagttggctactctctaaaactctgtctcttccatgaaattgccctgaactcagtggagttaaggtattgatttctcacagacatgtcttatttatgcaaacaattgccttatgccatttataatatgttctaccccacaacatcaaaatccaatgcacacattctattgttttgcaggatgttagccttgggggaaacttggtaaagggtacatggatctctctgtttcaattttttttacaactgcatgtgaatctacagttaattcaaaataagaactttaattaaaaacataatgcccttattttctctatcttcctccctttctctctttaaattatccttttaaatacacatgtaaaattttacatgtaaggataaaatttttcctctgatcctttaccttgtttactctcccaaactttccaattttttttttaatatattgtgttttcagaggggtagagactacgtttaagaataagggtacacattcggttgtttggaagaaattttatgatgtataaaacaacctcctatgtatcttggctgtttctcacgctatgcttgaaacaccagaaatccatgtaaactgtaaaacaaactgatgaaaaagccaagtccctttctccacttccatctcctattcgatccagccccacccactgtagagtaaggcagttcctgaggtcaaactcctcagtcacaagacctcacagactttagtgagtacagatatccaaaccaggctgataattccaaagtaaaagatgccctaaaagccagagaaaaacagggattttgttcactacattaaataaaaatctgagaaaaccagagcaattcctgccaagtataattaagatgctgggagaaatgactcaaaagaaatatacctgcctttctcattctactttgtattggcctttctgaactaaggtgctgacttgaaaatgttatactcttgctggaagtctgctttaactatcaatacaaatattcttcaatcctttacaaataccgattttcatgaagaataagatacattacaacaaaaaatcctgtaatctgtatgaccaggttagaactccattttttttttaatcaaagacttgattttcacactttctgtggaatcctagcatttattatatagtctgggccattgtttctccataataaggccagatacctgaggtctcataaagtcagaaaaaaaaaactcaataaaatttttcttgattttatgtaagtgtgttaataagggcagttcctatgtgttggaggttaaaaatgtgaaatgttaaatttaaaaataaaagtcacagtgttgccagccacaatgtgactgtgttaatacataatatctaactggcctctttctcaagtactgacactgagtcatcacacttcacttactttcccattttcccctggagggacgtttctgttttgtcaacctggaaaacacatagtttgctgtcatattggattcagatttagttgggtatgaaagtgatacatcaatattctagtatgtgaattttctttttatgggaaggaaatctcttatctttgcttgttcagaaagtctcaactcaaaaaaatgaggcattcatttttatccttgtactgtagttttatgatagaaactgtcctccttgttgttacatttataagcacctcctaagctcctttttaggacagcttcagtgctctctaatttttataatctatagtccagatcgatcagaatctgctggaccaagtgaggataaaaatgaatgcatttcccaattcagtgcaggatttgggatgcccagaattgaaaaacatagatgtgttaagcggatctgttttaatatccagaaaagtcatccctcagcctgggcaagatgatcttgtgctcattactttacttcccagaatggagatgatgcataaaccacaattttaatttgcttttttttgtgcatgtgtagaataagcgacaaaatttcagcggctgtgattattataatattgccataaacctctctaatgaaatgccagcaatgttgagacagctttattcaggcataggtcaaaatagccatgcatatcagtacagggcgataaatcctggactccaaacaataacactgggccagaaaggaagcagatattaaggaaacaattattttattaatatgcacttatgtaaggcactttagacacaggcaaggtagatgattacatgagttaattaactaattaattttaggtcatttagagtatgtaaggacatatgaaacacatttttgtgtcatcaaaaaactaagaatcccttgtgagaggcctcttatagctatgagaagataacttgtaatgcaaagtgataattgataagtgtagacaataagtgcaattggagttcagagaagggacagatcacttccagacagattaactgagctatatttcatgaagaatgtgatattttagttgaatatgcaaattaaaagattaaatgtttgtcaagtgcctattgcatgcagtgcctgctcctgagctctgcgtgggtatcaagaaaatttatgtcacagtcttgccctagtaaagtctataatgtggccaagaaaatgactcataaacatataaaacacaaataacaatcaaagatctatttcaaggcaacgctagaagtgatcatgacagaaggcagtcatgattagttgtgctcattagttatgcaaacaattaattgctttagacattagcaaaaggaggcactcacttccctgacctgttggcagcatttgacaaaaacagtgccttctgtcttccaggactctacacactctttgttctccccctaccactctggctgctgcttttcagtctcctatgctggttaatcctcatctataaacactaaagtaattgagggctccgcctgtggtcctcttctctcttttgtccacattagctctgttgcaaatctgatgtagttcatggctttaaatcccatctacatgctggtgattggcaaatttttatctccagcctagacattttccctgaagtcctcctttgtttctccaattccccactcaaatctctacttaattgtctacaagccatctccaatttaacatgttcaaaactgagttcctaatttcctctttaaaactttctcccttgtattctatctcatctcagaaaatggcagctctaccttccagttgctcaggcaaaaatccctggagtcatccttaactttttctttctcttaattcccatatcagatcgatcagcaaattctttagttctgccttcaaaatttatccagaattagaccatgtctcatctcctttcttacttccactctggttcaagaacctatcaataacctcctggatttttacaactgtcttgtgacccatctttcttcctctaccctgtttcaaccaagcagccagagtgatccttttaaaatatcagtcaaattatgtcactcttctactcaaaaccctccaatgacttcccctctcactctgattaaaacctaatatactcatgatgacctacaaggtcctacaggggctggccctcattctcactgatgtcatctatttttaccttctgacctcttcactctttcttgaacaaaccaggagcactgctgtttcaagctctttgttcttgctgttttctttgccttgaatgctcttccccaaaataacttcatagcttgctacttcatgtccgtcaagactttactcagtaaatccttccttcaccacctcaatctatcttagactggattcctcagaagcagagcctgataaaaggattttagatggtattgatttgggagatgataccctgaaatagcagtaagggaacagggaaatgagacagagaaagaagacaatatagggtacattaatgagtgggttaactctgtggccaaatagggctcatttcccactgggagcttggggaggctgtacagaacacattgtcctatgggaggagtatttaccctcctcaattcctgttagacattggctaagggatgctcctgggggtgttaattcctggcacttctaaccttgcctgtgtgtaggcagagcaggcatcagcggtcagagaaagcctttaggtagaaaatcagagatgcttacaccagaaggcccttcacatgtccaagaatattcagaatcaaggagatataagtaaggcattgccagtgctgcagcctccccaaaattccgtatcttccttttgctgtttttgttttatccctataacatttaaccctatatttaatacaatatattttccttacttatcttgtttacttttttcctttatgaatcatgaattttgtctcatttgttcactgctatatccccagcacctaatacagtgctttatacatgagcagcaataaatacttatggattgaaaaagaaatgagtggatgaacaacttcaggatgggtaagtgatccaggaagtcttagagaagggatgggatttgcactgagtaaacattggttaggtggaggcagggtcaggagagcagcccagcagtggagaaccacaggagcaagagtaggtgagctaacatagggtaagtttaaaaatgagttaattccttttgatagtagcagatggtccttataaaaataaaaataactggagtaagacgagataggtcttgtccaggcaaactgtcagactgaggaatttgagatcttttctgtaggcaactgggaagaaacaaatgttttaaaacagaggaatttaaactgtgttttaaacccaattaaacacgttttaggaagactaatctgaagttattagtaagctgatttggggaaataggaaataaaaatgagtgtagaagctttttcagaggcagaaactggggcctgatagagttttacaaagtgactaagaaaaggctaattgaatgttggagatagtgtggttaagctatcaagatcagggttagggatgacagaggggagagcctgcattgaccctaaggtctagagtctggaatttagtggtacagctaatagatgatgcacccaaagaccagtccccactccagggctcacgcttgtttccatcatcctgggcatacccagcaaaatccaaactcggctgagttttgagaatcttctggaactcaggtgacctaacattgatttgggcaccttggatttttgacaaaggtagttgttcaaaaaaaagagacaagtgagaaatttttagcaatttaaaaatgttcccagaactggctctgcttcctaaaatcagcactcactcctgctcccttccttatccttattgtctgtggttcttgggattcatactgcagcttaatgctgtggggagcatcagtctacctagtagtgcaaagatcccgccctgtctccagataaggactctggcagtcccatcattttacagatcaatgaacatctgaagcacttgtctagtttgggaactgcctttagcagctagcagtttggtcaaaattcattccacagttttcctaaaaacaacaataatagctacaatatattgagtacttattaggagccaagcattattctaaacaacttgtttatattagttaatataatcctcccagcaacttatgaagcaggtttaagtgttcctagttgactaatgaggaaaccaaggaacaaagaggttaagtaacttatccaaagtcacacagctggaatgtggctcctccttgacacctgctcaccagccagctcctgaccctcgggaggatgggtgaggagaggtaagggagggggaaggtgtacttgaactggtaccatcatagactagctttacattctttggattttctagatataataatgtggcactcttacaggtactttcctggcctttttcaggctattcccatgatggtggtgttggggagattctctcttgaaagccactagatccaattgcatctgtcccagttggtgatttgcaactctttcctgagccccgaggcatccagagtgtaccttcatattctgccattcagccttgcaggcagagtcatagatatgtttatactagcttccacacctcacagtgtctgcagctggtccataggaagcattcaagcatccctgacccccaagaactgtgggagtacagattcatcccaacatagccatcactttcctactgccacagctcctttaggtttctcaggtatgagctcaacagaggtgactttgaaacagttcactgaactttcctttgcaagttctgcatatggcaaaccatctcccgctcactttggtatctgatagctaagaaattgatgcctcaactgaaattcaggcaggaggtgtttgttttttaacctttttggtatgtttactatcttcatgggattccatggagacatcctggggaagaaaacatgatatggactagcatagtatgggccatgaaatcaaacagctcctggagtgccatgcggcaggaggcaaagcagaaaagaggtgcaaaggcaaggccacgaagagccccatgccagaagaactgacttcatgtgtgtggggaagggaaaccattggaaatttaaacagtaatgcttaacttagatgtcatgatcaagtgacattccccaagggaaaaaatgtgggaattacagtggtcaagtgattaaatcctggaaacaccagaatttacaacacagatggacttcatggatatttgttctatgttgtaccagtttcgtccgtaattcctgtgttactactcaagtctactgtcacacatctgcccaccacatctttttgagccttctgtttcagccttcttttttcctttcatttatcatctctaggaaatttttcttttcctttcttttgcaaaagcatttcctcatttttcaaattattttcagtgagttctagtttttattgtattattgaagattagaactttgtaattgtgtcattaagtctggaaaaaaatgggtgttaatgctaagtcatccctgatatcagtaatttctttcagatattgggcctaaaggatatggatgcttgttgaaaaagttatgagtattgctataagctctcagtttgagtatgtacaggaagaagaaataaacacacatgtacacacattcacacacaccctcacacagtgagtactcaagtgatcaaagcaaaaaatgtttaccccattcatcatgcccagccacaagcctttaaatataattttttggctgacatggatacattaaaaaattataaatttttcctataatctcactgattgttccaaaaagtttccaaattactttctctatatttcaacaatataaatcatagtgtttagtctatgctttctaaacaatttctgaaaagattacaaaatatactagccctccagctcaaaagacctattttttagcaggactgtttgtctttggaacatttcatataaaattcaaagtaggaaaaggaaggcaagaccaccccaaacctctgctgagtaacttcttttctgcctgtccctgtgtcaaggcagagaagagaaacaaaggcagagacctttagtcaactatttaccttttactcaaggataccaatataataactttgcttttctattactagtcaaaacaaattttctgttggacttttttttaattttaattttgattttaagttccagggctgttggacttcttaactcagggacttctcgagtttgaacccagcctctttctctggctttgactgttgcctctgtccttcctcacacacatgctgagatttctgttccagaactcccactcccctttctgcaaagggactaacatctctgtggctaatgtaggtctgtccacattagtatcttctggcctggaatgttttctggcagttatcaggtaacttaagcatttatctgcaagattagttaaaagacttgctgtatagctgtgatattgattcaactcatagtttgactcaattagccagtttcaaatccagtttcacagcaggaaatttcacacatacaaatcagcacttttgagaagcctgatgaaataatggctagtttaccctgaaacgctttgtaatctagaagccaactgtctcagtaaatgccatagtaatgagttaattatcctagcccagtggttgctggggctttctgccaacatcctttttttccacttgctgcaatttctatctcacaagcagtcctcttctcaacttccttactaaaaaataaaacaaaacctactttatcctctcagaatgtccccagtgagtctccacttctcaaatgtttggtaacccatggcagctttcttccacttccaccttactgcagtctcaatatcattgggttttgatggcttcagcattaataatggatcaatctaatttagaggatgcatccaggcctcaccaaaatgttgtgtgtggaactgtcctacagaaggagtagagggcaccaaggttctattagaccaaatcagatgatggccaaggagaatttgccctatattaattctaatgtaattactacataagttcagagcccagaattggggccctatttgaacctggatttactgcaaaactacaccaaatccaaacactgaagacttttctagaaacaatttccagaggatgatttggttggtggcaatcaccgtgacccttgaaagcagtgctgtttattttctcccttcttctacaattgttgtattaaatatatatgtcatgcacatatatatggaatttttaagttgtgtgattttgaccatcaaattaagagcccaaaaatatagttccaaattgaggtcagaacagcaatatccaattgacaattttaaatccattggttgtcagaagaaaaaagcaatgtttatttgttaatactttttaaaatcctttaaaaaattaataactttagctcagtgataatcatgagtgtgaataagactttagctaagagctgattataataatgaaaagcgtgatctatctagatttcaaaaatttatgaatggttaagtacattacagtatttccacaaaatgttaaaaatggtgcaattgaggaaaattactgacatgaacagatgttcatgttatgttgttaaggcaaaaaaaatttaaactatttgaagtatataattttttgtatggatgtacacacagacacacagagaaaaataatctagaaaaacatatctgaaaacattattagtggctatttctgtgtggtagaattacaggtgactgtattttctttcttttactttcttttgtctactcatccttaattttctacagtgacatgaactacttttataataatagcctaatttattttttcaaacaatgtttgttcctagacttctttacagtgttacttttagagatgttagtggttgggggtctgcaggacacctaagaaagtttggtttttcctccctgtgatggggttcaggccgattcatccagtgctcattaaacagaagcctataaacaggcatgtcgcaggtgtaaactagaggaagattggcttctgtcagcaaattagccagttataccaatggccaaactaagcaccccagtgtgcctttgcagataaaattaaggataaaattataaaatatccatgtaattgttttgaacaactagattggtaattttttccctttaaaccacttttgatctttgcatgcttattattcagagcctagtgaattgattacaaagaatattcatttttgactcctacaagagtaaatagatcatgtgcattgtacagattcaattcagttcaaatttttaaacttttactgagtaactctgcacatccccagaaccgtgttagacacagtagagtactcataaaggcaattcttagaggaattcacagttttgtcatagagacagataaattagtaaatatttctgataaatagaatagaatgggcttccatataagcagggagtaatacaaagcaagagtcatggaagtgagggagaaagagaggttaattctaactaaggaacaggaaatgtttcctagagaaagtaacattttggctacaattaaaagtgtattaatcttctttgggtcatagataacagaaatcaagttcaaactagcttaaataaaaaagacagtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctatttaaaaaaaaatgccataaactgggtaacgtaggcaacagaaacttatttctcacagttctggaagctgggaagtcccagatcaagatgccagcagattcagtgtctgatgagggcccgctttctagacagccatcttttagctgtaacctttttaatttgttgagtaacctccatactattttccataatggctgtactaatttacattcctaccaacagtgtgcaagagttcactattctccacatcctcaccaatacttgttttccttcatctttttaacagtagtcattctaacaagtatgtggtcatatctcatttgattttaatttgcatttgtctgatgatagtgatattgagcattaaatacctattgaccacttttatgtcttcttttgagaaatgtctatttagatcctttgcccatttttgtaatttaatttatttttatttacttatttttaatttttataaatatataaaacttgtacatatatgcagggtacatgtaatattttgatacaaatatacaatgtgcaatgatcaaatcttagtaattgggatattcatcccctcaaacatttatcatttctttttaaaatttattttcaaggatggtttcagaacatttataattttgtttgtgttgggacattccaaatcttttcttctagctattttgaaacataacaataaattattgttaactatagtcaccctgtatcttctttctttttttttaacttttattttaagttcatgggtacatgtgcaggatgtgcaggtttgttatgtaggtaaacgtgtgtcatgggggtttgttgtacacattatttcatctctcaggtattaagcctagtatccattagttttgcccatgttttaatgggattatttgttttcttactgagtagagctccttatatattttgcatattaacaccccttatcagatgtgtggtttgcaaatgtattctcttgtttcacaagttgtctctcaactctgattattgttttctttgctgtgcagaagcttttaagtttgatggaataccatttgtctatttttggttttgtttcctgtgatttggggtcatatccaaaacataattgcacagaccaatgtcatggagcttttcgcctgtgttttcttctggtaactttacaatttcaggtcttacgtttaagtcttcattttgagttgatttagtgtgaggtaagggtctagtttcatttttctgcatgtggatagccagtttttctagaaccatgcattgaaaagactgtcctttcccattgtgtgttcttgacatctttgctgaaaatcaatcaactgtaaaagtgtggatttatttctgggctctctattctgttgcattggtgtatgtatctgttattatgctggtaccatgctgttttgattgctatagctttgtagtagattttgaagtcactgaaaactacttaacattgataaaagaatttgaagaagacatggataaatggaaagatatctggtgttaatggattggaagaattaatactgttaaaatatccattctacctaaagcaatctatagactaaatgcaattcctattaaaatttcaatgacgtgtttcatagaaatagaaagacaaccttaaaatttatatgcaaccacacaagaccctgaagcgccaaagcaaccttgagcaaaatgaacaacgctggaggcatcacattacctgattttaaaacctagtaattatttaaatgtaatgggaactggctatttgaagtatatcttgcgataagtacttttgtaaagcaataaattaaattgccagttgaaacactggcctttaatctagaaccagaaataccatttgacccagcaatccaattactgggtgtatacccaaaggaatattaatcattctactataaagacacatgcacacgtatgtttactgcagcactgtttacaatagcaaagacatagaatcaacccaaatgcccatccatgatagaccggataaagaaaatgtggtacatatacaccacggaatactatgcagccataaaaaggaattggatcatgtcctttgcagagacatagataaagctggaagctatcatcctctgcaaactaacaaagaaacagaaaaccaaatacggcatgttctcactcgtaagtgggagctgaacaatgagaactcatggacacagagaggggaacaacacacactagggctgattagggggtgggttgggagaggagggaacttagaggatgggttaataggtgcagcaaaccaccatggcacatgtatacctatgtgacaaacctgcatgttatgcacatgtatcccatttttttcagaagaaaattttaaaaaagaaacattagcctttaatttttatgttttgtaagtctgaattattatatattgacttgacttagaatagtgtgtactcagactgtctttttttaaaaaaatgaattttaatccatttaaaatgtaattcaacttaagcttttagaacattacctgtttccagtgaatgattaataaatataaatacatgcttccttgaatttatatcagtaatcataaaatcatctatcagttttaaaagtctacgtgtaccagacatttgtttgttccttggcatagcaatgattggatatgaattcattttatgattcacagaatccccatgggctcatagtgatatgggcgtttgaaatcaggccaattgatgttttaatcctttctgtccttcaggaagaagtggaattaaaatctatgtttttgttatttagtatttgtggcactaagctaagattacagataaaatgtagaattagatccttgccaaatggattcataatctaaattaaacagatatacaggaaactgacctcgggaaataaattgtaggagtgacaaattggtgaaaaactcaggaacaaaccaaaaaatctaaacagagatagtaaagtactctattattaatatttcctggtaaagaacgaaggcatagaacaaaaaggccaatttctgaatccagttctcccctgaacttcttgcataagtttgagcatggctcctttcttcaccctgcattattttctgtatcttcaagatggttcatcctttacaaagaagttggagtcatgtatgaaataataaacatgaaacacttcaagtttctcagaataaagtttccagagcaaaatgaaataataacagggatacactgtatgatttactgctgatagtttatcttataaagcaagtaaattaggggctgaaattttatatattagaaggatttatttcaaaaatgattttaagaaatatacaatcagtaaatttgaactaaaccaatttataaaactttgattcatacacaacttttggaaaacatcttgcattattcagagttattatacctttgtggatttaattaatacccaacacataaggcaattctttaggataagtaatgtgctaaatcagtggtactcagagatatattacatttgagccattgataataatgaagtattattaaatgacaacttcatgttaactacttaataataaattattaaataataacaaaaatccatgtaactgttatatgccttttaaatattttctgtgatattaaatatactttctaatatagaaattgaaaatcttgaacctctctagattacaagcaaaaaaccacatgtgccatctcctattaaagtgaatgatcagttaaggaatattttgtgacactggattaaagaccttaagaactaatagtggttacaatgtaataattagtatggaattatagacaatttcagaatacataaaactagttttttaaaagttgtctaatcctatattgaaataaaccactgcatataatcatatgaatttgattacaaatgaggctgtgggttatcttgaggacaggatgaatgatgggaaagtgaaaaatttcccaagatggttgaaagacttgtatacagcaagaccatattgcataaaaaataactgacatagtcaccacattttgaaaaggtgccatgtgaagtcatgcttccacattcaatgacagaatatccttaccaaaataatattggtatccaatatggagaacagtggatgggacaatgtcaaaaaggaatgggatcaaaagatgagcaggttgctttcttccttaccccttgaatagaccccacacacacctgaagaaactgagtctgaaataatggaaaaaagctgtagttgttggcctttgtctgcagaattcctccatgtctcccttttatatcccttgttcccaattcccctaatttctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgcatgaaataacaaaatataatgaatccttaattagtagaatatatttaatgatttccatttacatttatatcaagaaaaaaaaaggaaaaagcaacccagcacatctacttatcatcacttttcaaacatctgtggtttaaaaaacagctttgaaaatcgttacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatatatttattttcttactatggtaggattctcaaaaataacaacagaaaatataatttgaaaagtattgagccaaatttttatgctctccatttcttgggaatttccaagggaatatgtgctatgaattccttaaaggcagtttgcacttcgagacatcatacagtgtcatgtaggctaagagttttttaaaattatcgtttctctatttcacacttaatatacaataactcctcattacaaaagtactaaaacaattcaggagcacgtagagtaacggtaaaatttcctttcatatatccctccaatgccactgccttccccacaagtaaccgcttgtttgatgtagatctttactttgagatacacacacaaagactacacacaaacactttatgtctttactgattatgtctttgttaccttttatttgttagagttataaaaatgtcatggaactggtcttgtttaatatttatagagaaccaaagtttaatgaggaaagctgatcaaagacatgaaatatagtgaaagaaatgactgggtaataaggccagcccactcagaaagatttcttccacagataggtttaaattcaattgttctttgtgatgaaatgtccccaacaaattgtaaaaatatttcctaaaagaagaactctactcattaccacactaactcattagtgtgaattcattggctattcatttattaattcaatcaatgaatagttatgaagtagcagcatattcacaagatttggtactgtaccacattgcttggtatcaaaaggtgaaagggctcatttctctctttcaaaaacattcaatcaaacagcttcttgaattgaaggtgtgggtataatacaccatcaaagcagtttctacactactgcaaaccttggaggataaagaaaacatttctagatggaaactccaaggattcttgaagatgttatttgggcttaaagtatagattctatttcaacaatagggtccatgttgaggagaagattccaaatggaaatgacagcatgaaaaacaagtgtgaaacaaatgccaaatgccaagtgtgtttaggaaatgaagagtgatcaagctggagtgaaggacagatgtaagcaagaaatgagaaatgaacctgaaagtgcagagtagggactggcagcatttggaaatgaagtttggaatttactgtacaagtaataaagagccattaaaagatttctggcaagggtgtgatgagacacaaaagtttctggagagagaaagatatggtaggtctgaacagcatgcagaggaggaactgagtcctagactagtaaataggttgttataagtaatataggcatgtggtaataagcattgagactaagggagatacagtgaaaatttttaaaaatggggtcatttcaagagaaatgtagaagaaagcataaacaagttgttgattcatgtgctgaagtcaaaaacaattccagatttaaggtgaccatgtattgtggtttgtctagagcatactgattttagtgtattacgtaagcattcagtccactttagcatttgtcatggacttttcctttttaaaaattattattattattagttgcatcagaagaggttttataagacctttacatcatacttcaacttctgacacaatctcttttagtagagtgtaatgtgcagttaacggttctcactgtaacacatggtaaactctgaaacatagtccatctctcgtatgccaaccttttctagtctcaaggaaagttctatctttctttgaattgccacatgcagggaagtggctgattaaatgatgctgtttggatatgaacagctagaaactgctaactcctttctgtcctggtggttgtggatgtgttggatgctgcagaccccgccatctactgggtgtagcagctagttgtgtcatgacccatgctgggtggcccatgtcatgacctatgagaggcatgaagccatcgggatgccagtcagtggggttaatgggacacgtttttacagaatagatgtaaataaaatatgtatggaaaatagggcctgagaaatcatgctacagagtgtctagaggctcttgctatggtaatttggttacctattgcatgttatagattgacaactcttttacaaattttttggttatgtttcattctgaaataaaccttttcagaagcaagaatttaatatattcatgtttgtattagtcagttttcacactgctataaagaactacctgagactgggtaatttatgaagaaaagaggtttaattgactcacagttcttcaggcttaacaggaagcaagcctgggaggcctcaggaaacttacaatcatggcagaagacaaaggggaagcaaagaccttctccacactgtggcaggagagagagagcacgccaagggggaagtgcgatgcactttcaaacaaccagatctcatgagaactcactcactatcacaagaacagcaaggggaaagtccacccccatgattcaatcacctcccaccaggcccctcccccatcacctggggattacaattcaagatgagacttggcaggggggacacagagccaaaccatatcaatgttttagaaaaattttgattttctttatctcaagaaagttgctgagcctataacacacaaaataccatccatcaaagggtcctcaatgctatcattgaccatagacaatcagaagatggaaatatgctgaagcagcggcaacatctatgtcaaagtttagtcattatttttaaaagactgtgctctaagcaagtgattaaatgcatgcagctgcttaaggtgtgtttacatttcactgcatgcagcatggcttctcatttaggtcagacaacagttttcctagattaattacattcattttttaattctgagtttccttaggcctatgagaaatataaaacaatggttactaatgagttgacaccgttagcaaaagagtactgcaaacagttaaatgatgacagttttatatcaatgtgagcagatgaatcgaataatagtttcaatagcagttaaaattttaaaaattcaattcacagaaccaaagaaaagcttttagaagtttatcatgtcaatggtgaattgtctgaccttattataaatgctgtcactttaacttaaaaattaaacattgtgactgcaaatgataacataaatacaaatattagtggagcacagcatcatagtaaaacaatgattttattaaaataaaaatctatagagcagacgtgtagttgaaaatgattggtgtatatatgatgaagttgtggaatttattaattgaagtaaaaactgtagtgaaaatttgcatttatttttatatacacaaaattagagtgaataacactacctgaagaataaatttgatattgaattaaaaataatcttatgtatgaaactatacactctctttcctgctggtcattaatcagtctttggaaatgtttgattctttgaagcaccactttacaaatcaaccagagtgtcctaacatggcattggactatttttgtaaacaaggcctctgaaattgaattgcattttgttaaaaatcagttggaagtctttagttaaggtattcatcaaatggagaaaataacttcaatttttaatctttacaaataacaattattaaaaacaaaattgcaaataggaagacattgaaatgtatccctatgaaaacaaggagtaagtttaaaaaaaataagcaatgagagctcatgtataaaatatttaattttgaaagtccataatcatgctttggaaaatctgacttatgaagagaagcctttgatggagctcctctttagtaggataaagtaatattctgtaccagatttcacaatctacatttgggaaaatattccaaaattacaaatagaaacaacttacttggtgagttttattttgaaaaaaagagagagagaatgaaagaaaacaattcaaatggaagcaaaaagataatgcctataaaaatatttcagctcaaatatttacttgttttaatatgtatagtaatgagagtaaagcttctatttaccataatttcctctgagctcaatagatatttccttgcttataaagtattttctcagttttaaatattatggtttacaaatttcagtagtaaaataaatatgctgatattgaattataacccacagaaatatcaatgagttcttgctgatataaataaatgtggagaaaggacagctgtccattacagattttaattaataaatagagaaagaagaacggctgggcatggtggctcacacctgtaatcccagcactttgggaggctgatgtgggcggatcacgagaccagcctgaccaacatggtgaaaccctactctactaaaaatgcaaaaattagccgggcgtggtggcacgcacctgtagtcccagctactcaggaggctgaggcaggagaatcgcttgaacccaggaggtagaagttccagtgagctgagatcgtgccactgcactccagcctgggtgacagagcgagactccatctcaaaaaaaagaaaaaagaagaaaatagaaaatcaaattcacattacataaacaccacagtcaactattgcagacaaaatctactggttgatgctatgtttagtgggtgaaagttagaggagaaatatacttttcatagtctcaaaactttctccccaagtaattattaacctcaaagggaaaggtggtaactttacattgagaaacctagcagaggccagccacctttatctagagatctagagttaattttccttctctgacaatcgtattttgatatgtaagatgttaatattggtgaagctgggtaaagagtatttgaaaactatttgcactattttttcaacttttctgtaaatcaaaaattagttcaaaatgaaaaattgaaaactatgatttacagagaaaactcaattgaagatgttcatactttcagattcactaatcatagaattccaactttgaggaaaattacagaaaattttatttaaaaaattaagacaatggggccatatttgaaaaagaatcagttggagtctcattttaatatccttatcctttgtatctgggctggccttgcgacttgctttgatcaatgaaatgaggcaaaatgatgttctacaacagcattatcacttctgccttctgcttgtgaggggagaggcccaaactgcccagccattcaaagcaacacagccaaggcctcaggcttgagagtaaggtccttgtcagctggccagctggcccccagccagtccaccaactgacgggaaacatagaagtaaaccccatcaatgccagttaaatgctgcccaattgttgacccatacaattgtgagcaaacgaacagttattgtcttaagcttttaagttttggagtgattcttttttttcctgtggtaattgctaactaatacagattaacaggtgagagactaacttatttcaactcaaatggtgagggaaaacttgatttggaagtggtttttgagcttgcacttgaaagatttagaaaagtggagattgggtgcaaaaggctttctaaatgagaaatagggtaaaggcctcaaagcaagagtacaggaaattctgaaaaaggatagcagcagccctatgtgactggagcatagtgccgagaaggcctctctgagccaaacgttgtagacagaccaaaatgagttcactggcaatttccattactaaaccttttaccaaagcactttcattccataagataaactgattgttggtgagatgtttccaaaattatgttatcacaaatgaaaagcacaggtgtcccatttctttgtccttagatggcacaaataagagtttgtgattcacagctgtagtgccaaagggagaattttcctgatacctagataaactatgaagaaaattttactcaataataacactggagtttggataaggtttaagtttaaacacaggggcatatgcttgcagatctgagagctctgaggaagttgtctgtactgtcatgccaagatacaaagtggattttaaaatcttgacttaagcacagtgtctagataggaaatgggttttcaatctttatagatgggagtatgaaatgtggctcttgtttccacttagatggcagtgtagagtttaagaacacatgggttttaatatcaggttgacttgggttacatctcgttttgtcctgttgctagatgtgcgatcttaggcaagttacaaaacctaattgaacttcagtttcttatctggaaactggaggcaatagtacctatcccatatggtttttatgaagatttgacaaaattatgtgtacagaatgatagcccagtgcctatccctaattaatatccaatagatgatgttataaattattatcccaagaatattagatttactcatctatttaaaatgcctgattttttctgtatgtaacaagtgaataaaatgtgactttttcttagaggtcctgatcatgtttttcaaacaagtcagatttgctggatgtgtgtgatttctagatgcttccaatatctatgcatcttaatgattcatggatctaatatggtgacatatttttttctgtgaagggagatttaacatatcaagtgtcattttcacatttggtagagtgaacagcaatggcagtaattagtctccaaagatggccctcaatggaccatgcctcctagttcacattgttatatgagtctagtgtcatattgactctggactggccctctgattcactattacaatgtggtgaaaatgacactgtatcagtaattgggcccaagccttagaaaagcctgacaatttctactttcataattttggaagcctgccatttaaaaagttgagataccttactggaagtatcatggagagagacagcagatgagactatgtagagtgagaaagtggcacagctatcccagaatcccagcagaggccagcctcccagctgttcctgccaaggcactagatttgtgaaattagtcatctcggacattaaaacccagataagtccttggatgactcagcctgagtggatgtcaagtgtagcaaaagaaccacagagttgagcccagtcaatctacaaaattgtgacagaaaataaaaatggctgttgtttcaagatactaagctttgggatggtttgttacatagcaataaataacccaatagcaatagtcctcttatatgtgtttgcatattataatgtttcaaagtattaaaacaagactgtcatgaacatgcttgagtctactttactggcttacctcatgcatagtgcgctgagaatcagactgaaagaagcttttgataaaggaattgtaatttcttgtatgcattttcctgagggtgactctctccttggagagaaataatttagagctttctgttctttgaaggtgtagtaggtgatgcactgttgttctatagcagtgctttgttttcctaaagcaatgtttcttgtaggtccctgaagtagaaatctgtgcctttagcagtgagtttgtgagaagagtactagttgctgacaattcatatcataatgctgtgtgggagatactacattggagctcacttaaatgaatttttcaggattattattgtgtgtaagtgtgtgcatgttttactcaggacacaaataggcttgacctggttaattttggccaactgggactggttgggagggtcctagacctgcatacttgaatgtatgaggtcagtgcggaggtttgggggacacccagatgcaacagttggaagatcagaatgcaaatgttagaagtaataggaaagctgtccgctttggagaaaatgacaatggggaaatggtattttcaggatcaaggatacaccaatcctcacaagaaagaaaaaatcagcaggaagcaggtaccaggctgtaacatgggggttggacttccagtctcctgagcggggtgaatatgggtcccagtgctgctaggacttatttcttacaataaaaataaaataaaggtggcttagtaaaaagtcttacagttctgatttctgaggaggatggtaagttctaggatgctatgctgatggagcctgccagtggaagtcagtggcttagctgtgccaggaggagtattggagagttgaggtcagatttgaatggacctgcgaaaagtcacatattgcgcaggatacacatagaaatacatttctaaatcccaggaaggaatgtaagagtctgtgagttcctgaacactttcccagcctccaggaagctaaaatgagaagtacatagaaagagtaacaaaccttgaagttgcccaatagcctggaaagagcatggcctttgaagtgaaacagatccaagtcttaatcctggctgtcatcactagtttgatggctgtgagcaagtcacttgagccagtgaggattcagtttgccttcctgtaataaaaagctggccaacagggtttgaccaaaaaggggtttatttttctcacgtcacaagaaatccgtaactcacaagtccaggactagtgcaactgcttgctgctccttcaacctcttcccttcacaatgctcagcatgtggcttttgatatcatcccttagatggctactccatttccaggcatcacttcctaaagacaatgaagcaaaatcacctcttcagaaggcttttgtcattttgggggaatataaccattttcccagtgacttctacatatatctcattctattttgcacacatgttatttcatttcacatacatacacacacaaacacacctttgcacacacacttggccatctaaataccagagatttggggaaaggtcaatatttttaactgggtgtgttaccagtccaaattctatgcctttggaagaaggaagaacagataagtaaatagcaatggattccacatgcatttgttcatcttttcaatggggacaacaagactcccatggcaggaaaatatcaaacactgggcataacccctccagaatgtacgctccatgagggaaggaattcttgtctgttttatgactgttgtgtcaccagcacccagaacagtgtctttaataactatttgctgaatggatgaaattagagataatagtaagcgtgcagtgcattggctggcacacagagggtccaggaggtgattgttgttactgtcgtcactgagtctgtctgtggtcagtgtcattgtcaaatgtcactttcaaaagtcaatgtcattgccagagattgctaagtaatatagagcaactagctacagcagaggcaagctttctcaagagaggtatttactaacgtgagttaaatggaaaatcatggattggtctaagacagggttttcctcagtgttgtcaaccttacattaaaaaaaagttatgtaccttttcctgatccagccagcaaaactttcactttctcagagaaccaatgttgccttaagatgtcagttgttaaagaatcctgacctggagttaaagtatctagaagtcaacaaggttcaggaagacatcgtgagctatcatcaaaatatgcagctgtatttttaaatgttagaactggactaatatttcaagagcatctattccattactgagacaaaaacagtaagagctgatttgcccaatttatattagtaactctggacactctcagaagggactctagctcttccaaatataggccagagctttttcctctccaaacattgaccctctccacagcccactagcaccccccagtttgtcctgctcagctgctagccacctcccatggccagatgtactgagtggatgccaccttagcttcagaacagccccttctttgagagccccaccacaattatgacattgtcttccctggcactggacacagagatgatcacgacaggttcccatcctccactctgctcttttcctttctctgtttctctctttagggtccagctcccttcattggtccctcttcttcatctctcattccctcctaaacccaaccctctaaaaatgctattactgcatcaccagggacctcagaattgtcaaatccaatggacacatattttttctgaacttatcttacgctagtgcttctgaaaaaaaatttttaccagaatattcccaatatcaagagagaaatatcataagcctcaggaagtgtggagttatgatctgaagctagagccacaggcgtgaaataatttggaagtcttattttgtcgtaagaattcatgtcagttttccagtctactcttctaggaaaccagagtttttttcttcaaatttcttaataaaatggatactcaagggatacacttgttttaatcccatggctgcatgtcccacctgctgcctgtatttggtttgaatattataaccctagccagggtctcttgggtatccacagcagcagttttatcccctaggctaggtggaagctaaatgagactgaaggcaagggagtgtggcttctttaagcagcatatactctttcagtttctttcttctcacttcctctccttgttttatgctcccttggagaacagaatgaggctaggaaagaaagggagaaagtattcagatgatctggcatttgggctggcgaatctactgccttgtttagtcatggcagctgggctcccatccaaggaggataagaagaccgcggggagcaacccttgaacttggggtgaaagctgccaggaaagctctttcactggagatggcataccatggagctttcgctcagctgtgtgtgtcactcagggaaatgacagtcagaggcctgtattgttgcacccagatctcagaccttctttccagagagtgggccatctctaccctctgttcatcacacccccttctctgtattctaaatactctgccttgaccacaagttttatttagaaccacagataacttccttttgggatatatctcaggccataatttatacatgagattttaactaaaattatttttgtaaacattatcttagttggtttttagaattgaacttactgcatagtttttcttgttaatacaagcaacatccaactttatatcctccataactaacagttcatgtcatattttcatataatttttaaatgaaatgtaaaaatgggtagtatagagggggccttaactcatcaggatttctcccaaaatattttcctgtcaaagagaaaacagaacaaaacacagtgagtagattagaattaagttcagctgggagaaacagaaacaaaaacaaaacattactagcataataagacagatgttgatttctctatgtgtaaaagtctgaaggggatgtgttctagagctgtacggcagctctgctccacaaggtgctctgggatgcaacctccttccagctcacagctccactcaccaagaggtggctgttatcttcatggacaaggtaaaggtattaatagtatccaaatcctaggtagcagatggagacaaggatgaagacagtgtaaaggctgagccagctgcctcttcaggaaaattcctggacattgtcatgggacactttcatttatatcccactgtgggctttaattacatggccataccaattggatgggagggtgggaaatgtcattttgatttggggcagccaaaacttccatttctttagaagcagattatgaccatggggagacagctagcaagctctgtcacccaccccaccaacttagtcaatcttggcagtatttctcattattttgttcttgtccttcctcatgctgatccttctttgtggctatgccttctcaggcttctctgcagtctctttttcttctataccatcctcaatgttagtgtttgccaccatctggtcctcaggcactcttttcttctcactctgtgaacactctcgcatggccacataaattcatgtcttatactacccaatttttacaaacctacatctttgtccaagatattattttcttaaatcctagattaatatatccaatttcctaaagggcttcactgcttgaatatacaataagcaactcaaactcaatacatctgaaattaaactcgtcatctttctcattaaactctgttatgccatcagtgtctacacccacatggtcacttaaaccacaattctgggatatgcctggaatcatctctcacacatgttcaatgtccatttttttcctttcctctgcatcctccttgcttttgctttgctttagttatagctaacatctattgagcatttgcatgtgccagcccctgatgcaaatatattacatattttaactcatttaatctgcaaacaaccctactattattatctgcattttacagatgaggaaattaaggaacagataagtaactttcccaactgtcacacatcgagtaaatggtaaaaccagaatttgaacccaggaagtcgactccagtgcactctctcttaactgcaataactttctgttttagcccctcattgtttatttaccttattattatagaagactttcagtttgtttatcttcttcaatctcaccaactcctccccgaaattccatctttcatacgaataactaccagaatagcttttctaaaacacaatctggtcagttacctaaaaatccatcggtgcttcaccatcactttcaggtgaaagtttcacctccttaatgttgcacaaggcccttcatgatctggccccagcacacctctacagtcccttctggaacttcctcacagacatggtcccatccagccacactagatcattccaagtttctgaacagatcttactctccacacctatctccttgctttttgcactcactcagaggtcctatgtcaaaagtacactgttatgagtgttgctcaaagctccccaagggctgaataggtaaccctctgtactttatttacttttcacatagtatggtaaacggaagttcagtcttctctctctcccttggtgtcctgtataatttccttgaaggaagagttggttctttgtatctacagtacctaccaaagtgtttggtgcatgatgatcatcgagtaattttcaaaaagggatgaactaaggaacacaactgcttcttcccttttatggcattttcctaaacaaaacccgggacaaggagatcccttgaaaatcactgactttacccttgtttacttacctgcaggagaaattcatcttggagcaggatcacaatactataaaggccacctggtttggtgtggcacatgttggggctgcacgtgagagtatggaaatagaaagagtagcatatgtttattcacatcagtaaagggaacaaattgaaacataggagtcatggtatccagacataatatcaatattttgggaagttatttttaatgaagataactaaggggacttaaaagggtgcattttttttctcctttgcatggcgattgctttttggggatgccaatgcagaaattcttgggttgtagaatttttaaaaagaagagcacactagttttatttattttacaggattctggtgcctttgtgacaggcaaccacaagtgaaattaccttcaatggtcttggcttagtccctcctctgctcctaatcatcccctcaaacccacatacattagacagagcggttgtccttcaccactaaagaaatgcagccgagagttatgttaccgtggaaacagaatcactttttgctgcaagacacactgcttcatctgcactattatgaagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagattcttctgttaaagtaagagctataaattctttcaaactacaccactcctgttaaagaaaatgcaagagaatttacaattaatgggttcattgtgtataaagataagtgttttagctcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatccatatgacctacactagttgaaggatgaactctataggatatcagaaacaaaacaagaatcctgtgtccttcagctccaaagatgctcacagttattgagttttcttataggcccccagaaagcactactaaaacaaacaaacaaaaatcttaaaacacacacacacatgcacacaaacacacacacactcacatgtgtgcacattatctcacattacctcagagtctaactataagcatataatcacaggaaaatcccacatcatgaaaaggaaaaatattttattggctgtaaataaattagaaaagaatgtgatactttaaaagtgttagtgttttaattctagaggtagcaaagcaaccttaagagacaaatgacaattcttgagcaactagtcagtggcgggcactttttatatctatcaccccatttcattctcaaatgaatctcaatggctactattatttttattttgcaaataaaatgaaggcactaagactcaaataatttattttaaaaaaaatcattctccgattgtataattcatccatgtaaccaaaaacgactagtaccctaaaagctactaaaattttaaaaagtcattctcaaattccccacacaaaccctaaattgtttctgatttcaagtttagtgttctttccaagtgcatcacctcatacagtgctcagcaaagctctgaattgggtggctggggaggggtatgtgctaaaatccagggaaaaaataagaatacagcctctaattctgcctttccacctctagacaggacttcgggaaaatcatttatttgtttcaaattcagatttattcatcctgaattaatatggataaataaccttttatctcttcatgcaagtaggaagttaatgtgtgaaaaacatgttgaaaatactaagggcacttttatttctgtggaaagaatgacttactcctgttaactataataggtccagattaataggtccagatcactgtcaatctattcagccatcccaattaattcagccaccaaatcattattagtctcaaatctgcaatgttttgagagctgaccctgtcacatattgcttggatatctgccaaataatttctatagtgttgggttgagtagtggatgcataatacttatctttaagtaatgaagtgtggatcaaatcaaactatcgtccaatatctaatttagtcaccagttatagaccctatttcatcataataccaaaaaggattcattaaatgcctggatacaattagtctaagttgctttacgaagatacagtcataacctttgttcatggtattaaactgatttttaaaataatgatctattttattatcacatagaaggaaatattttatttctctaaactccattgcttgcctttcagagagcctcaggaaatattagtggagtaaatattgaaaaatacttacccagcacttgaaatttcaccttctgtgtctcttataaattaacaaaaaattgcttcattttgagtatttcatatgtatttactatactatgaactttacaaataccacctcttttactttttacaatgactctctaaaattgaatctattggtgtcatcaggtttaaagagtaaaaataacttgctcaagtcaaagtgccagtctgtagcacagcctgactcaaatccgtgcacaccaactctaaactgcaactcttttttttttttttttgagatagagtcttgctctgtcacccaggctggagtgcagtggtgcaatctcagctcgctgcaacctctgcctcccgggttcaagcgattctcctgcctcagcctcccgagtagctggggctacaggtcgcctgacaccaagctgatttttgtatttttagtagagacggggtttcaccatattggccaggctggtctcaaactcctgacctcgtgatccacccacctcagcctcccaaagtgctgggattataggcgtgagccactgcacctggccacactgcaactcttaaccgcaattctgcacatcaaccttgtgtgtaaagttgcctttgagaaaaccagctttcttttgctgcccatctctgataacttgttcatcctttgttttataaaagaaaaaaaagaaaagacagaaaaagagaaggagcaaagaaggaaagcagggagagaaggaaaaaggaaagaaaaggaaaaaaaaatcactcaatgttttccaccctccctgaataacctggggataaagtagatcccatccaagtttttgacacgagtcgacattgttgaaaataatcatgtgaagtgccagctttgtctgatgatgtcattttgcctttgttttgcatttatcaggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttca

SEQ ID NO: 1596 - DNA, 425790 bp, Homo sapiens
gcctaataatcatttatttttcatagaagatgagcacaacaggacaaaataaaaacaggaattgtgtaactggtcatcggaataaaagttttgtgctgctcagggattacacagtgttaaaaatattcaagaatgctgcagacaaaattgtatacgaatcactatgtatccttcctgattcatgacattaaaaaaaaaaagcttaaagaagtgtttgatgtttcaaaggtaatgatttcattacaatctactcataagattaaaccacaaaaactacatttaaatggcattaagggtctgaagtctatcttctggagaattaccaggtattacatcattctgtaatatagtgtgagtctgtggtatttgggtatcagtccattttacttaaaattacaaacatgtttttacactcatgtgcagggagcagttttttttatcatttggccacttagtattttaagtggtcaaagtctacaaagtatgccaaagaatatttcatctgtgaacctcaatatgcatagatttttttcctgatttagaaaagatcaaaggtgctaaaccttagtaaaactgtacatttatccctatgcaattttgtcatttaaattaaatggaaaaaaaactagttccaaagactgaatatgagtcccaatattatttatttgctgcagccccagcacaattttaagggcacattgaaacccctgaaaatagaggtttataatagaaatactgataaacctttaactactagaggaaggcattaacagattccaataaactacagtaacacgtaatgaatgaatatatagatgattctgtctttgttatctttgtcaaatccatgccatcttaaaccctaaccagtataaattatactttttctggctgtttttaaaatttttatctattattttaaaaattattttctctattttaatcaaacacttgaagtttttagaaaaagatacctatgttacattgcagcttcactttatgcaggctcatcattccattaaacaatatttgaagactcgaatcaatcaaatacagtctgtgatgcatgcattgtacctaaatttcctctaaccactctcagaaactgaaacaatgtctttgctcttaaaagagaagagacttcagatgtaatcaagaaaacattgtgtaacttgcctctaagctcttcagagccaattttactatggcaggatattccttcctgataaggtgattaatgaagtttttggtgctcacttttctctcatagtctataagctcagtataccaaaaaaaaaaaaaaattagataaaataaaacaaaacccccaataggtcttgaaaataatataaatattttgtggagtcccagtcacataatactccactcccaaacccagagaaaatgatcaaggtcttgtgagtctttctgagtccttcaaaagggatttgatttccataagccatgaattccatccgtttcagcacagagtatagaagagatgcttagaacaacagaaggaagagacatgcggggaagataattagtggtaaacagagaataaattctctctcagtagtgtgtacttgacgttaatgccgatgataattcatctgatctacagaatattcactttaatagagagatgagagtctgaaatgaccagaggaaaatagatactgaagccaatatagtcttgataccaaaataaaattaaaatgagaaactaacatgataggttcaaggccttttgggagcctgttttctttgccagatttcacattcttacagcttcatggtctttttcttctaacaaattaatcagctgagagaagctgtctttcagtgcatccatgtcatccagtgagcagggctgtagaatccagcgttttccacgtgcaagtggttcaagttcaaaatattttttgatcttaagaggaaaaaataaagataaataggttattaattatatcagaaactttctcatatcaaaattctgagggataaagtaggggaatttcgaggcggaatttatacgaactgtgatgcctacaactttgcaatgtggatgcctgtccgcagctgttgttataatgtgggttatatattgtgacctgggagtgttttctttagaggtgaatgatctgcgtgcaagccaccattccacccatacatttagcagcgtgggaggtctgatgaagtcagagaaaaaattatttgcactatggcaccagtcaagatacattgcagacaccaaaagattcgatttcatcaaaataattagcagagtagctttcactatctcaccttgccaacttattaaatgggtgacgacttacagtaggtactatattgattactcaagactcaattattttgaccatcaagcacataacacaacaaaaatctaatttaaataatcttcttctctttctctctcaaatttctagtatctgcttctgagacatgagagcgtgttttctaggaaagaggatagaaactgcatgtatgtatgtttgtatgcatatacacacttacataaatttacatatatgcgtaaaatcttctacctttttttttctttttcagtcctgaattttctaggatggaaaaagcaagaacttataataggtatgtgctgaaaaacctgttcaattaataaccagtcacaagtcactcttactatattggccagcatactgactaacggcatttagtattaccaattcctggctgtgaataaatagcaaattattatggcttctagaagtattgatgatcttctctcaaaaggtatcataaaacacaaagttcaggaagctcccgactcatacacactgtatcatacaaaagtagaacattatatttattgcccaacaaagttttacataacatcaaatacagttagtagcaacatcaaaagagacattgctcaaagatgttcttggttaacaaatttcgttaaatctcatgtgtcatgaaaaattacagtcttaccttagtcaatacttgacctagaaaaaaaagtatctccactttaaatgccatgctcaaatacggttttattttgccagtaccagtgcagactactgtttgttgacagtagagatatgctatccaaattggtattaatatgtttgtacattttttcatataagccagaagacatatatatctatatataagaaatactaagctattatgctaatttaggaaccagaaatatactaacattttatagtccaagtatgtccaaaaagtctccttatcaatgtctgaaagttcataataaacactaatttaaaaaaaaaacctgtgagaattacaagatcctcattaattctgattctgaagagtaatgaacacctcacttgcagatcagaaaatggatatacaacttcagaacaattttttgcccaaggtgttttataaatcatgttaagaggattctttgttgttgttgtttttctttttttgttttatttatttatttttttatttttatttttttagattagatagggtctcaatctgtcacccaggctggagtgcaatggtaggaacacagctcactgcagccttgacgtcccaggcttgggcgatcctcccaccttagcctcctcagtagctgggaccataggtgcacgccacaacaactggctaatttttaaaaaatcttctgtagaggtggggtctaaccatgttgcctagggtggtcttgaactcctaagctcaggggcttctgccacctcagcctccaaaagtgttgggattacaggcgtgagctaccatgcccagctttaagaggattcttgcttactgaaaacacaaactccattcttttagcttgttttctttatggcactgaaaactattgacatccaagacaatctgaaattcctggtgcaaagaccagtatcagggaccaacccaactccgcagagggaagaactgccagttagctgagtaggggaccattggccaataggggaaaaaagagtagggaggagggactggtagggaatcctggctaagtccacccttagaaggaggtgggggctgctccaaagagctgaaaatcagagatgttggtcttgttgcttctgccacaaagtaaggcttcaggttgtatcactgagctcagaaattgggaccactgtgcttacaatgcaatctagtatttgatcaataatgcttcccatcagatgaagtatgcaacatccaaaatctagtacataaaggaagttgtgtccctgatacatattataaacccaaatccaaaaggacagcattttaagtattgctaatgactgagaagagggctggtcacaagaaattcaatattaaaataataaataataataataataggaaggcatctcattaacaatacttcctctgggtggttaatttaaaaataatacggaattgatcccggtagcatatttacagctaatttgaaaacaatattggattaaaataatcacaaagtatatcagtaatatgtgatattttacaatacctaccagacataaaacagtgaagttcagctacctgttaaaggttggtttctaggcaactgaaaatatagtctatcacacaggcatacatggaagataatacaggtgtctgcaggtagacatgattcagaagttgttcctgctgaatactaaacatgagaaagaagtggaggttacagggacagagtggtcagcagataaaggggcctagtggtgttaagctgacaaatatggctgggtaattcaagattttcagatccatcacctaagtgggtatctaacactgccaatattcactccactggtatccacaggattccacacaactctacatttatggtatcaatttttaaacgagttttgccatttcactagtattcaagtacagtgagtgactgctgctggaacatttattagcttttcattacttggaatttcatgtttctaaaaacaaagaccacagtacagagaggagaagatgaggactttatgttctagttctgactgtttttttttttttttttccgagacagagttttgctcttgttgcccaggctgaagtgcaatggcgcagtctcggctcactgcaacctctgcctcctgggttcaagtgattctcctgtctcagactcccacggagcggagattacagatgcctgccaccaggcccagctaatttttgtatttttagtagagacagaatttcaccacgttggccaggctggtctcgaactctgacctcaggacaatctgcccaccttggcctcccaaagtgctgggattacaggcatgagctgctgggcctggcctaggataacatttttattttgttatcttatatcaatctgaaattcaaattttactttccctatgttattacagtaacaattacagtcacatttgaattgttcaccattgcttttttgtctttgtatatgttgatgtacagttttaaagaatagtgtttaactttgaacaacgtaagtcatatacttaacatctgacgttatttttaaggtttaaaaaaaaaactgcctgtgatgcaatgatctattttttatgatggacatacaattttttaaggccatttacttatcaagatgaacatcttaaaaatgactgaagagaacatgaacctaaatcttttgactacttatccgttgctgaactagcacggttaagtgaaaacttcttgaataaggagatagtgattgtttcacattggcctttggagacggcacttgggagaatgacatcagaatacagctgtctgacaacctgtggtcatttagctattttcaggaaagccacagagagtgggcatttattagtagccatgtgtccaccctagagataggaaaacaaagccaccaccagcagccaacctattttagccctgtcaccagagcctttctccactcatgccactgccggctgattggcatgactgcgttccattattcacacatcgcgtttactgtaaagtcccaatataacagagacgactcggcaccatctcactgctgctaatgtttgtagcagctgttaaacctgtgagacattacatagcactggagacccactcattgggtaggagatgtcctttatgtttccttgagcagtgaaatcacagtatcatcctttcctaggtccaggatctctaacggggcagtgatgctctctgatttccctatcttgccctcacttgagattcaaaattttgattttcagttcttgccaatttggtgtgactaaatttctagaaggcatgtaaacagttttgaacttcaataacaagtctttcctttttaaaaatctgcaaacttcattttatttctaatggtaggctgcttgtttttcctctgtttgttattaaaccagtagtgtgtgcccagagttgaactagttttcctgtaagcattctggggagcaggggaacagaacagtccagaaagggtttacttagtgtttgtgtgtgaaagagagtcatgttctcagctcagatatttataaacagagctttgacccacaagaacgtgttgtgagacatggagagccagggtgtgtgacagttccttactgcgtgggactctgctctgcatcatagaatacgccacccctagttctactgagttagatgccatgggcaacaaccagtcattgctagaaatgaaaacaacctgcaccctcccatgcccaacacattccctgggtggtcctgcccgttgggaactgctgctcttgccatgtgaaatacaggtacctctcaccctgtatggggctattagcttattttttctgcatagtcaccactggggatggcagctggatatctgctttccccattctcccccagatcacccactacacacaatgcctatgttccctctgtgaaaaactagtggattataactgacccttcttaagcctgcgaggtggttgtggtggggtcaggatctatctaaggagctttggaaagttttgccctaaaagttggcttcccataacttcattcactcagccgctctgtcctgaacgagactggagagtgtgagaaggcagctcgggtgccagcactccaggtgccagcagacggggctccactgaagacacgatgctgcaaactgaaaacaaaacaacaacagcagtggtctgagaagagcactgtcctcatcatttgtattataagagtacagggttttcccccatgagctttttagtgaccataaaagaccgtttaatactgcacagtttactaagggctttttcacttatttatagcacttggacttacttccactggaaggcagaaaaacaatggattccaataaagagggatatgattacttagactagttcttaaatcacagaactcaatttgaataaaaagtatctggatagaagactgttaaaataaactttagaaataaaggcacattctccatctctggaaaaggaaacaggtctcatgaaggagtctaggttgacaactttagctccttcaaactgatggggataggtcagctaatgcagatgactgggtgaggatctcaaaccaaatacaaaaggccaggaaaaagaagtgcaactgtgggatgtgacagggagaagggcaagctggaagatgatgcaagagaatctgttaactgtcttgaaccacgtgcagctattactgctttcttgtaagtttaaatacacagtgtccattgcatggcatgtatttttcaaagaactataggaatcatggttttgggatggattcatattggttctgttatttatttattattactgttacttttttttttttttttaaagaaataggccctagctctgtcacccaggctggagtgctgtggcacaatcatagctcacttcagccttgaactcctgggctcaagcaatcctcccacctcagcctcctaagtagctgggactgtaggaatgtgctatcatgcctgcctaatttattttttattttttgtagagacattatctcattattttgttcaggctggtcttgaactcctggcctcaagtgatcctcctgccttggctcccaaaatgctggaattacaggcatgagctactgtgcctggcctatactggttttaaactctctagtaaaagtatggtcttgctccaattaataggatgccaagagagcctgaatggacagcaaaatttcgtaggaccttttccatgattgttacaaaaagagtgggactttccttgtctatgtcctagcacctttctttaatcactagagtagatagacctattgtgtgaacgtgtcacattagcggaaaatatttgcattgaaatttttctcagtgatatggtggggcccgctgacatagggctggcaatagctgattgtgtgcattctccttccaactccaggtacacggatgtcaaattgtacaagtcatgaacgtggccatggtttgagtatttacaccacagaaacctgcgagtacaacaaatcaggactttttttctttttaaagggacacatttaggctgggcacggtggctcacgcctgtaatcccagcactttgggaggcagaggtgggcggatcatgaggtcaggagattgagaccatcctggctaacacggtgaaaccccgtctctactaaaagatacaaaaaaattagcagggcgtggtggtgggcgcctgtagtcccagctcctcgggaggctgaggcaggagaatggcgtgaacccgggaggcggagcttgcagtgagccgagatcgcaccactgcactcgagcctgggcgacagagcgagactccatctcaaaacaaacaaacaaacaaacaaacaaagtcacatttaccatcacactactgagtgtatacatcttgtatatgtatttgcaaaagggccctccagctttgctgccttcattacagaggctcatgaagccagcttaactgggtaaccttcaccaaagtcagagaaagccatgcccacgccatggctccaggacagggtctggagataaagtggcagggcatcattaagattcttcagagtgcattcttggcagcttgttcaaagaaaggttagtctagagagcagcaccagctgttcctcttttcattgcaggattttgaaatccttagaaaggtactaaatatgtcattaaaggcagaaataaatgatacaaataaaaaaccaacttgccacagtccccaaaatattataacacagaatggatattattcactttttactgagtgcttaacaaggacctgaaaatgatgacttgatgttaaccaatatcacaatattactttgggggtgcgtatttatttcaaaaagatggtaagtacaaaagtatagttctcataagatgcttctttcttaaggatactaaagttcagtgcagcctacctgaataattgaaaaccagacaaataattgcaggtaatcacctgtgattgagccttgctcttactataagtcatcttccccaatcagtaacctccgacatgtatagaattttatttgttgtgacaataattgtgtagaaacccagtcttccaatgcacgggagaagttagtatgtcccagaatagccaaataaaatgatcccattagctttggtggtaggacctaggatctgaaaaacagtcttgtttttgcttaatctgattaccaagaagtacagagcaaacatgtctgtttttatttaaattattatttttggtatgccttaggggcttgttttattcttctatccaaaaagcttacttctagataaccactatgagaggcacagttatgtatgggtgcttcttgtcttcagggactaatgaaagacatccagtattcccatatctgtacccttctctactccagttattctatcaggccctctacagcctgagggattcctgcatccaggcctttgctccaactactgcttccaaccctaggtgcctccatccacaggtgggaaggatcagcctataaatactctctcatcttttaagaccaagctgatgtcctcctatcacctcaaggggatcgcttatgatataggagcaacttttgaattatatagaaggggtcttagtagcagaggccattgttggttgcctcctcatcacccaggcaccataaattccctgtaaataaaattttattagaactcagcatgctcatttacttaagtattatctatggctgctttcatgctacagtggcaaagttgagtaattgccacagagatggtatgtcccacacggcctagaatatttactacctagccctttatagaaaataaaaagtcaacccctggcctaaagcattctgtagccttctgctttgtctagcagggaggcccaaggagtgcttgggaggagcctggggcatcaggctttctgtgcctcagtttgacctcaaattgctagacttcctctcccctgctttagttcacactttagtgggacagaggatttgggctttccagcttggctgggctccagttacgacttcggatgctttgaactgtagtcaagcaggcagtagggtcatctctcattaaagaaagccatattttatttcctctctgtgtttagcctgtgtttctttcgtgtatgtagagacttgctaagaccacaagaacaagccagggcacaggaagttttcttaccaactcccttagtactactccccattaggcaagtggtcagtgacctgtcagtttgaggtttttggtgcccttgaggatggcttttggtgcacagcaatactagttattgttactttgcagttttgaaaaggaatatacagtttgttaaatttacaccacctgaagcctagcttttcctgaaatttttgtgttacacttaaaaattttaatattctatctacatatcttttcaattttaacaattacatttatggtgcctttgaatactctttgggtgcatttataaactaagttcatttttaactcattttataattccatttataagtttaatatattcagttttctttttaagcatttcaactgtttaacaatcaaaacatccccaagtggttgagaatcttagaatttttttccatgaattttatgaattaaatgactctcaagttctggtacattctaaatgagaatcacaaagagaatctatcagtttgatctatgtgtaacatatactttaaatgaaagtattaatattgtggggttattttatcattttaattttactttttaatgttttttttgagacagagtcttgctctgtcacccaggctggagtgcaatggcaccatgtcggcttgctgcaacctccacctcccaggttcaagtgattcttgtgcctcagccaaccgagtagctgggcttataggtgtgcactgccacgtcccgctaattttggtatttttggtagagacagtgttttgccatgttggctaggctggtcttaaactcctgacctcaagtgatctgcctgcctcggcctcccaaagtgctgggattacaggtgtgagccaccacgcccagcctatttaatcatttttatactcttaatgttaaatcttccagggtaaaaagacttttcattaaggaaacaatttgccatcccaaatgaaaggggttataattccatgtaacttgaggttcccatctaattgaacttgtgttggtttccctttatttatttatttattttttctttcttttgagacggaatctcactctgtcgcccaggctgtattgccatggcatgatctcggctcactgcaagctccacctcccgggttgttcacgccatcctcctgcctcagcctccagagcagctgggactacaggcgcccgccaccacgcccggctaattttttgtatttttagtagagacggggtttcactgtgttagccaggatgttcttgatctcctgacctcatgatccgcctgccttggccttccaaagttctgggattacaggttgtgagccaccgcgcccagcccaaacttgggttgcttttcaatcaaaatttttggagatactcattgacaagttaagccctttcaaaaaatagttgtgacaactcttagaaaacgtcggtcttcaaagggggttgtttgctcctggattaggaggtagttatcattacctacttcactgtctactcacacagatggatactcccacctaagattctagataatttcttccactgcttggttggactttatgtttctttagcacatgttttactatctttccatcttgctctacagatattccattttcttttactgataatttgtatactataaaattcatcctttgaaagcatacgattcagttgcttttagtatattcatagggttgtgcaacaatcatcaccatctaattccagaacatttctgtcatctagagagaaacacctgaaccattaatagtcatcccccaattatgctttccttcagcctttagcaaccactactctactttgtttcttcatggatttgcctattctgaacatttcatatagatcaaatcatgtaatatgtggtcttttgtgtctagcttctttcacttaacacaatgttttcaatggtcatccacactgtagtatgtatcaatacttcatccctttttacggctgaataatattccactgtgtggatatatcccattttgtttatccatttattggtcgggttctactttttggctattataaataatgctgctttttatgagcagttttgtgtaaacacatgttttcatttcttttgggtatatatctagggatggaattcctgggtcatgtgttaaatctatgttgtcaaatgcttttcctgcatttgacatgatctattaacatgactgtatgatttttatcttatagtatattaatataatgtgttacactgatttttgtatgttgaaacaactttatatcctgagataaactatgcttgattatcatatatataattctcttttatatgttgctggattaatttgttagtacagttgatccttgaacaacatgggggttggggtgctgacggccacacagtcaaaaatccatgtataacttttaagtcccccaaaacttaactactaatagcctactgttcactggaagccttgccaattaacataaattttgtatattatatgcacattacattattacaataagataagctagagaaaataaaatgtcattaataagataataaggaagataaaatatatttactatttattaagtgtaaggggatcattataaacttcttcactgtcttcatgttgagcacgctgaggaggaggaggaagagaggttggtcttgctatctcacaggtggcagaggcagaagaaaatctgcatataagtggacccacacagttcaaacccatgttgttcaagagtcaaatatattggttgagagatttttgcatctatattcacaaggaatattggtctttaacttttttttgtaatgtatttggttttagtatcatagtaatcttggttttgtggcatgagttgggaagtgttccctcctcttctactttttggaatggtttgagaattggtgtaaattctttaaacgtttggtagaattcagcagtgaagcaagggtcctgggcttttctgatgggaagggtaattcaatgtttttacttgttataggtctaattttgatttctattacttcttgagtaaatttcagtagtttgcacccttctaggaatttgtacatttaatgtagtttatctagttatttggcaaacaatttttttaattgtattccttcatagtcctttatatttctttttttttggtttgggttccacccgctgccccccctacccccgacagacctcactctgttgcccaggctggagtatagtgacactatcatggctcactgtagcctcaaccttccaggctcaggtagcctggaaccttccaacctcagcctcctgagtagcgaggaccacaggcgtgtaccaccatgcctggctaatttttgtatttttttgtagagatgggatttcatcatgctgcccaggctggtctcgaactcctgggctcaagcaatcctcctctcttggcctaccaaattgctgggattataggcatgagccactgtacccagcccctttttatttctgcaaggttggtagttgtgtctcttctttcatccctaattttagaaatttaagtttccctcatttttgctttgttagttgattaaatatttgtcaaactggctgtgcgtcttggctcacaccagtaatcccagcactttgggaggctgaggtgggtggatagcctgaggtcagaagtttgagaccagcctggccaacatggtgaaaccccatctctactaaaaatacaaaaaattagccaggcgtggtggtgcacgcctgtaatcccagctactcaggaggctggggcaggagaatcgcttgaacctgggaggcagagattgcagtgagctgggatcatgccactgcagtccagcctgggtaacagagtgagactctatcccaaaaaaaaaaaaaaaaaaaaaaaaaaaaaaaaaaaaaaaatagatttgtcaattttattggtctttcaaaaaaactaacttttggtattattgattttctctattgttttcctaatctctatttcatttatttctagtgtaatctttattatattctttcttctgtctgttttggtttagtttgctcttttttctcctactttcctaaggatgaacaaacatttaattttaatggcattttaagagcattctgttggatctcacccccatatatattattatgtttcaatttctagcttttttgattgattcaagtaaatgaagttctatattcttttccttgttttcttatctagcatggttatacctcttatacatgttaaaaataaaattcagttggattatgtctctctcacattttgtttctgtattcacaagagttaatgacatattccaagttacgacaagaaaaaatgtaaatgatctgtttttcaatcagtgaataggatttctaatcttacaaatcagggacagaagagtcctccttacttttttcctccctacatctatttatccaattctacattgcggagttcacttgtagcaaccacttctagtaccaaattatgagtaactgaatgttaatgtttggtagaattaactcagcaatcccttctagtacgaaattatcagtaactgaagaggcctgtggttgacagaaacagaatgcccaacttaaactggcctaaaaagatgaagaggatttatttgtttataaaactgaaatatcccctgctagtgtgtgcccactggattcagaggttcataaggtaatcaaagctgaggtttggtttctaggtagtctccgcaggatacaaatgctgaaagatagctgatacatgaagaaatagccaagaaaactgcaggtgtgattgaaccacaaacccctgaatcaagctatgccaaaggcctgcaatctgtgaactttttagttataggaaccattatactctgcttataacaggcattataaataattattgtataaattaatgggttaggctatcaagactcaatgcagatgaagcatctccacaagtctctggtgaactccattttcagttacagcataatccagatttggataattattccctatttttttcatgtgtatgagtcctcagttccttgagggcacagaaatgaaaaaaaattgtattatctagtattctcaatataatgtgagacacaaagaggatacttatttgaaaaaaatagatttaaatagctgagctacaatgaaaaagacaacaaaatatgtactatatttcattccatgttaaaatgttagtaaaagaagaaaattgaatattggagagaagttaccagtcttcccaattaatcaagccatggtttcatgaaggaggtgggattttacatgaagagtttcaaaactgtagatataattggttcaaatgattacacatatgcctacgggcagctgcaatgaatcgtgttgcaaacagaaaagtaaacaacctatcctggaaaagagaaccactccagaaatctcaagacccacataggacacttatgttttgagctattcctttaatctgtgtccaaacaaagcatctaattcttatttcagagaatggaaagctctgacatatgcaaaaagagaagcatcagtacacttgtctttgcatgcaggtgcaagcaacagacttctcaataccatacataacatagtcgttaattacagaggcagccaggttcaagagcacatcatgttctcttcctttttctcctctcctcctttccttcctttctgtcaatcatttccactccactctttcaaaagagcattcatttttggtatcaagcacttttagggtattctacttgattttttatcttctgtatttggggtaatattcagttatgattttccttcctttcaagaaagcaaatattgtaagtaggaagaaacctattcaatgaaaacctttctcctggcaatagaataaggttgtttaaggagtcctacctatatgtctgtaagctaacaaagtatgtactagacaggaaagggagttaatgagtgaaagccccaaacacatattagagacaaccaattagcttgtctgaaacacaggcttgtaaagctatcagtatcttataaaatggtctgctacacacgagtaaaatgttgtttaaatggcttgcttaactagatgcattcaccatgaaattgattcttttaagttttttttttaaacttaatacccattaagtgtgcatattgaaatggctaggtgggtgggagggtgggtgcacatcctgatattacaaagtgcaggttgaagatatgagttccatattttatgaggttaaagagcatatgaaaaagaaaaacaactcatgattaccaacaattgtgtctgcctcagtaactgaaatgtttcaacacagttggattattcctcctttgccttgctaaaagcttagactgggatggctagatgtgctctgaggacattccagtgctgagaatttatgcttttgtgttacagaaaacacggttttcccaccatagcctttgattctgcaaaatagcatgagaggaagaagcccctgagcctggtatttttcaaatccaacatttgcctcagagtgaacatcaaatttcatccctctaagaccttacaaaacatttgaggtaacttaacgttagctgacaaatgaacaattcctgattctatttcacattctcaattttcttaaaagtctactctatcttttaaaatgagtttttggccacacctcacattcaactttttctgttatacgaggctgtgtgccacaaatacacgtcaaacgattgctacctgatcagacaaccaggggaacgtgatttgattttgtcaagtctagctattctccctgctaatccaatattggcacccttgtgcactttattaaactactgtcaattggccaactcaagggattctctgactcaacaaaatattagggagaatatatttagtcaatggttaaagaatgttgaaggcacaaatatcttttaaaaacagtttatacacacaaggttatttggcttttgtaatggaatatatgtcccctgtctcaatcttgcagctgtcgggtatgaaaaaacaacagcagtagtaacaaatcaaaatgttaatatatggaacccaaataaacatgtttaatattggccttgtggtactatggcagcactctgtcctaacaacgacaacatttagatgctggagcagattcaaattcttgggccataaacaggagacagacaaatatggcaagccacgcgttactcagtcaccaatggagggtgccaatggccccgtccagatgcagagatattcaagggatgtgcctgtcagcagtttgtcctctggctacagcaagaagccaccatggaaacaccagaaggaaaagaaaaaacaggaaagcatggagaactaggggaaagaggggcagggagctgaggcagaaaaagctgacagccgcctcaatagcacatctgagcaagggcaacaggtaacaaatgggcttgtaaccaggtgccatgtcagtcacgggaagggaatttctttccctgctggcaatacagtcaggagcctaatatcctggcaactgagaaatatgagcttggaaagaggcttgcaggccgtctaaagaaaagctaagtggtaatccgtactgaggaattttagccaaaaaatcccacacaggactagttgagctcagtacaaagcctgtgaaagacatgtctcaagaacattctaatcagacataaagagaacaccagaaataaaggttccaaaagccattgactgggatttaccacagcattgggagtgtggccttgggtcgtaattgtcatccatgactagttgaaaatactagttctaaaccagggaaaggaaaaggcaactgtaccttcccacgggacatttgataatgtttggggattgttttggttgtcataacagggggtggggaagcagagcaggtggttactaccagcatctagtgggtagaggccagggagatgtggctaacatcctccaatgcatagggcagcttcccctctcacctcaacaaaacattatgtagcccaaaaggtcaataatgccaagattgaaaaaccttgctctgaactgatcttctaaggcaaaagtcagagaacaaacccctgttaatgattcaatccacagtttagcagcacaaaccatcagactcactccctggaaccaggagatttagaaagtggactgggagggtagaccaggagctccgtccaggagcatcacaggtcaacagctcctattctctgtgcttctttctggctcaaaatgaatgatcaacagatcttggggggccaagtcagtacaccaaattgggctgaaacaagtgtgccaaggaagtagccacctttcactcagtctacacagtcactgttttgggctctggggatacaaaggtgaacataacaagtcctggccctatggagcttacatggtggccagcgatactgacagatatcaagtaactaagtaaagtcgggtaggaataagtgacatgaaggaaaagaaagtaccacagcaataataacatttgctatataactgatctaaaggagggacagaaggcaatatatgggttaaatataaagcagccatagataaggacaaatctatagttgggttcaaaacaatagcacatagagctatgataaaagctctactgattagtctccacctaatcaccttggatcaaccgactcttcattgtcctggtacaagacaaatgattgatgttgcctacacagtgaatgttcatgaccagtggacacatcaccctgaatgatggtaattacccagtggatgctgacaactggtgagcactcctaggttgcttcacagctctcaagatggcaatcatatttattattaagtagtataagtaaatgtgacaccaacagataaaatatgaacttgagaatttctattcctatgaaaaactaaatggaatgagttcaaagaacttaataaaggtgagtcactaaaaccaaactgctgttggattggatttagataagataactacaaaggattgagagggaaagatgcagattgcttcccaagtatctttaacttatagttccattttaaagaaacagaagctgaaaaatcataggtaatggctgcttaatgaaacaaatataaaacacaactctgattagtggccacatattcagataaaaggccttggcccaacatgaaaagattagtaccattggtatgtttaaattaaaataaattatttatttttagttccttttttttttttttttttgagacagtctcacccaggctggagtgcagtggcacactctcggcttactgcagcctctgcctcccgggttcaagcaattctctgcctcatcctcctgagtagctgggattacaggtgcctgccaccatgcccacctaatttttgtatttttagtagagatggggttttgccatgttggccaggctggtctcgaactcctgacctcagatgatctgaccacctcagcctcccaaagtgctaggattacaggtgtgaaccaccagcgcctggccttttagccagttcttgattaactgttcaactaccagttcagaccaggccagatgagtgggcttttaactacacgttctgctctaaatttccagtcacacttttcatcatgtctgaatcaaaagcattctcagaggggaagtcattaacacccacttcagtctgaagtttagagtgttacataaaagcatgtccactgtcagaatcaatactagtgtctatcacctcaaatccttttttgtgacagtcgagtataaataaataaaattaaaatactcaaacccacgctcatgtgcacacccccacacccctacagtttcctgtagaaatattcatctctatgaaagcatattatggttataactgaaaaccttgttattaaatataatattagttaaaatattaaacataatgttattctgaatgtatttgtaaaatatttcctaaatagaacttattccaattttctagacccagaacagaaacagaattctattataaagtatacccatcaagaaaatgtcctgagcttttcttagcccatgccctgattacaatcttccacactacatttctttagagagcaggtaatcttagtgctttgcagaatagtcctattttaccttgaaattatcatctgtttctttccaaatgaattcttaccaaattcatttttcctttggtaaaatgccaattccagaaaagcgcttaaaaacaaaaatcatataattccaatgcctgacaaatgatagcttgtaccaatgatctatttttaactagaaggtaagtgttaataacaaaacaattctaaatgatacatgtaaatggcatttgcctctatgtgtccacaaacttacttttagttcctgataccctgtcacatttagcataaggacacttatacgtcagagtccttgaaatagggtttgtaaattttaggtgcctagtcacagcatctaatctttcactgaaaaaaaggaaaagatgtggctctagagaaatcagtatttcagaaacaaattcttgcctgtttgactgtagcttctcatctatccatacaacacatgtaacctgcacactttttagcaagtcaattatagttttcataaaacatacggaaatgctgaaatctcctgcagctgctgaaatacttgaattctgacttcttatatgaagtcgtggacaccaaatatgtagtaacctacttacaggttgaactgctttttggcaccatgagaaggggcaatcttctatcaaactgatttgataaatctgtaaatgtgtccggtaggttgcagggcttggatcagtaacaaaaagcattgtactatgggatgggggtttgacaggttccagcatgaccactggccctgtacatcaccaagatatggtttacctcctacaaaacctggggaaagagaaaaaaatggaagcaattaagaggtacaacataatggggggaagttctgcacatgaggtggaggtggaagtgaactgaactaactattctctttcttgttcccctcactttctcacaaagtatgttattaagcaaaggacttattcaaagcactaaaagacataatatattaactaacactcatggaggaattgaaaagagttccctaaatgagcaaatcactctatccttataggcaaggctgaatttgcaatggcttgcataactatcttaatggtttttatgaaatattataaattagacttacagtttagatttaagaaattcatttgtgctgcatcatagatgtttaaaaatattcctatatctgcacaaagcataaaaagctctctggaaaatcatgaaacccttgcacactcaatattcctccccacaccagtccttcccatctgccagctgggtttcattttaagaatttcacactgaatataaagtgctattttgaccatgtggctccagaaatgtgaatttatagttttttcagcttgtatgcaggtgattgacagagaggggattaaccaactggatgcgatgaagctgctgcctcttccttcaggttactttaagtttccatgcaaggatggccatccttgaatggtttcattgaggctagcaagaagtacagcttcctagcaggggacttacttttcatttaactactacatggccaccataccttgaaactattttctccatgttactattcctcccacattccatctattttcccatctgtaaaatgggaatactgaagttagctttcttagacataccttgtggtgatatcctactgatatatgacacatatctatagttactggtcttcgggtttaagagtcaagattttgacaaatgtgtaggtgagcatgtgtgtatttggttttcttgggtgggggcagactagagggaatgggcatggagaagaaggttgaaaggttggcttaagagttcatatatatatatatatatatatatatatatatttttttttttttttttttttttttttgaggcggactcttactctgtcatccaggctggagtgcagtggcgcaatctcagctcactgcaagctccgcctcctgggttcacgccattctcctgcctcagcctcccgagtagctgagactacaggcgccctccaccatgccctgctaatttttgtatttttagtagagacggggtttcaccttgttagccaggattgtcgcgatctcctgacctcgtgatctgcctgcctcagcctcccaaattgctaggattacaggcgtgagccacagcgcccagccgagttccttaatatattcttactctctgtgtgagcaatgcctaataactgaaatatggaagagaccctctacactcagtatttcagatattgctttgggcatctagaaatgtttcagatacgattgctatttaagattgccacataaagcagtcctattttttcaacagttaactatcttgtttcagacttctcatcctcaagcatcatcacaggcacaaaaatgatgtcataactatagacaatagtccccctttacatgcagtttcgctttccgtggtttcattttccttgctaccatataaaaagatattttgaaaaacagaaagagagaccacatttgttttcattacagtatgttgttacaattattttatcattagttactattgttaatctcttactgtgcctaatttataaattaaactttatcataggcatgtatatataggaaaaaaatatagtatctatagcaggccttctgtatccatgggttccacatctgtggattcaaccaactgtggattgaaaatactcaaaaaaaaattgcacacgtactgaacatgtaatgaactttttttcctcatcattattccctaaacaatagagcatgactagttacgcagcatttacattatattaggtattataaggagtcaagaaataatttaaatatataggaggatatgcataggtaatatgcaaatactacaccattttctttcactgactcagattttgttatttcagaaaggtctcagaacaaatgccccatggatactgagggacaactgtaaagggtttggtactatctgtagtttcaggcatccacaggaggccttggaatgtatcctccgtcaataaggggtgatccacttgtattcagattttcaaaatgtttcttttttgcaactttagggtcatgctgttcctgggattccgtacactcactaaatgcacaggaaataatactacaaaccagatgacttccctatttgacaaaagatcaatgaaaggatattcgagcattgacttttgagaagggtgtgtaggatatattcagatttgatactgtgacactggagctagtctcaaaattaatgagcatatacacaaaagttgacatcagatggaagatgacatcatttgaaaaatacatgcttatcatatcccatcaagtttggtcctgttcagaacaggaaaagttccattcataggtggagtcttcagcttctaaattattcgggagagtaataacaatgtttcccctcccttccctcaagacagagcaaacaaacaagtacactatagaaaatcaattataattaggggaaaatttctcctgcttgccagcaaaaataaatatggctccactgaaaaaaatcactaatattatatattgaagttttagacatatgctctgaataattaagaaaattatttgagcacagaaaaaggtatggaagaagccacatcaaactgataacactggataataaccttggggattaaagagggaaaagattattaacttttatatatctttatgtatttctgaataattggacttaaaataataagtgactatagtttttgtattttaaaaaaactaataaaataaaaacaatcaggctgggcacggtggctcacgccagtaatcccagcacttagggaggccgaggtgggcagatcacctgaggtcaggagttcgagaccagcctgaccaacatggagaaaccctgtctctactaaaaatacaaaattagctgggcgtggtggcgcatgcctctaatgccagctactcaagaggctgaggcaggagaatctcttgaacctggtaggcggaggctgtggtgagccaaaatcacgccattgcagtccagcctgggcaacaagagtgaaactccatctcaaaaagaaaaataataataaaataaaacaaaacataaaaacatacacatgaacacatcaaaaagagaatttaaggaaataaaactacactgtatgcagagacacatccaagaaggtaacctggctcacagtagaagctcaacaaacatgagttatatgaatgtgaagcacacaatagctgacaatataaacattctcctcatataatagtatctactcatgtgccgcagataaatatagttgctttttaaccatcatagttaagaaatatggatttttatcttatctaagcactttggggatttaaattttaagtcaataataatttataagagtttgtctgtttctggaaggtgggcaacctttcaggcaggccagaagaccctcaggattcttaactttcacaatgaaaatccaacaactgcccacagggctgcaatgtttatatgtggattttccagaattagtggtaccagctcttcaggcccggacaggaaatgaaatctccaactccctgctctttatcagatctcctgggagaagtaatctttagagaagatcattgaaagggccagatcatccatcttcctctacaggatgtctaatgctatccttgaatgaagttcaagtataccctgctgaaggctaccaaatcactttatggcatttcaatactagggtctcaacattacttaatgccaccgtaagaaaaggccacaagaaattcaaaactacgcttactataacagtgttgtgaattactcattagatcactcaatgtcttctatagaaaacatcttcttagaattatggtcttaaatgacgagttaatgggtgcagcacaccaaaatggcacatgtgtacctatgtgacaaacctgcacgttgtgcacatgtaccctagaacttaaagtataataaaaaaaaattatatatatatatatatatatatatatatatatatatataaagaaaacgtcttcttagaattatgctcgaacagcttttattttccctatggaagacacattctccttgttttccataatgagaaagaatatgtcacagatcatgattcccctgccctttcgtttttcaaaaacccagagcaacaaatatgaaactcaattggaaaagtgattcgaccaattggagtagggttgagcattattatagttgccttctctttgttctgatcttcttgtatttcaatattttattattactattttcatgtgagtcactttaaatactttgtagacagaagcagtggactacatagacaaaataaaaataaagtaatatctccatctggagttgaacaataacattcaattatctctttccttggcataactgcttaacagaatacacgaagcttcattgaaagccaccaatattcgatcattcttactattttgagggcttcttaattttaccatggagtgtggactccagttttatcagaattgtcttggtatgagaagcttcaactgaagttcactcatttaaaacattttaagaatatcacagtaagaagaaattcttcagtaggtcaagtcccttacagcaaaatccaagagactcttcaattgttttactatataaaatgaatgatgcttacaacatcattttttcagaatccttccttctttcctttgtcctttctttccttctctccctcattccttctctccctcattccttcccccatgactgtgatattttcaggtgataggattttaactgtaccgtccagttcttactatcttatagatcagatgttagatgtcatctggcattttttaaattgattgtttctccaaagtacctttaacctttttttcaataggcttttgggggacaggtggtgtttggtcacatgaataagttctctagtggtgacttctgagatttcagtgcacccatcacctgggcagtgtacactgtacccaatgtgtagtcttttatccctcgccacccaccaccctttcccccaagaccccaagtctaatatgtcattcttatacttttgtgttctcatagcttggctcccacatatgagtgagaacatatggtcatctggcatttttaatgccacacgatcaaatccaacaacactctccaaaataatctttcagggtagtgatggtggaatataaaaacagtaaagttaaggtgtctttagccataggattctggccaaactgtgagataaataaaatctgcctttatttctttttcaccttcctttccaagaattccttccagcaatccgaagtctctatataccttaccatgtgtcagactttttttttttaatggaatactttatgaatttgcatgtcatccttccacaggagccacgctaatctctgtatcattccaattttagtatatgtgttgtcaaagtgagcaccacacactcttttaagattaaaaatatatatattaactcactaatcctcacgtcagtccattgaggaaagtactattattattccatttttcgaagctaggacaccgaagcttagacaggttaaagaatatgtccaagctatgggggcaagacacaatagtggtggtctggcccaagagcctgtgtacagtggaaatatgctgcttgttacttagtatgctgcatgctgagctagtactaacaacaaaaaaacggttttcaatgaaaaatcagtgattaataacacgaaatgaaatccaacagtatgtaactttaggtacttataatagggttgggatgagatttgttgcaatgcctcctgaagtcccttaaaactcagtccacatcagcagctactccttgagagtattgcaagtagaacaaagcatttcaaaccacagaatcctttcaatgtttttatatttctccaccataatcttgcagcaccccctcctccaaagggcagcactgaatgcacagacacatgacacattgatatgatcaaggttgattggtggcttcccacatatcatgtgaggtccacaagagactaaagattgctagagtattgtggaaccctcagtgatctgaattcaacttatccattcattcattcaacagatactcaacaggaacctactacatgccagatactcttctagagactaaagatagagcggtgaacaaagctgaataatcccaaacttctagctacttacattctaatgaagaaagactaaataaatgtgataaaccactaaaatagtatgtagcatgttagacaatggcataaagtactaggaagatgaagcaggaagatgcatgggaagtctacagttcaaaacagggtggtcaggccaggcatgctggctcacgcctgtaatcccagcactttcggaggctgacgcaggaaggtcacttgaggccggacttcaagaccagactgggcaacagagtgagaccccatctctacaaaaaatttttttaaaaattagccaggcatggtggcatgcatccggagtctcagctacttgggaggctgaggtgggaggattgcttgagcccaagagggcagggttgcagtgagccaaggctgcaccactgcatttccccatgggcaacagagtgatattctgtgtcaacaaaacaaaacaaagcagggttgtcatctctcaatactcacagatcctatccccttaactgagtttagtcactccttgaactcaccttgccctttccaaatatgaactctttgcccaagacatttctttctcctagaaggccctctgtcctgtttcttgtgagtggtagtttagctagttaactggactgaagccgaaactaccgttgttcaaatcccctttttattacttactaactctttggctttgggtaagtcccttgactgctctaggccatagttttctaatttggaaaatgggtataataataatgacaagaacaataatacctatatcacaaggttcattgtgaggctcaattgaattagaatattaaagtgttcagaatagtacctggcactattctactactactatgacctcaactaaatttctatctgtgcttaagacccaattcaaatgctacttctcaatctctaatcacaatagctgaaggtgaggttttccttctctgagatcctgtagtcccttggttttatcactctaatggtatttaacctgtatcattgcaagtattcacgctatcttgaagtacaattattatatatatgtgaagtacaattattatatgtgtgtgtatatttatttacttataaacagcttcttccctcctgaaatcacagcacctgagggtttagaatgaacataaacttttcttcttcctccttatctccttttcccttctgtgagtgttttaatcagttcattatttatatataccagagagtggacaggacaaggaaagggaagtgaaattagcaagtgcacaggcccacacacacactctcacacacacacacactttatagttctgtattagtttattacatttaaatctcccaatgtttttgatctccttctctgaggaaagcttggtggtatagcagtctatcctccaaagatttacaatctaaatcgtgtagaaagccttaaggaaaaaaaaaatccctctcacttcaacaacttaagccccaaccctacttgaaactatgccttaaagtgcttgctgtctccccaaatataccatgtattaattttcacacttcaagactgctacttatccacctgatgcattctggaacctccttcccttcccctgtcacttcccttctttgttttccttgctctcccttccctgaagaattgactgctccctcaacccaagtaatacataaatattcgtccattcatttcccctctcccctgctagagtgcaaattctttgggatgaagacagacctcaaggctcagagagctttgcccaaagtagaccctctcactcatcttggcgaattccgcatctggagcaaggtctgaagtgaggcagatgctcagagtgttcactgaatggaactgaatgagctgctaatgagaatagacaaaggaatcttttcttcttttctttctctttctttttatcttctttttctttttctttcctttcttttcttttctttctttcctttgatggagtctcgcttcttcgcccaggctggagtgcaatggcgtgatctcagctcactgcaacctccacctctctggttcaagcaattctcctgcctcagcctcccaagtagctggaattacaggcatgtgccagcacgcccagctaatttttgtatttttagtagagacggggcttcaccatgttggccaggctagtctcaaactcctgacctcaagtgatcaacccgccttggcctcccaaagtgctgggattacaggcatgagccactgcatctggtcagtcagccaaagaaatttcagtccctccttccctcccttgtccttgccttctgagcagagatgctgggcacagagctgaccaaaccaaactactagggggaggagatacacaaatacttcctaaaacagtctgggcaggatgatctatagtttttattaattcagtttgttgggggctttatcacacacaaggcactgtgctgtgagagagaaagataaccaagacctgatactgccctcaaagaacccgtaggctactgggtgaaaaagataataattataacaaggtatgtataaaaatggctgtgggaacacagaagagggtgtgagatttacctgtcttgatagttgctaactcatttgaaaattcataatatttataaatgataataaatccatagcaaaagaagctttaaaactatagttctcaagtctagcattgaacagtttggacaatgtctaggttattttattttgtggagaataggctgtttctgaaagctcccacttttatggcccaatcagtaagagatttctattccagctgctacactattcatttattttagttgtaaaaacttgaaaaagcgaaaggaagaaatgtaaaataagcatccctgtcaaatttaccctttttctttagaatgatgttgatccaagacaaacagtctcaaccagggcaacatatattttaaatatcattgcagcaagtaagaaagagaaacgacttgatttaaggttggtttttgatttgtcaggtgactttaagtgattcgcctcttggttcccaatttggcttctattccaagatagaaattctaaaacttgctctttcactcaggttgaagtgcagtggcatggtcatggctcactgcagccttgaccttctgggctcaggagatcctctcatctcagcctcccaagtaactgggactgcaggcacacactattgcacctggctttttaatttatttttatattttgtagagagactgtcttgaactcctgggctcaagcgatccttctctctcagccttccaaagtgctgagattacaggcatgaggcactgcacctgacctgaaattctaaacgtactcacaaaatacccagaacagatttaattcagagaataccttaatctcaatgtggctgtgtccaggtgaagagtcaaaatgtaatattaaaaaaaaaaaaagagaaatagaaaattaggttccacgatagacaccagggcttacttgaggatggagggtgggaggagggagagatttgaagtaccaattgggtatgatatttactacctgggtgacaaaatgatttgtacaccaaaccccagtgacacaatttacctgctgcagggaaaacaacctgcacatgtaaccccctaaacctaaaataaaagttggggggaaagaaagaaagaaaattaggtttcagaacacaaagtattattattattatttggaaagtgcctagtaagacaggggcaggtgacatgttcttttaaggcatcagtactaaggctgcccagcaaatacacagctaatctagaatattctgatagaaagataagggtacagggaatcttgtatgaaacaagaaaaaggccagatgattgatacagcctccaacataatttcccctaaaggctattaacaacacaagaaggcccaaggcattactctgagcaaattaagacctgacaggtcatgtaggaaactctttcaaacatcccaacatttgatgttttatcatttcattttgctctgcatatcaaagagatggttttacctctagcccaaacctccgatattcagtagtcactctattcatatatatatgaaggaaatcactacaaaagaaatacacaaagcttcagcttactctggactcaatattctaggggaagacaacagttttcattttcttttcttgctggagaacaaaagcatcaggtaggaaaatctgtccccttggaaaaggaccagccatttgttctctggaaggcccctgaaagtaagcagataagggaaagtggatatctggacttgcctgagaaaagccttttaggtccaattgtagcaacttatttgagagctgcaactcattaagtgtgtctctgatatcacttcagatatgaaggttagtgaaacataccaatagattgaatcatcaaaaaattctcctaggaatttgaacacagaagatttgatggagaattactccattggctcaagcctggatgggcccctagtggagataagatacagacaccttttagacaagggtttcattcttcagaaatagaagctcaaattgagaatgttccctcaatccctcaacattatcatcacagtgtttattagacatctacatatactccataggcactaaccaaacacataaaatctaaagtctctgccttcacagagcagacaaattaagaaaacaaccccacctcctgctcccattctggggactacacatcagaaaatagatctctttttacaaatgtgaccagtttatttccttaaatccttattgattcaggaaacagtgctcttcaagtctctggcttgagaagagcagttaagattaaccttttctgatactcaagctgcaggacatcttctttgcattgcctctggaaggctttaacattgctctaatccctcatctatcaaactccttcaccagaggggtaaagggggcccttttgctccctatttttatgagtctgccaggaatacactggcaatcaaaactgaagctgcattccttaaaacgcttttggtaaatagacacaaggcagtattgtgcttacacatatttcatattctgagttgtctatcttaaactcaggctcaaagaggctctgaatttcccattcttagaaatcatacgacatatgcaataagaacatatggccatgagataactgaggcttcagtttgtaccacagccaagaacactagatgcccaagtgtataactactaatgaatcaagaaataatgcagagaggttgtcgagagaaggaaaatatagaaaaccaatttagaaaaagcagattttatttatttatttatttatttagacagggtctcactctgttgcccaggctggagcgcagtggtgtgatgatagctcactgcaaatttgacatcctgcgctgaagcaatactcctgccccagcctcctgagtagctgggacaacaaatgtgtactaccatgcctggctaatttttttttatttttagtagagatggggggggatctcactatgttgcccaagctggtcacgtactcctgggcttaagtgatcctccaccttggcctcccaaagtgctgggattacaggtgtaagtcactgctgctagccggaaatcagacattttaaaggtatctgtcaattgcataataatctaaaaatatttacataaatgtgataatgagagatgagagtgatttagatctggggggtcatgcaaaataaagcttctcaaactcagcagaatttcaacaattatccaaggttgacagtcttaaaaatacaaatagagactgcacactaataaatatgaagctcttaaaatctggctttaagataatgccacacagaccattgacagttagcaaatgaaataaaagagtctgagtatctggaagcaaaagagaggagattttgaaatatatcttataatttggtgaagttgacagtaaaaaaaaaagctgcattattttcgaaggtccattaaacttgaaaagtaacaacacaaatctacaatctaattacacaattaaaattagtacaagaagatatacaattattttataacttctggatttctactgggctttttatttcctccactggttttgtctttcattgggaaggaaaatttcaatggtttatcttataaacaccaggtgtgagtgaacattcactgggcaactgtacaggacataatacacccctcataacacctccctatcaaggcttttgttatagatcactgccaatctctgtgaaaacaggaaccatattgcaaagatcagcagtcatacagttttccttaacaaattcaaatactacatcgtaagtctacgaggtgtgtgccaaaggtgttatccaatatactgagtggtaaatagcaaagccctccccatcagattttctcaacttggaaggaattagggaagccattgaaatgaatgcagaatggtttgcagaaccgtaaataatcatggtagaatctacaaatgtaacactagctaccccttgtaaaattatctgtgctcctgccaagggaactcacactccagtggagtgcagagcagtagaaatacatttacctttcttatgaagacaagaaaaaagatcagcctagtgctttctataaacaataatacaagtgagaagaaagtgattgagggagacaaaacaggatgggaaaggaaaaaaaggaaaggtttgagcacgcctgtgtgtgcactcagaataaacagctcggattaaggtgaaagacttgcagcagctgctgccatggtctatttctactgaatggcaacagggagggaacaaggggaggcagatagagctaacctttattgagcacctactattccatgctgggtacctgaaataccatgtgtttggatcagctcactcgtttctcatagcaaccagtgacattggtgtttgagttgttgttttgttccttgtatcagagctgtgcaacttgaactagaaagatcactgtcctgccattttctaatcaagtaatcttgaaccgacgagtcagtaaatgtctttagcttcctaattttttaaaataagggaataacagctgtctttgaagggattgggtatagactgggcacaaatataggtaaagtatttagcacagtgactgcccagagtaggtgctcaaaaattggtagctttatgaataaaatttataactacttaatagaaagctgtaatatgtgaataactttttaaaaaaaatggaagtctcatgctaaagccctgaacaatccttccttcccgtaagtaccttcataacttttgggggtctattttacccaaattattattttatttttggtagagtagcccaattttagaaacttttcccccatatatgtagggttggagggtaattgaagacatgatgatagggtcccacactatgtttttcatttgtggtttcaacttggtgtatatcttgcttggttgcctttcataatatatgttcttgtcattttgttaaaaaatggctcttcaacacaaagtgagtgcttttatgggttcaggataatttgcacagtcactgagcaactgccaaatggtgagcatcactgtagctgctgcctggtgcttctggaatttttttttaaaaagtatctgccagcaggtgcagtggttcatgactgcaatcccagcactttgggatggctgtggagggaggatcacttgagcccaggagtttgagacaagcctgggcaacatagtgagactctgtctctattaaaaaataataaataaataaataaataaataaataaataaataaaaggagctgcctacttatgacatgccaggcactgtggtaagtgccttagatagctagtgcatagcaatatctgtgtcctcctcttcttccagggcaaaaggctacactacaattcacagcctttgccagggttggctgtagccaggtgactgagtcttgggagtcggggcacaactgatgtgcacaacctccaggcctggctcaaactaaacttttgtgatgtcccctttttgtgcgcacagtccttctctcccttttcataagtggttgaataaagtggccccaaggacctagaggagagcagaacaagatagaggacatcagggtccttgaataactacaaggagcagagtgcccccactgaccatattgcactgtgaggtgacctacagtggcaagacatcgagaatgtaagctttatagcaactgtattactctaatacagaaacatttcatcacttaattctcattacggctctgtcaggtaatgtattatcacctgcatttaactcatataggaacagaggctcagagaggtaagtcacttgttcaagagcaagcagctaacaggtgaagaaactgacattctgcccttggtcagtgaaactttaggacccatgttcttacctatgggtatactgtcccccctatagctattgtaagtatgtaagtacaaaaacctatgtgttagacatttccccttttaaccttgaacttatgttccagtaatagaaacattttattttcccattaattatgtggagaatagtaaaaattaacatgaactaatttttgcagatgatttcactcagggagtgacagaataatgcgtataaaacactaaaagcacaaggcaggtggatcacttgaggtcaggagttcaagaccagcctggccaacatggcaaaacctgtctctactaaaaatacaaaacttagctgggtgtggtggagtgcgccagtagtcccagctacttgggaggctgaggtgggaggattacttgaacccaggaggcggatgttgcagtgagccgagattgtgccactgcactccagcctgggtgacagagagagaccctgtctcaaaacaaaacaaaacaaaaaatcattaaaagcagactgctctgactaaagcaaggctggggttaccaggaatgagcagtttgacaatcactatgtgccatcatattgattctcaacactgagctattcagatttctttcccttttaaaacaaaaaatgtctaattcagttctagaattcagttttgcagacataccagagctatgcactgaaagttaatgtacaccttgaaagcaatatgtaccttagtgacaaggtatatccatcaatatctgctcatcaaactacttcctgttttacttaacttgtagtgtagcaccatgtgttttgtcagttaattactgaccctcagctggcagccacttggtaatgaaaagactgtcttctggtatgccttagtttgtgtttctggtatggccatctcagcttccattctctcctttaagtctgaagtctacattcagttccgtttagttcaattaacattcactgttcccttgcctgtgtttagtaacgaggatacaaacaagattcaggcctggtctctgccctaggaccaggagaagaatccaatagttcaccgtaaaaggatcactgtaccagttcatttagtctttgaatgtcttcttattttttaaatgacaatgactgtatcagctttgaggcatcattcttgaatgtcccctaactttctgtgtagataatgtttagtacaagaggaacatttaagatattaaagatggagtatgtcatggacactaaccaaccagaatgaacgttggtggcagtgctgtagtgcagttctagaggctctctaccaagccaggaattactgctttggttgtgaaattgtggagcagcccaagaggtcccagcggggaggaaacaggtggcattcaaatggataggccagtacgtcaatattttaacaagtggtacatctgtagtgatgtattgatggaatattgcttgacttgtgaacaacagctccataggaaaaggacagccacttttccatctgtgctgacaactgagctgtgtagatcctgaaccagaaacacaagagaaaaacaatctgaaaactgtctattcccctggggactttcactttcctttatgagcatttcaagtagagcagcactccataaatgctgctgactgactgacatttattgaataaccagtgtatacagagcatgttctgagaaacttatacagaaaacagaagtgacctatacacgctttcatttattttgatgattaatttttaaaaagtggcctttctgaggcaagtctataatctacaccctaaagaagtcttctcaagtgacagggaacttcaaactcagggcaagcaagttttggagaatgactgcctcttcacgattcgggctctggtcttcaatggctgccattggtaagggtgagtcaggatggaactcctgaaactcaaaacaaacaaacaatcacctcccacaccagaaacaaagtccttttgcctctccaacttgaaacacaagtttgtatttgtggtctgatttttgctaagatcataaaactttacatctgcataaaatatgacgcagttgcttcagaagggcaggctgttccctgtccccaccccactgcctccttgtcggtgaagggctacttggtaaaatgatctttgagttctagagatgaattatacatcctgtataattgctggatgttgtcagatgcacaaatataataggttgtcaaatgcacaaagctttctcaaataagcatgatttacctaaaggcatctcctttactagtaacctaaactgattcttttcaacctaaatgaaattctttcggttctggtatattcttgagcatgtcaaaataaaaatctcataatatttaaaaaacttatcaagttttattttttaaacaatacatttttaaaaacctgattatattagccaggcgtggtggcgggcgcccgtagtcccagctactcgggaggctgaggcaggagaatggcatgaacccaggaggcggagtttgcagtgagccgaggttgcgccactgcactccagcctgggcaacagagcaagactccgtctcaaaaaaataaaataaaataaaataaaaaacctgactatttttcagaccaagtaaacactgtaaagttaaaagacttataacgacttgtaattcaagcttaagatctgatttgaaaaaccgctgaaggaaaattttcaattagaaagcagaacattgaagataaatgagacatgactataagttctcttcctggcgttagactatgactttcaggaaaaggaggtaataaaagtgtccggagaaaggtatttgtctgacattgtgtcagatttccgaaggcccatgagcaccttgagaagtaacagctgggaggagcagactgagagctttagcagcttttggaaagttgccattacgtctccttagctttcttaaaaagcattcatttggtgttgtcttttacttttattagcttaaaaaattttagcagattgtcacacaagccacattatgggagatattcccaattttgttgattacttttcaagcctttcttagtgttactttaattattctaaacagcactttaaaactgtttagataaattgaaaataagattcattccaaagaactgatacagaaaagatcttctctgagtcagaatttttgagccagaaggggacttacaaatcatctatttcaaccctctcatttcacagctaaggagactgagaatgactaaagccaaagttggctaggagggttgagggcatgaacctagacgcctaacatttagtccaattctctttctactcagtgccagttccacactgtttttcatttttcattctcacttaaaggctgctcaccgtaactccccatgcccctcctcccaactctggacagcaaccaaactgtctttggcctaacaagggtgcacagggactttggttctctcccaaggaggaggtatatacattcatttggctctcttctttttaatagctcctggtctttctttcaattcttatcaaatacaatgtaatttgggagccccaaatacctcaatcaatatttataaatttacagagaagggaaggaattacattcaaattagaaaactgttaagttagacatattagacacaagaaagaattcaactccttcaaaaggtgcttataagcgtcttttagcattttcacagaagtctccttctactgcctttaataaaatctgtttcctcccaagcttcaattttcaacattaaaaaaaaaattcttcatttgtcctatattgcagacacttcaacttttttcttgaatttttatttgtttcttgtgctacttcctaacttgggccatttaaaaacctacagtttcataattctatttttataatttttttttttttgagaaggtgtctcactctgtcaccgacgctggagtgcagtggtgcaatcatggctcactgcagcctcaatgtccaagctcaagtgatcctcccaccttagcctccctcgtagctgggaccacagctgcatgccaccatgcctggctaattttttttactatttgtagagacagggttttgctatgttgctcaagctggtcttgaactcctggactcaactgatcctcttgccttggtgtcccaaagtgctgggattataggcgtgaaccactgtgcctggcctttcatacattaagtgaggtttggggcagggcacagtggctcatgcctgtaatctcagtgctttgggaggccaaggcaggaggatcgtttgaggtcaggagttcgagacctgcctgggtaatatagcaagacactcatctgtattatatatatgttatttttttaactgggcatggtggcatgtgcctgtagttctagctactctggaggctaaggcatgaagattgctgaagcctaggaattcgaggttgcagtgagcaccgatcacaccactgcactccagtctgggtgacagagcaagaccttgtctttaaaaaaaaccaaaataataacaaaaaaaactttgtttttaagcagtgaaacctgtttttcaaatcgtatcttacaaagaacttaaatatgtatcgtaaacataggagggattctctgactgaaacaagggttggggtctaccaattatatattgttatgaacctctatgtccttagtcttttttctttcttttttttttttttttttttttactaactatacactgaaataaagacattttaaaaacacctaaagaagatacatcatcgcaatccaagtatcttattgtatcaggcaaacagaaaccactccagttattccaagctaaggaatgtaatacagaaaactggctacacaggtgacagaagtactaagagtctcaaccaagatactaaagccattcagagattgcaggaagccactaatgcccacagggctgcagagatgcgggcaggaggtgtctttactagatcatagaagtcagggccatctggtgagaactgggaccatggcaggggctgcccagtggaatctgggaccatggaagaaagggctgtctagtgggaagatgaagccatggagaacatgcagccacggcgggaaaaaagtccccccaccccagccacttcatccaaagcacagacaggtaagaatatctctcatttctcccatacttgtccttcttcccctcaaaattctgtctgtccctccctgaccagagcaaatcagaagcataagggtcagggagcctgggcaatgcagttgacaggagaagggaaaggaattgacatgatagcaaattgacagtgagtggcttcctcttcttcagattgttctacgccaatcaaaaaaaccattcagctgaaactgatatccaatcttacagaaatccttctgccacccagcttcacgagaatgattctctctctgccatccatgctcttctttccctctactttggctcactagaagatactattctgtatggacctatgaaataggtttccaaaggaagttgttcaatgagccaggaaaaccccccacaaaattcagcagaaaaagaatacaacatgcctcaaggtaaagacctcacatgttgaactatttggttaaaccttcagtcaccaagacctttttttttaaaaaaaaaaaataaagtccaaaagcctctctagccccaatatcttcctccgttttaattttatttttattgtggtaaaatatatataacataaaattgaccatttcaactattttttaggagtaaaattcagtggcattaagtacactcacattgttgtgcaaccatttccaccctccatttaatcgttaattttctaacttgcagtgagggcgtgaataggaactcaacacagcaaagatggacagaattcctcaaatttctaaatccttctcttttggtaacttcatcagcttcatgtttctgaagaatggagccttgacattacctatattgcatgtctgtccatctcactcctgcccagctctgtgccttgccaagtcacaaatgaagatggacagacagacagagacacacacacagacacacgtgcaccacccttatgttttcatccttcagctaaaagctctcattcgtaagtggttatacatttggctctgttatttcctgcttaagcacctgccctgggtcccaattcacctcctctacaatcacctcttgaagcctttggaataaagtttccctaggtccgcatcaaatttccttccctaatttttggcactgtccatatcaactcagtgcagccctgcaagtactgatcacacacgtactatgtatgtgtctaggaccatgttctgctttctgaaaaatggtatggacaaggagcttagggtcttggtagctgtgtttgggacatcaaaaataacataaaaaattgaggatgaaggatcaagtatagtgaggtgaaaactgagcatcactgaatcaaaaatgtatgatttgaaagagggctgcagcaactcaaggcagcctgtagggaagtggtctctggactcccggcaggctgggttcaaagtctgactttgccctttactaactctgtgaccgtggatgtttcccttaaccaccccgggcttcatcttcctcatctgtaagatgttgctaataataacatgtatctttaaggctattgtgtggactaggtgagaggtaaggaatttatttagctcagtgcctggcaggtaggaggcactgcataaatgtcagtgaatattattgatctccacactcattctcagcacagagccagactgacggtaactaacgttactggagtcttcatggaggagacaggatttgagatggacttttgattagagttaagattcggatagctgactttgaatgccagaaaaggttcctggagaagggtatgatttatggttgcttaggtagtttagatattaaatgagggcagtattttaggattagcacttggattaatgttttcttttaactgcaaagtaaatgtaggcattttggtagaaaatcagtgtcaccgtcctagccatgatctttctaaaaggatccttcagctcctcagatctttctttttacttccaattctccaaccttgctatgaagtgtggataaaggattaaaattcagcagatcacttcaggttaaagaaaggaagaggctttgccaaataccctttataagtgcgaggcataaattgaggctccattctgaggacttttacaaacaaatagagccaggtacccaaattctacaaattatattgatatccattcataatcattccccctcccctaatatccattcatattaatcctcccgccctcaagtatatggacatatttatgggataaacttgaaaaaaatttaacaaggacattgttattccaggaagtggctgtcgggtgattggttcaagaatattatacaatgctcagcagagctcccacagagcttctgtgctgtcttttctctcacttccaggtgtttataccacataaaactcactgcgttaaccaatgccgagtccacgctcagaatgaaatgatttcctactgtgaaaatggtgtcatccaaacacccacaatagcttggatgtctgctttaagactaatgaatttgccagtttgtatagggcccacgtatttatactttagcaaaagcactataatcttgtttctgaaattttgttcttttcttctaaaacagaaatacagagaactcaagaaagataatccttaaagtttttatgaagttagagggaaacgattccattagtctcacttatcaaggccatctaactctttgtttagataagcattccagatagaaaataagttccaaaaaaaaaaaaaaaatacataaaagcacgcagattggttagatagaagcgaaaagggacagagggaggaaattagggtaaatattatttttccctcaatgggagtattttaaagctaaatgccctgccctaaaaagtcaagagttatgtaaagtattggtggttgtagtcatttgagaaaagtacaacccgaatatgcatttctcttatgggtcaaacagaagtcacgataattgtgtgtcctttacactaccccaagattgttatttaaagatgagcatagtgaaaactataatactatcatttgtccactacccatgtatgctagcaaataattatacatatttttaccaatgaactgaatcagaaattggtaacaattttaaaagtagcttttctgctattgtgcaacatcaatgcccttctattacaattagttccaaaaagataattctcttatctgacagcattataaaagcaaagtatttcatgcatggcagtgttgaggagcttggtcatgggggacagggtgaaaggtccaatggactaccataaatgtgtggttcacaccatcagaggcggatgcacctgctaatctggcttctcagtcaaagtcccccctacaaggcaatggtgtggcagaatgcaaatgggaaataaaggtacaggacagctgggactcttctattgcagaaaaggaaagcaagccgaggaagagagtttagtgtgggcacacttgctgctaacctgaagtgctctctttacttatgctctgttcttaggaggggctgatcatttattataggttctttttatattaaacactaatgagaagccaaataatttatagggagtttcatattaaggctcaatgatattaaatacctggagagcctcacataaacaaagatggattaccagcaatgctcaaagtaaaatttttatacaataataaaaaataaaatattttcataataaatctaaaaatcacatacccacacaagttgcttcttcccatccaatatatactgcaattggctaccagggaggggaagtgaagagacagacacactttttattattttatctcttaaatgttacctaaagacctccatcttaaccaagcagcctatggcttctcctcctgttactaaaaacctgccaacatttcttggtcacctgagagggtatcatcagggcagcttgaatttggtatcaccaaacagtctttgagaaggaaagggtcacttgaaagagagaaaatttcccatccatggataaaccttcctgcatataatgtaactttcaataagcctgataaatactctgtaaaaatagacatcacttctcctaggtgtaagagatatatttgttagaaaggaggcagaggtattgtcttgggattagagatcatttcaaagcgaagtcattacagaacacactctaggttgctcaacactccaggggaatattttcggtggtcgattcacgcacatgctgactacagaggacattcctatgaacaggaaactaaggaggaaaccacagttttctctacattatccatcatcagacctctggacactgttaattcaagtggtttccctatagaaaagatgcaggtcggtagagggaattaagctgtatatataccaatttaatttcatgaaatcagtttgaaatagaagtagtttagctaactggaaagactgtcttacagattctttgaggaattctgggcagtagattcactttccatgattttatttattttttatctctaaaggattcctaagaatacatgataatgttcctaacaattgagtcaagggaaaggtcaaattaatgccttcatcaatcataaatggtgattataaataaactcagaattaaatccttatcaacataaatgtttaaagtcagctttatttggcctacaatgaggaagaaagagtaatgacagctatatactattcacgtatgctattagcaaacagcatatatattattatgaaaaaacgcagggaaaaaaatctcaatttcatctttcctccaaccagggtcgctgctcctagcccaacaggccacacactccatcacacagggggctattcacaccaattattgtctaaatgatgttcttaccacttagaaaagatgtacgtaggacacaatcagtttgttactgtttaaagcaaattactgtcattttattttgctgaaagatttaaggaaaaattaagtaatttaatcccatcaaggtagatggtgtgcctgatgcagtcccttacaaattgttagaaagcttgcttttctttgttattatcatatttaagctttaagaatagtctcagcattaggcaggcatgaccaaattggatcttcctcctaaaggaagccacagaagtcaacacctttaccagatccaatcctacctctctcatctttggcacctttactttcttccactatttaccataggaataatataaaaaattatgtaccttttcctacatagtacattgctactttctcaacagcataaatacccaactaaaaccaaacacaatgagaataagtaggggtcagacatttcatttcttcttactttagcccacaagcctctctctgtcttaactccagtaagtaggttttgtttgtgtttgcttttttcaataactgtcttttaagtaagcctgtaggctagaggtttgggcttgggacttatatatcatctatattccctgcccatccggcacagtaattatttaattcaaaaaatacttgtggataggccaggcctaccctaaatcagttactggccttacgcggcaactcacatttatgattattttacataatgcacggtttctagaaattagttcacactttgctgggtctgaaaatttagtattgtaaactggcatttgtattaacttgataaactaagaagggacagcctcagtgcccacacattgctacattacagaaaaatcataggcatgagtgttttcaaacaaatgtaaaccttataaggaagggaacttccgcttattaagaaagaatcaggataaaggatgcagaaaacatatgcttttggggaaggtgagagaaggcagtagaaaactaaacttaaaaagttttgggtacaaattcccccaagggagtgtaaaccaaacggaaccgagcaacgcccaccagcccctagccctgccaacagctcccccttcataggagagccttgccaatggctttttacctctggcacaaagaccagttacaaaatggacctactattcccaatctcaggctttctaaatgacaaataagcaaggaagaaaaaaaccttctaagcggatcaccatctgggttgaggaatgaatttacgccaatgaagtggtactatgaaattataaacattctggaagactccgtgccttgatcaagagtactgggtgaaagccaaatttggaaacagaaagcaggataaagccaatgtttgtggtctttatcattccgtgctatattggttataggtaacactggacacagtgtcagtgtgaagttaatgaagcctctgagatctgagcaagtggctggcaatagcaaagcaggccaagggaatagagatttgcaaatagaggttaaatgtgagatcctcaaagacgaaggagctcaaggaattacaggggaaaatgtagaagcgctggggcaaaggacaattaaagccccaataatctcctttctcgtaatccccgtcatctctcaaatgtctccaaatttactgggtgcaatagggcttaattgaaagtaatcatataagcatgaaaatgtaaggccatagttatcacagagtcaacactttagtttataacaataataaaatgaaaagcttttatttagaataggacaaagcatctctgctgttctcttttgacattatttcttgggacaaaccttagagcctccccacaaaacaacaaccctacccaactgtgcttcatgctctccaagaatcttccaaggtctgggcaagggggtataggtagaattactctctaagagaagagattaatcaaatctagaaggaaaaaagacataggatatagggagggtgtagtttgaatagcattctttcacagatctcaaccaccagtagaaaggttttctattatcagtaaagatggagaaaaaggccgggcgcggtggctcacgcctgtaatcccagcactctgggaggtcgaggtgggcgatcacgaggtcaggagatcgagaccattctggctaacacggtgaaaccccatctctactaaaaatacaaaaaattagcctggcgtggtggtgggcacctgtagtcccagctactcaggaggctgaggcaggagaatggcgtgaacctgggagacagagcttgcagtgagccaagattgtgccactgcactccagtctgggcgacagagcgagactgtctcaaaaaaaaaaaaaaaaaaaaaaagatgcagaaaaagcagtcagatacatcagaatgaacacttaaaaagcttatcttcaatattcattaggtttaaggatctctcttaatgagaatctatgctttcttctaagttgcttagttcagttttagatgatgacggctgatgttacatattttcacaatgacacctgcaggttatttgcaaaatctggcttaaatagcaatgaccaagggctgaattcagattttcaagattcccaaggttatgtaaatgaccgctgtgtgggcagaatcccttaagctctaactcaaaatcagtcactattggtaaaataatttttcttttactctaacaattttcataaaaaggataccattagatttcacctggggttctgttgaaatattgacattattatagctattttaaaaagactttctgatagatgtttatagaaatgtttcctatgctcagtacatgcatatagctggtctataaaatatttcctctggagtgttaacccttcataaaatctttaattattcgttacaacagaatataatgagataaactgcttttatatccctgctgtacttggaggtagacatatccacagactctgtaaagataaatgcagaattcccggatgctgggaaagctgccatttagctcaaggcttccttactgtcatttcatgagaaatcttaagtatgtaaccacataccaacttaaaagcatgatttttattgtttaactgaaattctagggaggacagcatataaattgagaaaaaaaaaaatagaaacctggctacgcagagctcttaaataaacttgacagctgcccaaagacaggagatttaaataaatgtacattaaactcttaccactaggcacatacatcttttccctatagtatgtagggagaccagttgcaatagaagaaggccttgaaggatgttattacccattctccatctattaatagaataatgcggtagtcaaaagactttcaaaagataaaagcatcattctctctaaagtttttggactcctgcccaaatcacagtcatattttcatatttgtcagctcaaagagactcttttataatagcaaataaaaattaagtgttcacactgggcttcaaagcaaaattctttcagtgatgatgcataaagcacagtatacatctttctttaggaaggttgactgcctcaaattcaatattcaagctggtaacatcacagagttaaagcatactgggacaatggctgctatgatctgattttaaaaaattaggctaattatgcagaaaagcattctcacatgggtgaatccagagccctttcccagaggtgacattttttagaaatgtccttaataaagacagacatggaactgaagagtcaacagggataaaaagaggagggaggatcacaataaagactcctttggcacttgctgggtacagagtagtctcagagtaaataatgaaatcaataaatgaatgtaaaaaaatctatcaaataatacaagccaattgggtgctacttgtttcatggaaaacatactcatagcctaacactttttcttggattactttcccacttagtgaaggagctctttctttacacccaccctcatccaggagcagtagctgccaacaagcagatacatgtttgtgcaggatggaagtagtgataagttgttgacttgaataacaaaaaagaaaataaacagaatactattcagctactagctgactaaagcatataatagcaagcctgtcctctttagaggtgtctagcacacatcattctgtttcagtacagttggtggacttttacttctccctacagagaggcaactggaaatatccaaaacttcagtgcctgggatagtacccagcagacagtaagctctcaaagagttactgagaagaatcctttgaaatgtacttcaaggttttctggattcctgggtaaacctgggagtgtggagcgggaggaatttattcacatctgatttgcatgttgacagccatatttccccaaagtaaacaacaacaaccacagatccatataatctctgaggtttgtttttttgtttgtttggtttttttgtttgagactcagtctcagtctctgttgcccaggctggagtacagtggtgcgatctcggcaacctctgcctcctgagttcaagtgattctcctgcctcagcctgctgagtagctgagattacagatgtgcatcaccacacccagctaatttttgtaattttagtagagatggggtttcaccatgttggccacactggtctcgaactcccaacctcaggtgatccacctgcctcagcctcccaaagtgctgggattacaggcgtggccatcgtgcccggcctctgaggtttatttgtaatctcagagaagaaaaaggaaaaaaaagaaaatgaaatcatttatgaaagacttagttttcagagagaggtacatatattgacataatgaaactatatctatcttcatgttaggcctcttttcctagacataatgatgataaataagcagcagaggccaaagctaccatttgtttcacactttcacatttcgtactttatgttttttgtgcatttatcctcaccaactttatgatgtagctgtgattttgcccgcctcacagtttagcaatccttagagacagtttaaacaatttgctcaaggtcacatggctagaaagtggtaaaactgagtttttaaacccagatgtctgagtctaaaacctatgtgcatatctatgacactattgtctagcttggataatcagaatcttggggtaattgcaggggttggactaacttgagtttcaatcctggctttgccacttgctattggtatgctattgagcaaacttttgcatcattatctgaaaaacaaacaaacaaaacttccaagattattgtgggaattagaaacaatgtgtttaaagtatctgatagctgctcttgccattgttgttactgtcattatcattaaaaggaatgtagaattttgaaattcttttgagactatccagttttctcatttttttgcatgcattttatctgcatataacctgaggacaagagccagttaagcagtgagagttcctctgctggggttcgctagagggaaaagttgagaccagaattctggtttcttgcccagtgcgatttccaccaccctctgctacctatcatttgctttactttaaaaagactaaactaatcccaaatgctgctaatcaaatccaaaccaaataaggatagaaactgttcctcctttgcagggaaccataaaacaggaatgcagaaaacacatgcttttggaaaaaatcaacagaaaaaactcaatactctttgggtacaaattcccccaagggaacacagacctgacagaactgaaaaaaacacccactggtagcaagccttgccaagagttctccgtccccggaggctcggtgtcaatggctttcacctctggcatagtgaccaattacaaaatgggccttccattcctaaccacagatatcctaaatgacaaattaagtgtctgagagataaaaggttatcagggaataagtacaaaatacacatgtgcacgcctgcgcatacacacacacacacacacacacagcctgatgtggagttttaaaaagtctcatttggttttcatcacatttacactagtttttctttgtctagcataactcttatgtcagtagtttaaacaacatttaatatttgagaaaaaagccctatgtggacgtgccaaataagtacagtcacgtgtagcataacaacatttcagtcaaggatgggctgcatatatgataatgggcctttagaattataatactatagtttttactacggcttttctatgtttagatacacaaatacttcctattgtgctacagttgcctacagtattcagtacatgttgtacaggtttgtagcctaggaaaaacaggctttaccatacagcctaggagtgtagcaggcaggctctaccacctgggtatgtgtaagtacactctgtgatggtcacacaatggtgaaatcacctaactgtatcaaaataatactaacaccaaccatgatgtgccaaatctatgtgatcaggggtacactatgaaatggcaaaaaaaaaaaaggggtggagtggggtggggtgaagtgggtatgaaacactttaaggaacttcccaggccaaacagtgcacagccagtttaaccataatatcatcaccactctggggtaaacaatttccatggccattcatgtcaacgtcatatctgtgtttatattcattctcatgagggtagaaataacagcgttcattatgagagatacatcatactaaaatgctcaattagttttctcttgatccagaggcttgttaaaatcaacaccctcaactgatatggggttcaacatttagaagaacctacaaacatgcaaaatgttttattttgcttttacttgtatggctcttctagtcttttgttggggagggtggttaaaaaaggagtttatccatatttctccttggttaacattctgctaaaaaaaaaaaaatcaaaattttaaactggcttataatgcctgtgacaccaagaatacttagtgagcaattaaactacagcactatatgtctactttagggaacttccctaccacatgtctggataaatatttttactttcttgtacaaggaattaacgaatcaaatcacatttctaaaatagtctgcactcattgtcttaccaataaccttttcagtattttgcatacatcaatcttttgtccaagatcttccaactgtctcctttaccaggttgacacccaaaatgcaattctggccgggtgctgtggctcacgcctgtaatcccagcacttgggagaccaagacaggcagatcacttgagaccaggagttcgagaccagcctggccaacatggcaaaaccctgtctctactaaaaatataaaaattggccgggtgtggtgccatgtgcctctaggcacatgttacttgcaagttccagttacttgggaggctgaggtaggagaatcgcttgaacctgggaggtagaggttgcagtgagccgagatcatgccactgcactccagcctgggtgacagagagagactctgtctcaaaaataaataaataaataaaatgcaattcttatcggtgtttacagtatgcatcacttggcagtctggccatattagcgtcagtttacgacacaaatttgttagcatcataaaattacgctaaaatcctttaagctattatagatttcctctcagttactgtgaaatcaacaaacaatccatcacttcctcttagattctcacccaaaagatatcttggttgcatttcttctagaacatacttccctcaactacccaaattaaacatatttcaagcatcattaattgattagatttacaaagagctctgaatgagttcaaaggcactctggatgagtgaaaaggcaattgttcattttcttcaagtaccttcacctttcctttcactcgggaacgaatgttttctaataatttttcttatgaaagtgttacctatcttctgtctcttcccctagtcttatatttcatgctaatgcatgcatttcagtttccattttactgacattactgtttgttataatgttattaaaattcttctcttcacaaatttttggactgacgaaaatattcagtcattacatttccgttttgcaaatagcaagttagatgctgggccgggcgcgatggctcacgcctataaccccagcaccttctgaggccgaggtgggtggatcatgaggtcaggagatcaacaccatgctggccaacatgatgaaaccctgtctctactaaaaataaaaaaattagctaggcgtggtggggcgcgcctgtagtcccacctactctggaggttgaggcaggagaattgcttgaacccgggaggtggtggttgcagtgagccgagatcccgctactgcactccagcctggagataaagcgagactccgtctcaaaaaaaaataaaataaaataaagaaagaaagaaaaagaaagttagctgctacatcactcactattccaatgttccttacatttgaaatctgtagattaataatcataaaagaataaaattaaacactgattcaaacaaatatgaacagacgtttgtaacttaggtgttatccagaaaaaacaacaacaacaacaacaacaacaacaaacaactttgatttttgcttgaaaataaagtcctgaacttttttttttttttttttgagacggagcctcgctctgtcgcccaggctggagtgcagaggcgcgatctcggctcactgcaagctccgcctccctggttcacgccattctcctgcctcagcctcccgagtagctgggactacaggtgcctgccacggctaatttttctggtatttttagtagagacggggtttcaccgtgttagccaggatggtcttgatctcctgaccccgtcatccgcccaccttggcctcccaaagtgctgggattacaggcgtgaaccaccgcgcccggcagtcctgaagttttaaaactagaccaaccagtgctatgatactgcttaattcccataggcatgtagcaaatttgtattttcttcatttgctgaaagaaaaaagaaaaacaccataaccttttgtctctacctttgagcaatttaataaaattaaactttgaaagagattaagagtagtaatcaaagttccaaatatagctaagaaaaagctaactactctggtggaagttacgtatatttgaagcatttttcctcaatataacatggaattaataggaattcactcattatgcatgttctagtataaccttaaatgcccacaggttattcctaattttctggagaaataaaagtcacatggcatttttctatgcttaaacagagaacaattatggattttttaagaagggagagaaggaaacatgcatacttcacttatgcccataacttctagagcttttatgtttcatatgaaaaacagaaaatacatttctaatgtgtcatcaattcttttgaacttctaataatttgaatgtacattttatagcaaatagcttaatgatcacatcatgcagctgacttaattctcaaaatgtctttgtagttttattattctgtaaaagcaaactgtttcaccaaaaattgtactaggtcaagcttttacaagaaaaatatttattatattgtccattaaagcttaccaattaattaccaagtttagtcaatggggttcctttgaactgcctgtgagatgagtattttattacttattattataataatgagtagatttgaaagatttttaccttacaaaatatcaatggtttatttcacaatgttatttgttaaaccaaagcattagtcattctcttcttctacttttctccttcttcccctttccctttacttctgtataagcttttttaatatttaagatatgaagaaatccaacattatacatcattaaaccatggccaaattcacaataaaatgtgcctgcaatcctttaaaaaaaggattatgtatacagaactacgtggaaaacttgctgttctcagaaaagaacagaatgaaacagataataaataaatttctatatccaaggtagatctttctttttacaggaggtcgggtaagttcatacagaaaaactctacagaatgggcctgtcgttaaaaataaacgaagcaaggattattgggtttagatcattttcttaagaatcaaaaaagtttttctagggctttggctaagtacatgaagataaatgatgcccaattctggttttgccaaataacacaagtcttttcagaaactacaaattccagtggctctggcagaatgaatatcaacctaggtcagttctccataaccagaacccacaaatttgccagtccacttcacatctcaactattagataatagcaggcaagatgcatgttcctggtgggcacagttgtttatgtggtgattcttctttgagttgttggtgttttctcgctttcttccctcccttcctccctttcctcccctcccctccacctaatagagggcccacctctctacagggtgctcacctctaactgtctccagcagtagaaaaggaagtcagaaagctaagcaaggcctgggtcaggagagctatttattttcatgatgagaaaccaccgcagggctctgggaagggaagtggcacagtctgatttatctatttaaaaaatccatgtaaagagtatggggcgggcaggggcaagaatggaagcagagatgccaggtaggaagcaattacaagaatccagagaggaatggttgcaggttgcttggactagggtggtaatactgtaggttcaggatatattttgaagataaaggcaactggtcttgctcatgtgggcactgagagaaactggggccagggaactaggtaaattgtggggtgggtggggaagagagggaaggatgctactttgactgagatggaaaacaatgggggagaagttgggtttgagttgtgtgggggcttcaggaatcttttgaccttaaatgtaagatggcatcagacataccagtggcactagaagctgtggaagcacaggaataatctagaaatcggttgagagctttggctagagatttaaatgtaggactcatcagtttataggcatcattggtgtatttaaaaccatggaccaaggaccaggcgcggtggctcatgcctgtaatcccagcattttgggaggccgaggcaggtggatcatgaggtcaagagatcgagaccatcccggccaacatggtgaaaccccgtctctactaaaaatacaaaaattagctgggcatggtggcatgcgcctgtaatcccagctactcaggaggctgagtcaggagaatcgcttgaacccaggaggtggaggttgcagtgagccgagatcgcgccactgcactccagcctgggtgacagagcgagactccatctcaaacaaaacaaaacaaaacaaaacaaccatgggaaaggtgagatgacctaggatatgagtgtaggtggagaagagattaaaaacaaaatgaggcccgcattccactatttagaagtcaggacatgtgagggtgtgataagcagccaccagtgatgaaagtgcttcaggaaggagggatggatccgctgtggattgcgtagtagttgagtcatgagagaactgattggcatgacttcaagagggaaaatgggaggggaggaaatggaggcaacaaagagacaataaatgttctctctaggagcttcacgataagtgtgtgcttgcagagccaagaaagaaacttgctggaggagggctggtcagtggggagtgggcgggggtgttggggaagataagaagggatttttaaaagattttaacgggctatgtatataattttaacactctgtatcctgattgtaataattcactagagagaagaacaaagtgatgatgccagaaagaaaatgtaacttcagtaggtgaaaggaaaaaggatatggtaagaaagtgtgtgtaaaaggttagtagattttttgttttgatgatttttattttctcagggaaacagggagtgaggtcatccactgagaaggtggaagggatactgaaggtttgagagaggaggagaaactatgaatgagtccttcccagagaagtgaccagctaagattactagaaaatttggggccccttgagccttatggtcatcaatttaataagccagtcaggagtagtattgctggtttttccttctgtcatgttcagtttttctgatgcaggtatggagtaagtgagttgaaaagacaggaattgtcaaagacagtgcttaaagatgaggtttcacaggtggtacagctacttataatggccaagtctggttgagaatggcctgagtgggtggctgagatagagtgaaagaaagattgttggaaggaaagtgctcaaggaactaagagaaccaaagctggataaattttctacctgagagctggagtttccaagaatgacagacagccatgggaagaagaggtgtcaaaccagcgctcaaaagcttctatgaatgatggtcagaatcaacaggaagctgtacaaaatgtgtccagaacagtagtaggtagaatagtgcaatggcttaaaattaaaaggaaatggaatttttaattgcaagataaatggtctggaagtggcagtaaggaacaagaaagacactcatctcaactctggaccccatgttacatgggcatgggagataaaaatcacagcaagtgaaggatagaaaatgaattaagatccttctagggatcttacagggccttagaactacatggtaaacaccaccatgtctggcacagagccaaaaacacaacagggtttgaacaaatacttgggttttaactaaaaggagtttaaaagtatcatcaattctgtagacaaacagcctagatatggggctttagaaaaagtccacaagggagtggttaaacagcttgagcaagagacttggaatatatgagaaaagggatgaaataaagaaatgacctggccgggcacagttgttcgcacctgtaatcccagcactttgggaggccgaggcaggaggatcgtttgagcccaggagtttgagaccatcctgggcaacacggtgaaacttcatctctacaaaaaatacaaaaaatttgctgagtgtggtggcatgcgggaggctgaggtgggaggatcacctgagtctgggaggttgaggctgcagaaagctgtgatcatgccactgcactccagcctgggtggcagagtgagaccctgcctcaaaaaacaaacaaacaaacaaaaaacaaacaacaaacctgatcacctactgagtagctcccgactgcactctcagctattttctatcctactaccttatccttttccttgatttctttgctaattatttgtctgcttttctagaattgctaattttctgattcactacaaatgtatcagcttaattactatttcttttgctcgtcactatatacctaaggcctagcaaagtgtctggcacatataatgtcctcaaagaataccaaataaacaaaatagagaaaagcatggttagaagtagcccaattaagttacactatgcagagacaggccaatataggttcaatacttctaaggatcccatctttgggatggaattgacatttagaaagaaggcagtgaaaaacaaatactgattcctgggcaacagatcagggaggctgcattcttgtaggcagagggctaaacagcacttgactaaggagtaagcttggagtggctgagagagatgtgagtcagcttcctcgtctctactcaaccatcttcaaagtcctgcctcatgtgaccttattcctacgatgatccattctgtccacagtggcctttcatgttctgtacttcctgatctaacagacaatcgctatttccactgtactcctagcttctacatcactattacgttgcaactgtgaacacggacatgtttgtcgtttactgggtatgtttactgagtagtttagacgtacattgacatcagacagtttatcttttagattataaacttgtagaagcaggggtttgtagtctccataatgtaatctttggttcgttaactcagtttgtttaggtcaagggtgaaggtttaacctccaaacgagttatttagttttgctttgctccactttctcaaactacctccaactcaggcattctcagcacactgagaagtgttaaaccaagacagaataagagaaaaaattcacatttgaatgaaaattccaaactttacaattgcaaacaccatacattaaaaagaacagcagtgaaattccaaagcacctgaaaaatgagttgcaaaaacaaaaaggtttatataatctaaaattcccgactgcagaaatatgtaaatatatatttaaacttgaaatatatggccattgctattaaatgtaaagtcaagtaaatttatgttaaagtaaaatgtagtgttctcattccactaaccataaacatagaagtttagagctgggaaggaccttgcaggccaggccccttattttgtagacgaagtaactaaagcctagaagggttgctgaggtacccagcatcagacagcagcacaagtcagcagcactgaagtggagacaccacaggctttggagacagatccatctgcatttgaccctgatattccaccctttagctgtgtggcattgggaaccctcactctttcaaatttcagtttcctcatgtatgaatgagggatcatatcactatggtttattgagcaggcctgtaaagattaaaagtcttaaacctgaagtgcctagcacagaacttttgggctaaaatgacataataggctgcgcaccatcgctcacacctataattctagcactttgggaggccaaggcaggtggatcacctgaagtcaagagtttgagaccagcctggccaacatggcgaagccccatctgtactaaaaatacaaaacccaggcgtagtggcatgcaagtgtaatcccagctccccgggaggctgaggcaggagaactgcttgtacttggaaggcggaggttgcagtgagctgagatcacaccactgcactccagtctgggcgacagagcaagactcggtctcaagaggaaaaaaaaaaaaaaaaaaaaaaaaagacataataaagccagattatagaatctttcccctaatggaataaacttaaaatcgctgttaaaagaaaaaaaagtcaaaaatgttaccagagaccaaccaagttaaagagaacatcataccatattctgtataagcggtgcccatgaatagaagattcctaggtaaaaagggattgcattggaggtgggaaagttaggtggccaaaatcctgaaaactatcattaacagcccccaatttggggaaaatggatctaagctagcattttggcagcccagggaggagatggaaaaatccatccatagtaaaaagctcttcctgccatcacaggaatctcctcagacacagaaaagcaaatcagaactcaccattttggctttttatgcctgggaggaaaggagaagaaaagggaaatgagtcataatcaagcaaagctaattaattacagccaaactctattataaagctgtatgtaggagtctaacaaattcaatcatgtatgtgggatctcattgttgtagagctaataaaacaaggacaagggctgggatgaagggaaggagatagccaattgccagttgtgttaaatcttagttggtgctaacatgaggttcgctagtctgtatcagagtttactgtatcttaaacagtaaacaaaggtctagccaaagagaaaaataaataagggtgtgtgtgtgtgtgtgtgtgtgtgtgtgtgtgtgtgtgtgtgtgtgtgtgtgttgagggctgggagagaaggagaattaaaggcagaaaattcccaggtgaggttcccttccctgtctgtggattaataatgccatggtaaaagcatacaggtttctcctttctccattagctggaaagagataaaaacacttgctgggggaaagataggatgtggcaagggaaggagacacctgaggctgacattcttagccaaaactaatcaaacaaatggcttgcaagcacctccttgaattggaggaataatccaaagccccgtatctcactcctccagagatatatctgtgaatatgtagagcaaaccctgatgcagggcatttaatacaattactgaggaagagcaaagatcctaccaacaactgggattgtaggatcccagcacgcagcccagctcaactaactctacctcatctccagcatgtgggtcttcaggtcgactcctcaaactgaatgcagctctgggactagaccccgaggtctaattagagacggttaaaaagcaagacaaggacaattcaccaacattagagaatgaagaaaagatcctgagtgagttgttcatattcaacttaagttttacaaagagaaaagactatgacaactaagcaggactcccagagcaaagaaaaaaatgaaagaaagggggagggctgggaaggaagcaagaatctagtttagaagaaaacagccctctccaccttcctccaaaaatctccgtgagtgcattacactacaagattaaagaaaatagaaattaaatgagacaccagtggaaaaaaatgagataaaaagggaggttgcagaaggaaacaataaattaaacaataacactgtagaactaataaacaaattagaaagaaaagaaatagaataggcacaggtaaaaaatagtgacatagcaaaaacccttggaaacttgagataatgacagtgaatacgtaagatgatgatatacaaattaaggcaatttgggaacagaggacagataatgacaaacaaatgtaagtgtccaaaataaagttggaactactgtagtaggttccttaacaaatattagtaaactttaccccacctaactcctatcatcatgtatgtaaaaacagtgttttatggttcttttggtcttctatatgactacctacagaagcaaacaataaaaatgaactgataggtcttgtaaaatttgccctgatgtctattttgaagtgttataaattcggtatttgcgtaacagtggttctcctggagaaaatcattagaaatttgatcctacaccctattcttattcactgaacagaaaagagaaatctggaagcaatctggtaatataaaactattagtttatgctgttggagcctttatctaacaaatttccaaaacaactacagtcgttaaaatagtgaaattattatttccaagtggacatatatttttattaaaagaacaattaagacagtttatttgatatattttaacacttttcattaaccaggggtcatacacttgctaaaatacttttctggaagcacaggtaatattcagaacaagagtcacaattgtgcccactcagcattccttcacattgatcagaactcacttcactgagaagtactgcactaaaggatttaatgagacatgctactgaaacataaatgtacatagcccggagctgaaggattttataataacaaactcatacacacacagaaccgcaaatcattaccttcactgccattctgaagagagctggcactttagtcgtaaagtttttccttaagtttagaagtgtccctgattgcaaataatattcaacaaaaaatttataatcttaaaaaagatactgctaaataaaataaaagctacatactgcctgccacatggaaggtgcttgataaacatcagttagataaataagcctcaagactcacaagacaatacaatgatttaattcccattggatatggtattgtggaggactctaaatttctgagtcagcacccttcatttcatgttgtttatagactagctttgtaaccagtattctactcaatagctagagtattcacaaatacactaaaataatgaagaataagccactgtgtaattaaatatgaataatgaagacagcacttataacagtttgacttctatttcaagtgaaaaacaggaagttgcctaaaaagttgctgtgtttaaaaatgggtctttttatggatttataatacaatcaagggaccaacttttgcagtttgttctcaaatattaggagatgtagtttcttcatcatttgaaatgatgacatggaagacagcatgcataagatcaaacaccttttactcaaaatacagaattaatgggcttgctcatattccaaggatgtgtcttcttaaacactggtttgtttcatagttctaagttttttggagggcctgacttaatccaaaaatactgtggcatgcctacaagagttaacctcttatattttgaagtagaacaaaaagggaacatatattctgacaggagattctatcataatcgctcagaacactgaactttttcaacttgatgaaaggtttctccaagttagaaatactataagtaactctttccaaaagactgctcgtatgtgaagagtgaaaaaacaaactaaacaaaagcaaaaacttaggactaaagactaacaaatgcatatgaagaaggaaagtgcctttgctcaaggtcattgtgctaacagaatgacttgcttagttcacgtgcagatatttgttggcaaatgttaagcgatgcagaaaaaaaggcactacataaatgtgaaaaacaaataagtaaaaccataaacatgaatgttgtaatttgatgattatgtgcaagatcaatcaagtagtgaaagtatgtagtattcaagtgtttaaagtggcggcctgggcatggtggctcatgcctgtaatcccagcactctgagaggctgaggtgagagaaatgcttgaggccaggagttcaggaccagccagggcaacacagtaaaacctcgtttctacaaaaattaaaaaaaaaaaaacgactatgctcaaggtagtgaggaaccacttctactaagccagatggaaattgctaagaacagaaagacgacgatgtcatgacggctggttaactatgggagcagctggggtttgaatttctgttaacagtaggagaaaataaggactggagacagagggggaatctgagaaattctctattttggtggctaagctaacacaatctactcacagctttttttcatttgattaccatttgaaacagattacttctccatttgagggtaatcgtgaagcaagatttcaactcatgctctatcactacccattccaggccacaaattaaaatagcctattactacttttatacacacaataaagagatcttccatcccaatcttctccatgcttttttttttctcagcaaagttcatgtaaaccagtaggtcatagtaaatcctaaaatgtattcccacagtgagatacttggaacattttccttctggattttattaaacataatgttctaagcattatgagtgctctaaggtatttcttgaataataacccaaactgcagagtgaaagtaagtggcaattaaaatcccgagacagacgggaacactgagactaagaaataacagcatctgttcctgacgatggctggactgctgatctagcttggggtcagcaaacttggcctgagggccaaatccagcccactccctgttttcatatggcctgcaagagccaagaatggttttcacagttttaaatggttgggggaaaaaaatcaaaacaatattagcatattaagaacataaaaattagatgaaatacaaatttcaatgtccataaagtttcactgaaacacagcaagattcatttgtttatatattgtctattgcagctgggtatgggagagctgagtagcagggactttgagtatggcctacaaagcctatatttacaatctgaccctttagagaaaaggtttgcagaccatgagcttgatcagaacttcaaataccatctgtggtgaaggagctggtttgttttgagtatttgttttctaacccatcatagatctgagctaagcttttgtagaatacaaaaatcatatactttggatgttgcagagatgtcagattgctataaatttcctaaatgtttactctcaatttctgtatttatcttcttgcatactcaaacagatattttgtggactggcaccagtctgcaggtggttctgtgtaggtattctttgtgttctttagatcacacaaattttctaaaagcactgatctagagaacacaagaataccttcacataactttttggaaaaccttacttactccttccctatatactccttccctatatattttcgatatgatgaccactaaaaatatcagtaaataaatatattgctttgtaaatatattaactagataaaattatagtttttccatgaatctttttcaagcattatgctttatgctttaaaattataaccagtttcttccttaccagctaccacattatatatttttactgttctcttagactttacataaaagaattttttttttttttttttttttttttacattttgtgctttggggaataactcaaattccataaacaaaactattagtacaaatgttttctggacaatctgtgctgtgattttggaaattgtgtgtgaaagaggagagtagctgggcgtggtggctcgcgcctgtaatcccagcactttgggaggccgaggagggtggatcatgaggtcagttcaagaccagcctggccaagatggtgaaaccctgtctctactaaaaataaaaaaaatagccaggcatggtggtgggtgcctgtaatcccagctactcgggaggctaaggcagagaattgcttgaacccgggaggcagaggttggagtgagttgagatcacgccactgcacttcagcctgggcaacagagtgagactctgtctcaaaaataaaaacaaacaaacaaaaaagaagagagtgaaagaatttgagtccttgcacagacaataactgttttttatgtttaaactttttagtttcttatgttaaactttttatgtttaaactttcaaaaggttgaataaatttcatcttatgcttgcattataatagcaaagttccttgatatgtcaaaggccacaaaagtaatttttagcttaggtacaaaacgtgccttgggcctgttttatatgatactccttggttttagcactacattaaaaaaaatgaatgtgaaaaaaatcatttccatgaaagttttttaattggctcaaagttagtagcaatttactttcaaatttcaatctttatctctctagggaaatacttaattctactgcaatttttatttaagaaatgaaataatttctaaacatttttaaactttaagaaagatgaaactctgttattgtgccaatgactttttattattaggtgtcagatgataaaacattcaaataagaaacagcactgggatttcacagtgtcaggagaaaggaaagtctataaaaagaaactcaaggtgtgtttaagtatgtgaaaagagcagataatccctaaacctgttttatttgaaggcaaataggaagatgcttgctttatttgttgttacagaagaatgttgttgctagcaaaggataaaatctcaaagcagagggagagggaatataaaatggctgtagattaaacttctgcaaatgttcactttactacgcagctccactgtcataaaacagtcaaaatagtaagatatactcattcagaacaatgacacaatgtttataaatatttatatgtatgctgaactagaccattactaaaagctgcagctggggtatagaaagaaaactaggatttgattggaggccttattttgcaaattactaggctccatgatcttgtggaacttacttaacctttctgagtctcagtttcttatccataaaataaatgagattctacctacctctgaagaattgaggaggataatatacgtgtcttgtataaagcactatgcaaatgtgaggggttattgttatttagtagggagctcagagaatcttaatatgtattatatttaaattttctataaataagtgaactttttatacagcaaagtagattgagttgtttgtatatgccctttcctaatatcactatttcttgaagcagagaatatattgaggtaaatcctcattagaaaatttattacgcaaaatttaaccaactgtagttgtgatcagtgctactgatggtcagtgtgctatgggtgtgaagcaggaagaccttttcatatgaagagggtggagggcaaaggtggtagggatgggtagaggcaggggcaggtgcagtgggaaatacattttgtaatgccgacgcctgaaggaagaggaggtgtcagccaaaggaatgtgagaacaaacattttctatatttaatgagacaatcataattaatacggatatatcaaaagttctctgatccatcataatatctatttgttgattcaaaagtgacaagcaataattattatgtaggagccttacgctttaatgaattatctatgatcacttaaaaacactaggttttccatttcagactaagtagtgagatggtaatagatttttgttaaccttatacagatgtacattaaacatatggtataagaatagcattctattttcaaaacctgagattattgattttcagatctttagttgaatatgtatcggtacaaagacttctctgttccatacaagctatttctcatcttctacttaaaaaaaaaaaaaaaaaaatcaccaaagacaggggagctttcttgcattcctctaagtggtagaattatcctaatgtttgggaaatcagtcctggcatcctttagtctggataaaacatttgaagaagcatggtatgacatacaggcaaggaagacccagctacttcagtaaggttgctgtatatatcctctccatccatcatctgcaaataccttcctctgtcttgggatccaagccctctgccaaggtgtagaacttgtatactgatttctcattatttggaggtgattaagctaatcagttaatacaacaaaaggagaaaaataaggtaattactttctaagaatatttccatgttccatagcccaattcctcactggatcacctgtccactccttgaacatcatgtccctgcgtttcccacttcccagccatttcatgtctgccacagaacagtttcctttcacaccaaatgcttgataacctgaaaagtgagtagaaactcatattcaactttaagaactcatgtaaacaggttaggttattgagaatccacacagtgttaggcctctagatcaaatattttacataaatagactcatttaatactcaaaacggtcagtaaaattaggcatcattatccaaagtttgcttccaacatactgctaactaggaccacactgcctctttgcataggaaagaacatattccttttaaaaacactgttcttaaagtggaaactattttatggaaagagcatcgatctaatttctgacctccactccagtgtttccacattgcaccagctcttcggtaacatatgtgccatactccaacatcactttctggaatctgcctaagaaatagttctttgggtgaaagtctctatacttcttccagcactgaaatgcacatctcctgctttagattaacttaataacaatgtcttagttaacttgaagttcatctaacaaacatttatcgagcacatttcatgtgccatactagatggagaccttaaagaacctgcccctccacctaaggactgtaagacaaaggaagatagcagcacagctggaagactctacacccttccattcaatcctgataccccaatacttttcttccttcaacaacaattaggttactttagaaaaggataaaattttcgatctaatcacttttctgccaagctaatacagtcagatttaccatttcttctttacagagatttataaatatataaatattttgcaaagcataccttgtgagcttacggcagcattttactaggattacaactgaaattaaagctccaaaactggaatagattttacagtttaagaaagaatttttcgataaataaaacacacttctaaaacttacaatttaaagtagggcaggaaagtgatgttagcaaaaatggcagagtaggcacctccaagtgccccatctcccaaggaaacattcaaaattcaagaaaaagctttgagaattgacattgttagaactctggaaaacagacaaaggtttacagcaactaagcaatgccgaatcaagagtaaggcaatttaaaaatggtagaaaagcacagtaacagttgcatatgttctggcccaaacctgtttcctggctcagcagcagtcttaaaggcaacagtctggatttccagtgtgggaccctggcgcctggttctgaaggctgcacagtgtaccttatttacaaagaattgtttttgtcatttctaacttatctagaggctacctgaagaactttgtttcacctaactcaaaacacattcgaggtggaaaccctgcagctgcctaggacaaaagattaaagttgaggcatacgagtcccaaaaatatggaaaagaaaagctggagagagttgttgttgttgttgtcgttgttttgagaaaacagggcattcaaaagtgtctatatatactagagaatttacaaagtcatgcacatacccacagcatgatatacattcaaaaaaagaccctgagagattttcttccccccaccccacttcctctctcttgcttgtggctcctggcattcaagaaaatctctttcagaacactatctgaatggaagctaaaggaataaagctatcagagaccacatatgataaagaatacatccctcgttttaatagtttagaaatgtcactaaactaacagctgcagcttacagcaaacaacaacaacaaaaccctgaagaaaagaaagactgatttccagggttaccatattacaaaagtcaaaatgtccaattttaaacaaaaaatatataaggcatgcaaagaaagaggaagtatggtccattcacaaaagaccatacttcctctttctttgcatgccttatatatttttcacaaaagaaattaatagaaatttcacaaaagaaattaatagaaatttccctgaggaccaaaggcactaaacttacagataaagactttaagtcagttgtcttacatatgcccacagtactaaaggaaaccatagatgcactaaaggacatcaggagaatgatacatgaacaaatagagaatatcaataaagagacagaaattataaaaaggaaccaaatagaaaatctggagctgacatatgaacaaatagagaccatcaataaagagatagaaattacagaaaggaaccaaacagaaaatctggagctgaaaactacaatgactcaaataaaaagctcactagagggttttaatagcagatgtgggcaagcagaaaaaataaccagtgaacatgaagataggtccactgcaattatccaatctgaggagcagaaagaaaaaaggatgaagaaaaatgatcagagcctaaaagaccagctggacaccataacagtataccaacttacacataatgggaagcccagaagagaagagaaagaaaaaaaatgatttgaagaaataatggctaaaaactccccaaatgtaaaaaaaagacacaaatctatacagtcaagaagctcggtgaactccaacaagaatcaatgcaaagagatctgcaccaaaacatctaataatcaaattattgaaagccaaggaattttgaaacaaggtatttttaaagcaacaagatgagagaaggaatttaccacatagaagtgagcttcaataagactaagagaagatttatcattggacactatggggaccaaaaaggagtgggacaacatttttaaagtgctgaaagaataaaaaatgttgaccaagaatttcatatatgaccaagacatccttaaaaaataaagcagaaattacaacattcccagaaaaaccagcaccgagaaggtttgcttttagtagacctcccttaccagaaggctaaagagagttctttaggttgaaacaaaaggacactagatagtaagtcaaagctataacaaagacataaagaatgccgttaaaagtaaccaaatggagccaggcatggtgatttatgcctataatcccagcactttgggtgaattgcttgagcccaggagtttgagaccagctcaggtaacatggcaaaagcttgtctctacaaaaaaatacaaaaattagctgggtatggtggtatatgcccatagtcccagctactcaggaggctgaggtgagagaatcaactgagcccggaaggtcaaggctgcaatgagccatgattgtaccattgcattccagcctgggcaacagagtgagaccttgtctcaaaaacagaaaaatagtaatcaaacaggtaaatataaaagctagtatatattttaaatttgtaactcctctttttactttctacatgatttaaaagacaaatgtggccaggcatggtggctcacacctgtaatcccagcactttgggaggccaaggcgggtggatcacctgaggtcaggggttcaagaccagcctggccaacatggtgaaaacccatctctacaaaaaatacaaaaattaaccaggcacggtggtggctgcctgtaatcccagctactaaggaggctgagacaggagaatcgcttgagcctgggaggaggaggttgcagtgagtgaagattgtgccactgactctgtctcaaaaaaaagaaaaaaaaaaaagacaaatgcaaaaaacatttaaataattttaaacatatgttaatgggcacaaaatatataaatgtaatttatgagaacaacataaagaggaggagaacaaagccgtacagaagcagagtttttatatgctgttacgttggtatcaagtaaaagtagactgttagaaatttaggacattaattgtaatccccatagtaagcactaggaaaatgtctttaaaaaatcacaaaaggaaaagagaatcaaaacaatacattccactaaaacatcaactaaacacaaaagaaggcagtactggagggaatgacaaaaatgtgtaagacatacagaaaacaaatagcaaaaaggttaagattcttgttggtagttacttgaagtataaatggatcaaactcttcaatataaaggcagagattggcacaatggagtaaaaaacatcaggatccaaccatatactgtttataagaaactcactttagatccaaagacaaacattggttaaagtgcacagatgaaaaaagatattgtatgcacatagtgaccaaaaaacagttggtgtgactaaaataatatcagctaaaatggtcaaaaagtttttacaagacaaaaaaagatattatgtattgataaaagggtcaattcatcagaagatataacaattataaacacatatgcaccaaatatcagatctccaaagtatatgaagccaacatttacaaaattgaaggaagaaatagaaaattcgacaataataattggggacatcaatacctcactttcaataatagaaagaatatctagatgaaaaatcagtgaggaaataagaggatttgaacaccattataaaccaattagacctaacagacatacatagaacactccagccagtaacagaatacaccttcttctcaagtgcatgtggcacattctctaagacagatcatatattagaccacaaaacaagtctcaataaatttaaagtatggtaaaaattattacaattttaagttttaaaaaaattttgtttcattttcaaataaatgtgctggctaataaatgtatgatattaataaaagatgcactgttaagccaaatgactgccaagataatacctatgcaaatttatgggaggagaaatgagcaaaaatcccccaagggcgctttttatctatgtgctaggcaatagagacacaatagagaataaaataaacataaaatccttgccttcacagaggtcatattttggtgggggagatgatcaatatatctatattaagaaacgaagagcctagtttcaggttctaataaattttatgtagaagatatgctaaggtaactgtgggagagagtaacctggaggattgcttttgctaggataaaaggggtaacgatactctgcctcttttcctctggcactggctatagaggtgcagttctctcttgggacctatggacttattattcctactactttctgcactgatttgcacctcttcctgtttttgatcatttgtcaccttctcagtgaggccttccatgctcgtgatcatccaacgttgcattcctcctccctcctcactccctgccccactggcaactctccttcctttcttcttgcattgtaactcccacacttagcactatcataggatacattttactttgctatcttgtttactttttttttccctttactatactgaaagttccaagacaggagcatggcttgtcctgatcactgctgcatctgttgtgcctggagcagtgtctgacatatagtagatgcttggtaaatatttgtcgaaagaattaatgagtggagatgtcaagcagacagacagatatataagtctatagttcaaacgaaagtgcttgacgggaagatataagtttgaaagtcaaaggagattaaaatgggtattgttttcttcaacataaagatgtagaaattggttcatataggcaaatgagtatgtacaatgatatatcatcttctcattatctcacaagctgaagcaatctagctggtagaagagataaacatttcctggtgcatattctaaagggatattaacatttggacatttaaaaacaagaacactaaaacacataatgaaataatctatccttaacagtgattttcttattgtgacccttgatgacagctcaggtcactacaaaagtaaatgtgcttcagtgaaagaatcttacggcccaaaccaatgaggctagggcacaaagatttcctgagctctaacttaatctaaggatagaatttagaatacctaatgatgtagagacagcttgtcctcctttctattctgttgtgacaggagcattcagttcaaggttgatctctcttgtggttattttgtattgctgagtaaagagacgtcaagatgttttgtaaaataggtgcccaagttgcaagactgaaatttcatcatataaatatcaatatgtctgacttgttttcttgccagataagtagccacttcacctctttgtggaggtgagggttaagtgattcttccaaagtcacagctagtggcagagatggggcttgacctcaggtctccgaactcccagctcagagtattccactttcaatcctctgtgccttttatactcacatattaaaagataacaggtcacatttctggaacactgtgggtgggatcctgaggctgtctttatttgtaaccttctctaaagcacctatcactgcaggaaacagaagaggcttgtttttgtcagggtttcttgtatcttgtccttgtaccacatggtccaaatgttagggctctaggcatctgcccttccctttagtttctctatctacatccagttgtggactggggaataccaaagataaataggaaataggataactgcttctatatgaaacaaggttatggttaggcttgaaattttttaaatcgctgtttagattaggaaaaacattaataagtagagtcatagactttagaaataattatatatacaaggatcaagcatgtgatcttaaaaacaacaaaaaattatttccttggggggccaaggtgggtggatcacccgaggtcaggagttcgagatcatcctggccaacatggtgaaaccccatctctactaaaaatacaaaaattagccaggtatggtggcacacgcctgtagtcccagctactcgggaggctgaggcaggagaattgcttgagcctgggaggtggaggttgcagtgagccaaggtagtactatcgcactccagtctgggtgacagagagactctgtctcaaaaaaaaaaaaaaaaaaaaaaaaatcattcccattgattgattttatattttaaaatttactagttgtttgtgatgcaaaaaccacttttaaaagaaagaagctgtacctaatcccatcatccaaatggttgaagtgaacattaaattttaaaaagggggagaaatacacacataggtttagaaaattccaacagtagagaaaggcatgaaacataaattaattattcttacttgtatgtattatatttctgtgtttccttccagaacaaaatatcttttatgttataggagtctgtgttggcatgtattaatttaatgtatgtctataatatacacaaaacaacccatattgttcagacttctatagcttgccttttttgactattttatcctgaaggtctttcgatagcagcacatattttttcagggagcatatggagttctatactacagatgtaatgtaattaattcaaccagttccctactgataggcatttaggttattcccagtttgttactattattagcaacactttaatgaacatctttgtacatacagcttggtgtactttcacaagtatattcttaggggaaactactgatggtaagagtataggataaaagggaatgtgcatttacaatgttgacaggtattaccaaattgttccctaacatccttggacaatttgtactctagctaacagttggagaccataatatccataatacttttaatcaacaggtacataaaataaaaagtatgatgtaaatataaattatacttgtgtattctatcccatgtactccatctctggggctaccatgatttatacaagtaattaccattaagtataatataacatatctggaactttatgttaccaaacaacattaattcactgagaaaacaattcatagtcattgctatagaatcttccataataatgatcctgggagttggaagccagctccaattatcaataattggaaccatacaagagtgtgttgtgtgtgtcactttttgaacagtaagtttcatttcgaaatctatctgaatcagcttgtaaaacctcaaaaccaaaacatttgttcatcatctctatgcaaggattgatcagaaatatatagtaaatgtatactctattttcctcaaaagtaatgagaaataattcatagtagtgttctagttaaatgatgtgaacagatttcatcatttaactttggttcatttaaactggatcaaaggcctaaaggatatatgaaaattttgaattttaaattatgaagacaattgtcctatggatattagaagaaaggaaacagaaggcagtggttagaaaagagttatcaaaataaggtttttttatttttatttttttttaagtgagggctgtaaaactaatctcagcttctttctttacaagttatgtgacttcagagaaaatacttaactctccaggctttaaatgaggtaatgaaaacatttagtccagtacctggcacctcgatagtaccacatgaatgtgaactgctattaatctacagcctctattaccccattattaacagtaggtctgaaaaaatagaaaagaatgtctcctaggatatagacaaaaaggtaataaaggatgggaagaatttgagagtagatgtttactacctaattagcacatttatcccctttctcaagtgaacaatgaacgtgttatctccaaagaagcagatcacagtgcaagactgtcagatttccacattatgattttggttttccaaaacttttgcagactttggcatggtaaaaatacatcttgaaagccttattctggaactgaagaatttaagttagtctgctttgggtgaaaaacagtgtttcccagtaggagccagcacagaaactcatagggtcttctgacatgaaaggcaagtttcagctttatttcttcacccaattttatgaatttcataaaaaataaattcatacaaaatgaaaattcaagaatataaaattgactctaaaatataactgatggctgggcgcagtggctcacgcctgtaattccaacactttgggaggccaagacgggtgcatcacctgaggtcaggagttcaagaccagcctggccaacatggtgaaaccctgtctctactaaaaatacaaaaattagctgggcatggtggtggacacctgtaatcccagcttctcgggaggctgaggcaggaaaatcccttgaacctgggaggtggaggttgcaatgagccaaaattgtgccattgcattccagcctgggagacaagagtgaaactccatcacacacacacacacacacacacacacacacacacacacacacatacacagagtaacttgaatattttacattctttgataattgattgccacgagaattctggaaatagttaattcttctcagcaataaatttgccttatttttaaatgctctcgattcaaagattcccttgatttgaccttgtaatttctctttttatctgaagattgcagaagagagatggtaactacatgggccacctattcccacagctgaggccaactgtgcagaatactgaagcctttttccccaaggagcctggttgtggccacagagtgcttctcagcaagtgctacctgttcctccctcatcttggacaggaggtggcactcatttgtcatcccttttacagaatattcactttacaggaaggtcccactaaaatcagttagtatagtatcccactgtaaagtcatttcactttctattttccttttgtttaaaaaaattagtatcttctcccttgagaaagatgcctgaaggtatttctatactggttctattttattttattttatttatttatttttttgagacggagtctagctctgtcccccatgctggagtgcagtggcgtgatctcggctcactgcatgctccgcctcccgggttcacgccattctcctgcctcagcctccctagtagctgggactacaggcgcccaccaccatgcctggctaattttgttttgtatttagtagagacggggcttcaccgtgttagccaggatggtcttgatctcctgacctcgtgatccgcccaccttggcctcccaaagtgctgggattacaggcgtgagccaccgcacctggcctctatactggttttaaacacttagttacttaaaccaaaattcataggctccctgagatagtagggattttcgtattcttctaatcttacttcttcctaatgtagaaatactttctataacatccttgatgattagacactgaattccagagctaacactctagcaatgtagaactggctgaggagtaccttgttacaagtaaaagagcagtggatgaaatgttgggatagctggggttatactcccaccccactcctgaaggtaagcgacttattccattgtgcaccttggttttctttcctctaaaacatagttgttatttattgattgctaagatgccttagaggcctgccaatttgcaaaacatttcataagaaaatctttgccaggaagtcctaattgttagaaatctgcctcctttaacttctgcccaggccctctaatcttgactctagagagattcaaacaagtagattttcacacaattgaaagctaggtatcacatctgccagaagcattctttcttccggaccttgcagagtccttagaatatatttcttgtttgtatattattaatatctcctttagtgtttaatcaaatgatatagtggttaataggacaaaatttattcatggtattttggtggaagaagataagtggaaggctgaagctctgcaactcatagtgtaagcattttaaagactattttagtaaaagattaaataaagaatattattttagcaatcttctgaaactgattgacaacagttgacatttaattaattactatttttatgagccaaggttttgctctttgtaagatttcaaaatcctgaggtgggggggacttgtgttgaaatgcagtgaaagccttagagaccacagaagagagttgggcttttgggccttgaattaaatgggccatggactgtgtgtgcattttgggattctatttctgtttttctttttttttttttctgtgtggggggtttcttgtatccttgctcactgttggtctgtctgctattactcatgctgctgccagtggacttgactatatcagtgcatctttcttcttccaaagttcctgcttctgatctactgtgggtttggcaagcacacaaccaaacattttagaaacttgtctgagattggagtaaatggactgagataccatttttcatctacccagttggataaaaatgtaaaagaattattactattactattgtgggagtggggaacatcgacaaactcttgctctgcagtgtattaaaaggtattaacactttggatagctgtgatattgtgaaatatatatttggttttcatccccatttcctgacatacaatttctaaaatccttggaatctccaaaaggctgtctttttggtatactaatgttgactgctaactttaggatggggctggtcaccagaaagacatatgcaggattagaggagtggaacttgcagccccatcctccaacctcagggaaggggaaaaggactgaagatcaagttgatcaccagtggcaatggtttaaacaatcattcctccgtaatgaagcctccataaaaacccaagagaacagggttcggagagcttctggatggctcaacatgtggaggttcccagaaggttgtaccccagggaggacactgagactccacgccccttccctcatacctcaccctatgcatctcttcatccgtatcctttgtaatgtccttcataataaagcggtaaatgtaagtaagtgtttccctgagttctgtgtgctgctccagcaagttaacagaaccaaaagtgggagttgtgggaaccccaacttgagctggtcattcagaaattcttgagacctggacttgcaactggtgtgctgttgggacaatcatggggactgaaccccagcatgtgggatctcacactatctccaggtagatagtggtgggattgaattggaggccactgcagaattaattgctcacttggtggtggaaagcaacccacacacatttggtcaaagaagtcttattccgtgttgacgactgttactgtggtggtgtaagagaagagagaaaaggtggtttgagagtttttcccaaacaatagctatttgacaatctattttaaaagccctaaaacaatgcatccccgcaaatatgtgagacaaattccacatgcagaaatctgtcctcagaaactagatgtacaagtacagaaagatgtatgaataaggctttgattataataatgaaatgttggaaagatcctatacatctacctttagggcactagttcaataagctgtgttgcagccatataataatgtcatgaaaaaatgatactgcaggtgtataattaccaacaaagaagtaggtacacactaaactggaatataagtcagttcatatattataatcccctttaaaaaatagacatacatattggaatggaaaaatctgcaataatatagacaaatgttagttaagagtcagtgttcagtatattataatttcaggtttttttagtttaaaatttttgtttatttgtattttctaacttttccaaaacattaatgctttaatttaaagctggcttagacttccgtgtacacacaatgaattcatcacaagttatctcttctctcttcaaaatttcactagaatgacaataaaagcatgtaaaagtattgaatgataagatcaagccaaatgggagaaggcaaaagcagatgagagatttcagcaatgaagatggagagaaaagtggttagtttgaggatatgaaggctatagtgaacttgataaaatttagaaactggatatgggaggagacaaagggatcacaaagaaaataagaattggtgttggtgctgctattcactgcctctgagaaaataagaagagtaggtagaaaaacaataggtaaaaatggatccagttttgtacatttaacctaagacttgtgaggtgtccagtagggtgctggatacacagagctgccttcaggagacagatctaggaatcatctgcatgtgagtgaggctgaaactaggggaggacatgtggtcatgttgagagatttgcccagcgatcagaagccaggggatggaatgctggggaacatcagcatgtaagaagcagtggaggaagagtgatccacagaggaggcccacgataagtaactagacaattgaatgtggggccaaagaagctatgaaggagggaaatagagaagtgaggaccaaatgtagtaccaaagaagtagtcctgtaaaaagcagttattgttcagtgattgtgatgggtgtagggtgagaagccagattccaggtctagaggagtaaggaaaaaatgggaggttagacacagacagtgttttcaagaagcctggctgtcactagagaaatgagagatgtgagtggcaacttgggggcattaagctgacattagacttctggtttcgtctctttaatataagagagagttagtatgctgaagtaaaattatatgcaccatgatgtaaactgatactctacaaaactggttgtctaaataaattatacagctttcagatgatcgatcactttcaacaagatagcaaaacctggcatatctaattttttgctcttaatttttcttctattttataattatctaagacctaacataaaagcacagatttaaaatgccaagctaattttaaacattcgtgggaggatgaggccaaaaaacccaaacaaaccctaaaatacagaaacatcttcactgagactgggttcatgaagacatcttaaaactgagcagcataatttcatagccaaatcaaataagcattcactttcttgataaattagatgtaatttcaactatcataagaaagtagccagaaagtaatatttactgtaagctgctgtgtcctactcaattagcagcatcctagtgatctgaaggactgcagtcttcggacgggcttaccacttgatatagagcattcattcattcattcattcattttgtatttttagtagagacggggtttgaccatgtcggccaggctggtctcgaactattgaccttgtgatccacccgcctcagcctcccaaagtgctgggattacaggcgtgagccaccgctcccggcccgatatagggcatttaaacacattttttgttacctgggcacatcttatatcttttaaaatacgcaggctgggcacggtgactcacgcctgtaatcctcgcactctgaggtgggtggatcacctgaggtcgggagttcgagaccagcctggacaacatggtgaaaccccgtctctactaaaaaatacaaaaaattagccaggcatggtggcaggtgcctgtaatctcagctactcaggaggctgaggcaggagaattgtttgagaattgctaggtggaggttgcagtgagccgagatcgcgccactacactccaacctgggtgacagagcgagattccatctcaaaaaacaaacaaacaaacaacaacaagaagaaaaggcacatacatgctagtgtctttagtaactatatatttacataataggcatgctttgtccaccatagcatattttttaaaaactgaaatacttgcaaaagtactattaggtattcaacaatttgaattccctagttaggaagatggggccaaatagtatcatactttttttctttttggtaactattcatggcagaacttcaactactttcctcttaatgtggtgttctgtgcagttagtttttctttttgtgtctatcttagaaagatggattctcaaaaattaaaaacatgtgacaacagtgacttcagcacattttgccaggagcaaaatgcagagtgaacaaagagaaagattaaataatttagaaacacgttctggtgaatgagagagaattatcaaacagataaaagcaggtctgttcctattttcagtcatcttttcgatgcttaatatttttaaaaaatctatttctgctttatgatctcaacaaaacccactacaaagcatgcaatgggatagtgatctctgaattttgtgagttgacaattttcctcaagtgcctagaatattctggaataagaaggttacaaaaactttctttgtttcaataataaaaatgtaagtggctaaaactctttattggtaaaaaaaagaaaaaaaaatcccatgtttgagaagttgtgacaggaacgtgagctgggacacttaaaataccataaattaagataaactttgcatttactgcatgagcatatgtaaatgaaaatgtggtttaactctcttggcatactgtaaaggtgattgcatgctggataaaagggagaaccttggaagaagtaagtccaaagtgtgatgcatgtacaagtatgcatctagtttaatatctcacaggcttcatagatgaagtttgagaggaaactccccccaaatgatatcaaatgtggctgcaaaaaaatttgaaattaatttccattttttacttgaaaaaagataaaagatagccaatgaaaacagaaaataaaaactatgaaacataatttgatgagtttggtgcataatagctattgaatggtttcaataattattttttgaatggtgtactggtcttccggttgtgccaactccaggagggtacaaaaaagtccataaaatatcactcagcttctaccatacatttgaaaccaaaatcatgttttctttgaataaagcttaaacaaagttccaggtatttcaatagcttacttctcttccattctctcatcctaaacactatagcagagagtgagaatgagtgagaaagagagagagagagggagagagagagagcgagagagaactccgtttttatttgttgatatttggtcctcaaaactctggaatccattcttaatgacacagttgcttggttttaccttcttgccctgaactactcatcaaatgttattaacagttacagagacaactcaacgcaacagatgattttgtgtagataggctggaggacaagttgactcattgggccctgaaagttttccatcccaccttgggcagtttactgtacagcttgccaaactttaaagttattataactagtttcacacagatgccagacaaaacagacaagggattaattggaatgatcacaaatgcattccttctgaataaatgaaaacacactggctagtgccaagagacatttaaaatagaaaacctgaaactaatcaatcagatcaagtttagctctttttgatgttatagttgggagacatttcactttataaataatagaaaaatacctagggaggaaaaaagagagagaaaagtttgatagcattaagaaggaatttttgcactatcaaagagaagtgcctaaggagtcagtatcttctgtggctggcatttaaaaaaaaattataaatgttaaaagtaataaatgataagagttataagtcttcaagaaaaaagtgaagactcaaactattggctcgatttttaaattataacattgaacaaatcaaagttaaagtataaaagcccagaacaatactgggagatgagggctgtggtcagatgttagacagactatccaaacagctggaaaagatgttgattctccttgggaaatttgtaatgtatttgactcatgttttcatggagctgtggattgtcctagggggtttgaaagagagaaaacttgccaagaactttatctggaaaatgatagtattttaccagttttccaattagacaacaaaagcatttaaagaataataacaaaaatactcagaagtgaccaatgctatctctgtagcactaacgttcaggttatatgactagaaattattgagtacattatcctcattcatttacacacagctatttcttaaaaaggcatccacacacaaacaccacatgaagtgattaaaaaaaaaagaagagcctttcattacttgagttggatgatatgttaaatttcatatttggtgcacacacatcctaaacaacatgctcaataacaagtctccttatgcatgccttggcatacctacagctagtatctgatgctgagaggccagaaagggaagatttggtaactgaattcttgctgatgtgatgcaattttttagctctaaacagcccttgcatatgctttgctgaatttcttaaaggtttttaattgtttgcttctcaacaattgcaatgttcattttcccaaataagcctaaaagatggattaggaatcatctattatgcatactgaaatatttatggatgaaatagcatggtatttgggattggcttaaaaataatccagtgtggaataggaagtatgtgtgaatatagatttaaaaagattatccgtaagtttttgactgttgaactggtaatggatatatggggttcattatactattctctcaacttttgtaaaggcttagaatttcctaataaatttggaaagagttaaaagaaaaaagtggaaattaaacaaaaaaaacccctcttggatcataaatgtaaataattaggcaaagcaaacgttcttcatacttttaaatttcccagatgattaatcacctgcccgcattgatagtcatttttcctccctaaaaaaatacaattcccttattttggatcatattttcaataccacaattattttcattattttagtttgttccccagtagcacagtatattatagtagaagatatgctggactttgactcagaaaacttggtttttaaaattcaagtagtgctatttgttaaccttattaccttgaacaagtcatttaatctttccgggtcttagtacagatatctcctatgcttgctttacaaagcaaatattaggttgcaccaggtaacatttgtttctttttttgtacgtcaaaaacagttgaattgtgtcagtttcacatgtgtccaaactaatataaaacattataattatgactttcttctagagactttagagccagaaatcactgtcttattattatacaggtttaccgagatcaccggtcaaggcattttctgtggaacataaaatatgaacctgtttaaacagttaaatcacaaatgagaattagtctcaccctccaatatcggtattgtactgagatttcaacgtcaaggagtatataggaataaaatctatctgatggtctgtctcttgccttctgttacgtactggaagtgatttcaagtttaatactagcagagtttccttattttcatgtttgcaatgacctaaagatacttgaagataaatttctaaaaatattaattactttttactctatcatatccagcttgtttgtgcaactgtgatgttacttggagcaactgctatagaaaaagcatgagtgcactaaataaatattatttactagtgatgacaatggcagtgatggctaaggaactgcaatttataaagcacagccgagtatgagaaatcgaagcataaaggtccaagaaataaacagagaatggaaatttacagcagatataaacttgatttaaagttttttaacgtcaaaaaaataccagccttggcaaaatagtgaagccctgtctctacaaataaatataaaaaattaggccgggcatggtggctcacgcctgtaatcccagcactttgggaagccgaggcaggtggatcacctgaggtcagaagttcgagaccagcctggtgaacatggtaaaaccccatctctactaaatatacaaaaattagccaggcatggtggcgggcgcctgtaattccacctactcggaaggctgaggcaggagaatcacttgaacccgggaggcagaggttgcagtgagccaagatcgagccattgcgctccagcctgggcaacaagagtgaaacttcatctcaaaaaaaaaaaaaaaaaaaagtagtcaggtgttgtgccatgtacctatagtctttgctacttgggaggctgaggtgggaggatcacttgagcctcagcaggctgtggtaagccatgattgcgccactgtactccagcctgcatggtagagaaagaccctgtcttaaaaaaacaaaacaaaacaaacaaacaaacaaaaatacacagacttaactgaggttaaatgatgttttagtttctgtgagcgggcaattttaaaaggtataagctgaaatgatacagtcatttatcatatgcataaataatgctattttcaacgatttttcccttttgtatatgtgggcatataataaagtctttaaaattttatgttgactttgagtaaggccctgtcattaaaaaaaaacagaaaaaaagaagacaagagactaataacagagttttgggtttgtggtctgtctgggaaactgattccacataaataacattgcatacaagctagactctgttttcccacagaaacaaatcccatgttaacttttcaactgatttttaaattgggtacagcctaccctttagcaagctactgtcatgtacccacctcttggcaagttgccttagacctggatcacacttaccaggttgatctggctggagaagaaagtgagcacaggcagtgcctgggcagctaagtggttgtaagtgcctgggagtgtcaattaagtctcctttacttgtgacttaatctgaaaaatgtcatttttatgaggttactaggtgatttgttttcctcctcaataatctgcccttaaatgtaatctataaaacacgccctgcccctttaaggaatttctgccatatattggtagacattaattattttaaaagcaaacagaagtttctctgcgctcactgttttctgcttggaaaccatgtatctgtgagcagagatcaaaagcatagatattggaaataatggcagaattctaaaggtcactatattaggtactttcagcctatcttcttgtctaacatcatttgtgtatttcaatcacttgacaaatatttaataaacatgacattgttctaatagttaacaaaataaagaacaaaaactatgtccttatagatcttaaatgtccaatttattaatggattaatgacaacctctgctttgctgcacacagaatttgaggcaactctaattctagaattaattaaaatctggttgaatcttgagagagcccttgataatcataggtgatgtatccaagacctaggagagaaaactgatcttctggcttctttactgaacttctccattctactttctgtctgtgaggtggtaatcagttataagaaggtgagcggcaacagtataaaaagtcttctggttatgtgtacctcagggagatgtaaacaaaggtgctgtgaaggaggcatgaggggaaccctggtatatgagcaggactgacagcagtggttgtgtgggcctgattaccaggaaaccaacatcctctactccagcctgaaaatctaaccttttttttccttactcctacaacctcagtctttcctccttcccattctaagtatttccatctttttctctaaactttctcccatatcaatttgtaagagaaaaacaagaaataggtgggcagaaatgatgtctgagggatcccccagcagcttccaattagctatgtcactaagaacacctccagtcacagcaagctgggacttgatttggtgactgtccattgctggaaatatctcagtttcattaatctaagcactgtattcaaagagagcttgcctacaaagcacttgcaaagggtcctccctgttacactactcctctaagaagttctcaaggatcttggcctttacgggcaccctaaatccttggttagtgtttcacatggacatgatgtagggcagtaagcagcagcatgcaaaggactgtgaaatgttcagatctaattctgttccctctcttggcaatacttgctggctttatttgacattggaaagatactaggagcatctaggcccatggggcgtggcaatgccaagggtcctattgagaaagaatctgaaactgaagaaattaaaagaaaaaagtgtcatatgattcttctggggaaggaccaaagccagttgagacacaaccatccacaaggcttgcaggtgggtgagtgagtagaacatgttgacctgacctgactaaggctgctgataggtctaggaacatcagtacagctgcttggccagggtccctggctctgcctacgtcatctgggtgtgtagctataataacaaaaatggcaaaaaggatattaagtggccatacctttctatcaaggaaagctacccgctgtcacagactcatgatacctttaggattgaagattcgcacatcctggatttagcctgtgtgccatcaatgttctgtttattggaaggaaagaaattgatttcctgtttccttagttcattcatctattaataaacattttttaggcaccctccaggtcccagatactatgctatgcaggcagcaaaaacacaaataagacataatccctgcactgagggtctactggggtagtgtagcaggggtgataggcaaccacacgagtaccaaaatagctgagtaagtggcatgtcaaaaatgcactagggctgagtctagagtagaaaggaagtacatgcaggtaggaggaataatatttgcacatgctccaagaacagggtagtgacaccacccatttaggaaactacaacatttcactgggatgtcacatgagccagagtggctggaaataagtgatgaggggcttctatgcatagagcgtcttctatgctgtgccaaagaacttgaacttttatactaatggatatggggagccacttaactttaagcaggggactgagatgagtagatttccagcacagaaaaaaataacttgggcaaatgtggaggggcaaggctggcaagcagccccaaaccgtagtctagaagattgccccaagtgactactcgatggaggcatcattcactgatatgggacaaacaggaagagaaatgcatttgagagaagatgagctcaatttttggcatgtcgagcttgaggtcgtggtgctggtggttcagaaatgtccgtttctagaaggaaagttctatacatagatcaagggaggcaggtgtagggagctggcagtatgtgagtatcgcttagtcctgaagaagacgggcagccccttcaaaggatggtatttttgaacagtaacgaacttcatggatttttctgttggagcatttatacccagtagtgatttgtctctggactacagttgtatttcatttgttcttgtttttataacaaacataaattaattaccaagagactaacaaaatagttttgttaacttttatctccaaattataatgtgaaaactaggaaattcaaggcataggttagaaaaatatcccactaggcaaggtgcggtggctcacgcctgtaatcccagcactttgggaggccgaggcgggcggatcacaaggtcaggagatcaagaccatcctgataacatggtgaaaccccatctctactaaaaatacaaaaaattagccgggcgtggtggcgggcgcctgtagtcccagctactcggaggctgaggcaggagaatggcgtgaacccgggaggcggagcttgcgtgagccgagatcgcgccactgcactccagcctgagcaacagagtgagactccgcctcaaaaaaaaaaaaaaaaaaaaaattcccactaatagtgttttgttttgttttaatgtagcacagtagtcttttacatagtaatttttcccacttgaggaactaaaaggctgtcagtaataacttcacttcttagatgattcctgtttaatctgtaagtgttcccatcaaatctgtgtcatgaatacctggtctgagtttttatggaatatagatcaatattacttcagaatttaagtccatgcaattttgccagaacaaactaaggcaagtgattgaccctgctgatagaagatatcatattttgaaagataccagcacaaaatgtaagtatttcaaaccaagctctttgatgatgaaattagagcagaaaagtcttatcaagtctctggaaacaaggtctgagaacaatgaattcaagtcaggagaatctggtgctctctatgcagtgcttccactggtaccctgtatgaccttgggcaagtcccccggtcctctgcccccccgccccaacaacttttcctcctttctatcactgtggagttttataaagtattttatgttctttagatgaaagatacaaagtgcaccacttaaatggaaggtctgaggcttttcgcctataataggaggaaagactcattagcacaaaaccatctaagagacaaaaactttatttagtggttttagtctccagctaacacctaaatccaaaaaggtctaggtcatgtgttcccaaacatttcaatgtaaagaaagggggaaaaaaaggaacctagggaagaatcgaatcctacaagtggtatattgcttagtatctgtagcctgagaaaatatacaatgctttaagtcactgccagttcaggaatgtttatgggtaaatttgtatttttaataatcacatggtattcacatatattttcatctatatttgaaatagtggtatctgtatgtatgggacataactcctcagtcacaggcaaccacttggtttgcaatgagaataagagactcctgacatcaaatcttaatgcccaccctaatgttctaaagactgaatgttgaaatctctccttagcttccccgaaacttgttttactatctactcccggagtcatccatttgtcacagcaactaaaagaaatatcacagggcaagcatgatggctcaacacctatagtcctagaactttgggaggccaagatgggagaatcacttgaggccaggagttcgagaccagcctgagcaacacagggagaccctgtctctacaaaaaaaaaaaaaagaaaagaaaagaaagaaataaaagaagcatcacagcaggcaagaggtatgctaaagtccagtattctgagaaacgttcatataagaatatatatatacacacacatatatattttatagaaagtaacaaagtacctcaagatccaacttttgtaaaaggccacttaaatagtggaaggagaagcacaaccaattgaggttaagtttctatacttttcacaaagggaatgagaaaagtgtatttatacaatatattgaaaatctcctttgtaaatacaatgttgtataaaatataaagcattatcatacagtaagtggttcaaatttgtaagggtagaatattaacttccagaaccacacagacatggctacattaagagactttgtgtctttatcaagggagtcagtattctcattttactctgtgggtcaggttactcctgagcgctacctgttctgagtctatgctttcagaacagcacatctagaagtgagtgaacctgctctgtcaacaggggaagcaaacacagattattatacgttacaatacctaccatctattgatcacttcttaggtacctggtctttatatatatatttcattaaaattcatgggctgtggcatggtggctcacgcctataatcccagcactttgagaggccaaggtgagtggattgcttgagctcaggagtttgagactagcctgggcaacatagtgagacctcatctctacaaaaaaaataaacaaaaaaattagctgggtatggtggtatgtgcctgtagtcccagctacttggagaggctgaactgggaggatcactagagcccaggaggtctaggcttcagtgtgccacgatcataccattgcactccagcctgggcaacagaataagaccttgtctcaaaacaaaaccaaaacctaaacaacaacaacaacaaaaatctcatactatagcaacctcttttaatccctatttttagcagaggtgccagaagcagtcatagggctggagacaattctggctggcctgattctaaagccccactccttcactataccaacatgtcctcccattaagtgactgacacataaaactgggggaattttccccagcaagagatgccaaaataatttgtttagcatctgcttggcaactctgcctcagtcacagttgaaagtctttaaagtcttttgtgtgtgtgtgtgtgtgtgtgtgtgtgtgtgtgtgtgtgtgtgtgtgtatgtttcgtagagatggggtttcaccatgttggccaaactggtctcaaactcttggcctcaagtaatccacctgacttggcctcccaaagtgctgggattacaggcgtgagccactgaacctggcctaaagtcttgactctagtttctttcttcaactactattttgaacatacagtttatttattcctttgagtgctattgatttcattggctaataaacctatgattcctaaattatactttttgctttccttatgtatcttctccaacacctattttgcaaaaataccaaagcaactcaaagacatacttcattatctctatcttccattttcccatttcttagtactagtttgaaaagcaatctgcagtcattcttttaagtagcatcaaagcagtgccagcattgtgctaaacacttaatttgcattaccttttttgattctttatgattaaggtattaaattggtgttaggtctccatttcatagatgaggaaagagttcacacacagccaacaagtggcaaacataaaatttacacagaggtctgatggatgcttaagccctgactttaggccccaattttaagcgctaaactatacctacccagaatacaaacacagttttttcttgtcagaagacactaatcgttaaattacaggaggtggatggagacatgtgagaaattatcagaatttagttctctatacctgcttaactccatttgttcactttaatttacttttaatcccacagagctaagaactgaggactgtgagttattcaaaaaaccctcagatttaagaggaaagcagtaacaaggggctaagattacagcattgaatcttatttcctcagatgaagatagttcatctcaaatgtttaaggaaaagaaaactccaaatcagagcacctcactaatacacccaaaggcttctctcaaactgccctgtagcgaggcatggtggttcattcttgcagtcccagctacttgggaggctgaggccgtagggtcacctgagcccaggagttcaaggctgcagtgagctataatcctgctactgcactccagcctgggtgacagagtgagacccagtttcaaaaaaacaaagcaacacaataaaaaaactgccctgccccctttgccagagggaattactgaaggaacccgactgcacaggggagtggtctagattcaaacaaacttcagttacttcagaacgaaccccggtttagtcacagtggcagaggagaatcttatatttcaagaaactgaagatataataactagatccagaaaaaaaaatcctacagaatttcctaatcattattatttatttttaaacagggtagtgaaaaatgataaaataaatattagtaaacatcaattaaagaatatgtgagaatggtattaattattgccttaggacagtcatcctttggttttattaaattttatcccagtgcaatgctggatatagggtaagccagaaggcaccctgagggtcagtcatcgaataagagtgagaaagagtggaaactctagtgcctgagtctttctgggagcacacaggattcagagaacacagtctgcaagcaactgatactctgtgagcagtggtgcatatatttcagtacaattctcataaaaataatcacttataaggattcctaatttaaaaactcgaaaaacattaatttgtggtatctgcaagaactcttgaaagaaatcatgcggggcgcagtagctcactcctataatcccaggactttgggaggctgaggcaggcggatcacctgaagttgggagtttgagaccagcctgaccaacatggagaaaccccatctctattaaaaatacaaaaaaaatcagccaggcatggtggtgcatgcccataatcccagttactcaggaggctgaggtaggagaattgctttgaatccagcaggcagaggttttggtgagctgatatcaggccattgcactccagactgggcaacaagagtgaaactctgtctcaaaaaaaaagaaaagaaaaaagaaataatggaagattttcaaagctaggcaaagagcttacacttttcgtataggcaagaggaagctacctgaggcttatgagtagggcaggtttcaagagcggaatcttggaaccaagagagaacactaaggaggaggtaaggagaacctggatgactctgaaagcctcagaaatggaatgaaagctagttcaagactgaacactcccaggtttttcccactgcttgataaccccgggcttttaaacattcttttttttttttcttttctttttttatactttaagttctgggatacatacatgtgcagaaggtgcaggtttgttacataggtatacatgtgtcatggtggtttgctgcacccatcaacctgtcatctacattaggtatttctcctaatgctacacctcccctacccccccaccccctgacaggcaccagtatgtgatgttccccttcctgtgtccgtgtgttctcactgttcaactcccacctatgagtgagaacatgaggtgtttggttttttgttcctgtgttagtttgctgagaatgatggtttccagcttcatccatgtccctgcaaaggacatggattcatccttttttatggctgcatagtattccatggtgtctatgtgccatgttttctttatccagtctatcattgatgggcatttgggttggttccaagtctttgctattgtgaacaatgccacggtaaatatacatgtgcatgtgtctttattgtagaatgatttataatcctttgggtatatatccagtaatgggattgctgggtcaaatggtatttctggttctagatccttgaggaatcgccacactgtcttccacaatggttgaactaatttacactcccaccaacagtgtaaaggcattcctatttctccacatcctctccggcacctgttgtttcctgactttttaatgatcaccattctaactggtgtgagatggtatctcgttgtggttttgatttgcatttctttaatgaccagtgatgatgactttttcatatgtttgttggctgcataaatgtcttcttttgagaagtgtctgatcatatcctttgtccagtttttgatgcagttgtttatttttttcttgtaaactgcacccagcggttttttcttatgtaaactgccagtcatggaatcagttgattcctagtcttttttagtatggcgtatagtattatgtagataataaacagcggtcagtttttgttaagatagagactgtataatcatttggtaattcagtgttgtttatccaatttctagatttttactgaaaaacttgtaaacctgctttgagttatcagggtgctttgctgtacataagtatattttaaaaataaattttctttaaaaaaatcatcaattgacttaatcctcttgcatcttaaaggaaaacagcattcaatgttggatctgctctccaaatttatgttacccatttataagaaacttctgaaattttcagtttggggactctggtctccaaagcatgtgggggaaggctgcttaaatcacactatctcagcaatgtcactttcagccttccattctctaaaaacaatgccagagaaggtgcactctggttcactcctgtttccctataactgttgcattttgacaatttgcattttattttggaccatagctactgtaattgtaaattggtctactttctttaatctgggagtagcagcaaatcatttttaatagcccttaattcccccttttaatgagatatctgcattcgactgactcaaccatgtactgccgtaggctagggtggatgaatcacagaaaatagacggaagaaacccattaggtaatctcacgcagtcctctgccagactccggatgattcccaacaataaaacttctaggaccagttcagcatacttttaatgctcctccaaggatggaactgctaaccctcccaccacaggccatccagtcatttggacagcccgcactcccgcagtcgtctccccaagcttccatttatgctctctttatcctcactgcatcccatttcactacagagctcaaggtccacccgggctatgtgcacaaacttttcttctggtctgtttgcaagcactcacatacttagagagtgaccgccctggatattaagggaaaattgaactatatataaaataacttcttatacttcttaacccttgccataaaaattagaaaaggactcatatcatggactcattctcaaagcctgctgtcttttatatgctctccagttctttgtttggtctaattcttttcttgctgcattcctctgaactctctccagctgttccacatctggagttgagctgctcatagctgaacacactattcttggtgtggtcttatttgatgcagataaaccctggctctcagtttcccttcatctctcttatcctgcttgcttttccctttcttttgctttttcctttgctttcaatctataagctctgtttttgacattatgttctggagagttactcaattcagttccacgggcttgagaataatggtaatgaaaaaaacctcttttgaggccccaacgcctatttagttgatagagtgatgccttttaggatttccatttcccactgctctacaattaacatcatcatcaacaataaccacctccatcttttttcaaggtcaatgtattacctggtaataactattatttaccataataatttcatttccagccaaatacattattttacttaccatctatttattttccccttgtgttaatttatatttttttctttgctaaggttagattattctgccttcaatttactgagaaaacccttatttatacattcagcccaacttccccacttatttcttcattttcaaagtgattcctgcaatctttgtaggattcagaactgaaaaggactgaacctgtagctaggccacttcctttgaccttcaattatggctgtttatcctgccaatttaccctcacatatgtaaaatccagcttcatttatagcaggacctaattaagggggtcactttttaaatattgaactttctacttatctatgtaaaaagctcactatctaaattattgtcaagaatggaacaactacatagccagattctagcccatgtgtttacatagagggtgagtacatgcaaatgttgtactcacaataccaagggtgctcccaattctacataatcaaccttttccaccactcccctcctccaagaacagcaggtctttcttcccacatcctcactccctctgctcacactctcacactcctccccctatctcctattaggttgggctcagatttttttaaaaaactgtggtaaaatacacaacataaaatttaccatcttaaccatttttaagtgtacagttcagcgctattaaatacattcataatgttgtgcaaccatcaccaccatccatcgccattactcttttcatcttttaaaactgaaactcttatgcataaaacagtaattcctcatttatttctctccccaaaccctggcaaccaccattatcctttctgtctctgtgattttgactactctgcattcttgatttaagagaatcacaaggtatttctcttttaatgactgccttatttcatttagcgtaatgtcctcagaattcatccatgttgtggcatatgtcagaattcccttcctttttaaggcttaataacattccattgcatgtgtatatatagtacatttgcttatctattcatccgctgatggatacttgggttgcctctacgttttagctacagtgaataatgctgctacaaacatgggtatacaacagatcattcttttttatggtattttcaaatacacacaaaagtagagcaaccgacaaaattaacccccgtatactcaactttaacatccccaaatccaaaggtccccagatttgactttctcgttttcagacactcaaaagacagccttcactgcctgatgtctctctgtaggaatttttcggtggggcttggggatgacacccagtgtcactagtctttgaatctgatcaccactaattccctgtaaccacagagctaagagaacacatgtccacatccaattagtcagtgttttatttttcctctcctctcatttacaattctgccagaagttctaaataaaagaatagagtacctatctaccttctttcggccctgactctcaaacatatagtttaccctgaatgttatgtttctgcctatgttctgtcattctttcaagtgatcatgacttcaactttcaaatggtttcaggcaagattttagaacaaacaatatactgctagagagaaaataaaaaccagcaaaaataaaccaaaaaggcaattgataattattttgggagaaataatttatttttcaattttgaccatcttttgttattttgcttttcatcagcacttctaacagagctaagagttcagatcagatgcctctaattttaatgtgagctaaaatctgtgttaaaatgtagactgccagcctccactccagacatcggattacactggtctagggtacagcctaggaatctgcattttatcaaacactccagagggttccaatgcaggtggtctctgactatgctttggcaaacactgaagaatcagatgaggaacacggaattgctataataattctgaagagaaagtaattttttaacttggggtaatgggacagcttcacagagacagagtttcaactttgtagttttcgttcattcagtcactgaaaagaaattattaggcatctgctatgtatcacattctgtactggagctacaatagtgaagaagcctgacagagtcctttgctaatgaggctgagagtctacaagagcaggatttcgggagcaaacagaggaaccgtcataaacaaagaggggatgggattaaggaatatccagtacaatgttgggcaatgtggagaacacaaaagaaatatatatacatttaaatctaagactagaaggggtagggtggtacaaaagaagttagtacagctggaatggccaagtcttcaatgacagagactgaggatggaaactgggcagtggagatggctgaagggaagtcagcagttatcccaagggcagtagaaagccctccatggtgtctaggcaggaacatgatataatttcaagatatggctcaagaggcccaagttatgttttgaaaaggtcatctttttcctagaaggtacattaacaatgaagtatactagagattttgtgtaaatgtagaaatgaatattgaactgcttccagaactatgtagccaggctgacaaacttttaattaagtccatctggccgggggtggggtggggaggggtgtcttgtattcattttctcttcatctagatctagcctcgtccttccacataatttgcagaaaaggctcacacatgcatgcgcacaggcccaatccttttaagcttttaattgggcttccatccacaaacccctttcactttttttttttttttgagaaccaactcacacattctgaattattttgagtatcttatcatctttaaagagagtgagaaagagagattacagattttgtggttaatgattctttaaagaagaagggaagctcaagtcaagtttctttccatttagaatagagctttgggtcctttcagaaattaacttctctgaggctggactcgatggttcacacctgtaatcccagcagtttgggaggccaaggtgggaggatcacttgagcctaggagctcaagaacagcctaggcaacacagggagaccccatctctacaaaaataaaaattaaaattaaaaaataatttggggccaggtgcggtggctcatgcctgtaatcccagcactttggaaggccgaggtgggcggatcacgaggtcaggagatggagaccatcctggctaatgcggtgaaaccccgtctctactaaaaatacaaaaacattagccgggcatggtggcgtgcgcctgtagtcccagctaatcccgaggctgaggcaggagaatggcatgaacccgggaggcggagcttgcagtgagcagagatcgggccactgcactccagcctgggcgacagagtgagactccaactccaacaacaacaacaaaataataataatgataataataataataataatttggatgtgttggtgcatacctgtggtcctaggtactcaggtggctgagatgggtggatcactgaggcccaggaggtctagctaggctgcagtgaaccatgattgtgccactgcactccagcctgggcaaccaagtgagagcctgtctcaaaaagaaaaaaagaaaaaaagaaaaaaaaaaaaagcttttctgagataagatcttttcaactttatagttgaaaaaaactacatggacaatagcccccacttaagttattggaagaatcaggtgagttgagttacaagttgctttattatagttcttgacgcataacagctgctcattaaatgttagcttctaaagggttaagaatacacatcattaggaacaggataaaaaagaatgagttgacatttaatatttatagggtattgaatcaagtattgaatcaagatctttaatttattactgaatacattttgcgtgcctaaaatgaccaggatactctccaaaagacaattttacagcatactgtttatctgaattttaatggtagactgtagcaagaacatgaagtaggtcagttgaagaagataagcctgtaaggatataaaggatgagagaaaacctcaatacaagtccagaggtgctgccgatagatgagttccctagaattctaagtactaccaagcataatggttagtgtatcaactttggggaggagtggtgaatttctgaaaagctgcaatcagctgagataaatatgcaacatctattgagcatatttcaaggttattcagaggcatcaagaactgaacaccaggtgaccttgggcaagttatgtgtctctgagttttggtttccttatctgcaaggctgatgggctagataacctctaaatggttcttgcagatataacaggatttggggaggagaatggataattgaaagagtccagactatgcagtcagtcagacttgggctggaattctgcttctaccacccaccaggcaaagtacttaacatccttgggtcccattttctcctctgtaaaatggagaaaataaaatatacattgtatagctattgaaggataaaaaataacatttctaaattatctggcatttattaataatagacaactaaattaagggaacactcaatgttattctatgatcgtgtgttaaatgcacctatggccaaatttaaagtctagttatcactttaaagtctagttatccggtaactgactaaacggtgattcttcaaatttcaaaaacattcctcgctttacaaaaaagattcatctcaggctcctcttaaaatgtgagtcaataatcaccctgagcatgagatagacttctaggatatttagatatatctacccactgttgaatatgaagtgtgatatcttcattctcaacaaacccttaccagggaggggtgtgtgtgtgtgtgtgtgtgtgtatgggtgtgtgtatccccttgtttgtaaagctcaatgctaagtgaggtttataaagttctgcgaggtttgattctctgctcttgagaaactgacgataacttttctctgtaggaagacaggtacacaatgccaaagaaccaaaagccttattttgaaaagaaaaatgagagcgactccttccacagaatagtgtgaattaattagtgtttataaagaattttgatatgcttatgcaaaaggcactttgaatgtaaacagttttaagggcactttgttgtgtaagactagattaagaacagggcagtaattagcacgttgggaggcatgaaaaagttttaaagaaagcacaaggctgggcactgtggctcacacctgtaattccagcgctttgggaggctgaggcgagaggatcacttgagtctgggagttcaaaaccagcctgggaaatgcagtgaaacccattgaaaaatttaaaaatttgctgggcatggtggcacacgcctgtggtcccagctacttgagaggctgaggcagcaggatcgctcaagcccaggtcgtctatagtgagctaggatcactatagtgagccaggctgcactccagcctgggcagcagggccaggccctgtctctaaaaaaaaaatagttaaaaaaaaacacatcatattgctacaaagacaatatgtaaaacccactgcaattgttacataaaagaatgctcctagagtagattttgtgcagatgataagccaggtaaaatctggaaatacaatttcttctttttagttcagggaaagccaggttcctcagtataagtaaatcttaaataagtttttaaaaataccaaatcaatttaaagtgctaacagccttaccaggatgtaaattcttaaacaattagcttcattcccaacaggatcaaacacaagcacacagccaagacagtttagctcctaagcttggtgcgttcaaagagaatcttgacttgagctgagtgtgatctccagatgcaatacaacccttctacacacagatccatgggaaagcattttctggaaacagatgcaccttgtttaaaaccaaagttgtgtttctgaagaaagctgggtacaaatagaatttttaaaaattgaatcatattttaaatgccctggggatgctcatatcacagggaaccctcttatgaatgattctgcaagagaagaattattttatgaattgaaaaagcacctctaatttatttgctgcactgattttttgaattttgttttcaaaattcaaaaaaattttgaaattatgtgctaattatgtgcttgccttttgtggcttattccgaatatcttaacaaagaaacactatttttttttctctttgaatgtttgattttgaaatatttgcttttaatatagtcttttcatatagtctaattcctctcactccctacccccaccccatgggtataattccatttttgaagtggaagccaatgagataactgaattgaatgtactggaacttattttatggtcaaattttaggaacgcatctgttatacttggtagggaatatagattctattagatctaaacagaatgaaagggagccggggcatggtgtctctatttgctgttgaacagctgatataaaaggaattgaagcaggccatgtacggtggctcacgcctgtaatcccagcactttgggaggccgaggcaggcagatcacctgaggtaaggagttcgagaccagcctgaccaatatgatgaaactccatctctactaaaaatacaaaaattagccaggtgtggttgcatgcgcctgtaatcccagctactcaggaggctaagataggagaatcgcttgaacctgggaggcggaggttgcagtgagctgagattgcgccattgcactctagcctgggcaataagctcgaaactccatctcaaaaaaaaaaaaaaaaaaagggggggcggggggcaattgaagcaatgagtgtaaacaccttggctctgtagctgaccctatcaggtggggaagaacagagcaagatcagaagtatgcttctattcacaaaatcttctatagacatgtttgattcaactccaagacaccaagttaactttcagcagaggttcccaaattttcttgattcatgaatctcccacgtagtgggagagtgattaatctcccactatggtggtgtctttaggccaaaagaaatacctaacagttaacttattaagtacctacgttcaaacaactactaaggagctgtcctaataacttggtagcagtttgaaaaaaataatacttataaattgaaagaaaaaaggtatatttttatttcattcttaaccacaactactcactaaagtatgcgtacacctttcgggtatgcacaacttctcaaatcttggaatcatattggatagagttgccttcatttcccataccaaattgttgccatgcagtacttgctttgtatcaagttaacctccaaaaacccaaccttagaaagatatgacatcgtcaaaaggaatgtagcgccatctaatgttgaagctgtgaactacctcaatctagtaatgcactgggtacttgacagataccaaacattgctgtgttttcctctaaaatttaaaacatcccctatgagttgactgtggtacccttgggtgccctggtatacagtttgggaactacaagtttaaataaagacaagtagactttccattttcctgaatgactgaacaatgtcataacacttcaatacctgctcagtatacatataacacacacagaggaaatctatacttgcttctacacacatcttatacctagttaaaagcactgtcattccaggttaggttacaattttaaaggcaatacttttatggcagtacctacccaaatgcatttttaaactgtattccattaaatttcacctttgctttcacaattttgtatctggcatgtgattccatttaggttatactaggaaaaaacatttttattttctcaaataactaacgttttgtgttgtaataaaacctaatgtctagtaccaacaatgtcatggactctaccatgttagatgcccatccatctcaaatgtgtaagatatcacatatttaggcacaatggctgtacagtattggtacattgcatgaaaaggtcacaggccagccacagtggctcacgcctgtaatctcagcactttgggaggccgaggtgggtcgggagtttgagaccagccagaccaacatggagaaaccctgtctctactaaaaatataaaattagctgggcgtagtggcgcatgcctgtaatcccagctactcaggaggctgaggcagaagaatcgcttgaacccgggaggtggaagttgctgtgagccaagatggcgccattgcactctggcccgggcaacaagagtaaaactccttctcaaaaaaaaaaagaagttaaaaaatgtggccatttctttgtggaaaaaaagatattaaaagcactaatttaggatgatgttaagtagaaatgtgtcatttcacctgatacacattttcgtctaggaaacacagtgcagattgttaatgatagaataatcccactcctagtcgttagccttggaaccaaactgttaactctcttctttcctttgagcatagcctatttatttctatttgctgttgaggataaaccactgattgagtcatagaatgcagttttgggctgggcatggtagctcgtgcctgtaatcctagcctttgtgaggctgaggcaggaagatcccttgggcccagggttcaagaccagcctgggcaacataggagaccctgtctctaaaaaataaagaaggaatgatgaagataatgatgatgatgacagttttgcaatcatctcacaatttccttttctatctttgaaatcaaactctgtccttacattgcctatttcaactttctgcaccttttaccttgcctatttcagctttctgcatgtttacctcatattgcttttgccctggggttctcctccctccttagagttttatctgtctgtgcactttctttcctctctctgctactttgcaaaagcctcccacacaattctaggtaatagcaatttaacaacatgccctcaggtggaataatcagccatcatgattagttagagtcaggtcctggctgaatctgggattagggatgggtgtctcctcaggaccaaggcagtctagtctcagaagaatagaattaaagggaaaattccagtttcattaagtgtggcattttttaatcagcaagtcacagaaccttattaccaacatgtattaaaatgaactccattttaatggcagtgtgtccattgtcaagatatttgtggttcactatggcaagtaagttcatgcgtcctaacccaatccagtgggggtaaatgaatgagctgaaagagactggaataaccacgttgataaggatatcacaatgtaattactgaaaagatgccactttgggacccttgctcttttctttaacagattggtattttgttacttttaaacattccgtcatatagtattccacctgaagaatattttagctcatataatgacatttaagaaaaatatagcaaaaaacctagaagccttctccagtgccaaactcatttagaaagtttagcttctgactaatgcaatgatgcaatgtaatactaccaaattctttcatcatatttaggagtaagtgattacttgtggaaactgtaatgtttcctaacaaaccgagtgtttcagggacagaccacccaaatgtattattatataaagatgtcagttacataattacatgagaaaacaacacattttacttttttgttttttaacaacaattatcctctctggggaagagaggctgaattagctgcttagcaaagtggctcctaggggctccaattaacttagacacatttaaactggatccttgataatgtacatttaacatgaggaaaatgaaattgtattttcttcctcccaatccctaactcctgccatgtctgaactgactttgctgagaccaccaacagtgaagatgcatttaaaaactgcaactcacatctaaatgtaggccatataccagctgccttgttttaaaattttttttaaattattttgaaagtcctatgccattaatattaatattagagccatttaaatgaaaacacacaaacctcaaatcaacacttatttttctttctttttatatggacaggggtctcactatgttgctgaggctggtctcaaactcctgtcttcaagcaatcctcccacctcagtctcccaaagtactggaattacaggcataagccaccgtacctggtctaaacatctacttttcttaatgggtgccaagacattctttaaaagtaactgggaggctgggcgcggtggctcatgcctgtaatcccagcactttgggaggccgaggcaggcagatcacgaggtcaggaattcaagaccagcctggccaagatggtgaaaccccatctctactaaaaatacaaaaattagctgggcatggtggtgggtgactgtaatcccagctactcaggaggctgaggcagagaattgcttgaacccgggaagtggaggttgctccgagccgagattgtgccactgcacacctgggagacagagcgagactccgtcacaaaaaaaaaaaaaaaaaaaaaaaagcaattggggatttttttaaatgatgtgagtgtgcagttgcatttaattcaaataatattttataaacatttgtctacattaggggtgtgcaataaatgattttaaaaatgactatactgcttatgtataaaacagaaatatgttttaaatatttgatgcctcactactcataattctcagtattttggcagacacttattgagtgtccaatgtcagaaaacagttacactactaaggtccaaataagcaaaatagctatagattactcatcttcaagagtagtttatcatagtttatcagtaagaaaatttggcaaaggaagagtacattttcattaaaatgctcagtgtttcaatgaggatgctcctggcatttaagatatgataattctcccttttcgggggttggccttgtcctggcattcctggcccctgcccacaaaatgctagcagtgaccccagttatagtgataatcagaatattcccatacgttccccaaagtcccctaggcaaaaaagtactttctccagttggaaaccactgacccaaagagtctctagcttaaaacagaaacaaaaacagaataagggtgaaatgtgctaaagcttcattatgtggttttaaaaagcaggggtggttgagtgttccttaataactgtatataactttacttccttgtctttcagtttatttgtaaaaggtttgtctcctgggggttcatacattatcaataattctcattggcttcttcagaggaggatgttcaggcagatgttcaggagaatgttcagctagatgggtgagcaaaaaacccagttttcttaaacttttagttaaactcagctctgccgcctagctggggacaatggcaagggaaatcagattgcagactagtgtctcctgggactaatctgacatttatgaggggagcctctggttgacgaaatgcgagtaccagaacagagctgatgcatgtgtgatcatactcaacattagaacaccccttcaggctgggtgcagtggctcacacctgtaatcccaacactttgggagactgaggcgggtagatcatctgaggtctggagttcaagaccagctttgccagcatggcaaaactccgtctccactaaaaatacaaaaattagctgggcacggtggtgcacatctgtaatcccagctacttgggaggctgaagcacgagaattgcttgaacccgggaggcggaggttgcagtgcgctgagatcgcaccactgcactccagcctgggtgacagagtgagactgtctcataaaaaaaaaaaaaaaaaaaaaaagagaacaccccttcagcttgtgacaagcagctaacatctaggtctatatgacaaatgtttttcttttgctacctaaaaataggtttctgaggctggttaggtgaaagtcccctaggtaggaatggtattgtctctagttagagactactgatccaaagagaccctagataaaaagagaataatggtaggctaacaccttacacctgtaccttacgcctgaaggcagaagggagcaggagcactgggatggacacaggctcaacatatctaaaattataatcttcctatttttacagatgggaagaaagagttcagagatgtgggatgacttgcagacattctgtgcagtttaataaaccttccttctcctgtatcgtacagcaagatctctttccaacattactacctcaatagggtgaagaatacatttctcatctaccatttgacaaatttatgctgaaatgcaattcgtttgctgaaccttggaaaacaactcaacaaagttctgtcctttacattataaatccagttcacaaaaacctttcaaacttttttctccaaataatctgtcttcttctttatgtcctgagctcagaagagttccctaatctgagctcctcaactctgggctcgtcgttcttcatttcttgatatgtgcccactgctaagagttgtctttgtttatcactctagccacagcattcaaaatctccaagcagtagacagtctctctgctgccctatcaatctcttttcctgactatttcttaaaaaccaaattaagggtaccttttatttcctgatgaatagcaggccttcccacaccacttcttgtttcactctccctaaatcctcatcacctgataattttcaataatgatccaaatggcaacagactacatcatctcagcaccatagcatgagagaatgaaagggaccttggaggtcatttgattaactggataaaaagtgttctctaagaaacttttcagattcttcagtgggcatccaggagcaggatgaaggaggtgaatggggaagggggcagcaagcagaatttatggtcctcacctccaatttagccagaacaattccactttaatctgtttctctaattatgctaagtacaattttattttaaaaagaaaataaaaagagggacgctttggaaatctccacttaaaaaaaagaaatgtaaaaccactaatctatttcccaccatgctgagtcctttaaaaagagcctgatgtaaactttgcaaaaatttgtgattagcaaagggtctttaaaatgcctagtctcttagtaatcataatccctcaccttaaacactggcctgcaccaccaagaaaagagaaaatgtgatttactgatggatgtgctgggagaggaagaaagagactcatgtttgactgctgattttcccattagctagctgctaagccacttaacctcctcatgcctcagtttccttgcctgcagaatgagagctgggctctactcaggcattttctagctccaaaattctgggttctatgaaccagatttttgtgagggggactgagccctatttctctcgcttttcccatctcttgaataatgtatcgttcttttccaaaggagaagtgtccagggacatcaggaaaaaaaaaaaaaaaaaagcttttatccaatctaacaccaggactaatggaatgtttacagacagactggctggcctcagccctttagtttctccccttttatctttctaatcctcctttcaatgtgtcacccctcacatctctttccttccttcttagctccgctcaaatttagcatacctttaagtggctactgtatacaaggcactgcggttcagcacttgggttatataaagatgaataaggcacagccctgcacagaaagggacttctgtaaggaggacaactctggcagaaacataaagggaaggttagagatgcaaaagaataaaagtggaatatttacataagagatgagggcatgaaaagtctttgagaactaactgggaggtgggagagaagccgttcaatattaattcagtgaatcaatcagcttgttacttactgagctgtgttccaggcactgtactacatgcagcagttacaaaatgaaaaggcctggtccctgcttatggtctaaaaaggagagacagacatgggaattgggtttggtgccaatgagaaccagggcaacaccaaccaaaagagggatgtcccaaatagcagacatgagtgggaggagacagaataagtaaactcccactggaataaggaatttatttaacatgacgatgctgaagggatgtgggggctaatggggcattggtgcattcacattaagcacactcagagtaacatttggatctggagtcagaagacagagacatcaacactgagatgctgtcaagagtggggccaggaagtggaagaaatctcctaggtagaaagaacagagaataaagagaaggctgtaggaccaacattcggtaagtgtctatactcaaggaatagagaggaaaagaaaactgagtgaagaagacagtgaaaggaaatgtaggaaaacaagtaggcatgtgcaatgctaaaataagctcaggaagaagggaacttcaaacaaaaagaaatgttcaaaaataagtggaaggccgggcgtggtggctcatgcctgtaatcccagcactttgggaggccgaggcaggtggatcacctgaggtcggcagttcaagaccagcctggccaacatggtgaaatcccgttcctgctaaaaatacaaaaaattagccaggtatggtggtgcgggcctgtaatcccagccacttgggaggctgaggcacggagaatcacttgaacccgggaggtggagggtgcagtgagccaagatcgtgccactgcactccaacttgtgcaacaagagtgaaacttcatttcaaaaaaataaaaataaaaataaataaataaatacataaaggctgggtgcggtggctcacacctgtaatcccagcactttgggaggccaaggtgggcggatcacctgaagttgggagttcgagaccagcccgaccaacatggagaaaaccccatctctacatgggcgtggtggcacatgcctgtaatctcagctactcaggaggctgaggcaggagaatctcctgaaccgggaggtggaggttgcagtgagccaagatcacgccattgcactccagcctgggcaataaaagtgaaactctgtctcaaaaataaaataaaataaaaataaaaataaggaaaaaaataagggaaaaaaaggaagcagagaagggtggggtatagtagacagaaaaaatgtcataaaatttagcagctagttaataaaaggcttttgagacagcagtttcactcatatctatattgagtccatgagggtcttccttagaaaaaattagcaaaaaagaaaagctacactgcagactgatgtattatggattcaaagaacactcttttcttttcctctagtttttttaagtttggaggaggctccagcaaggcttttaggccaaggaaaagaaatgaatctgctacagattctctcccctgactattgtccaacaaaaaacaaaaacaccaactctatgttagaagttttcaatcttttgaaaacctttcttctggtcactagctgcatgtgagggtggtaatctacataaataaatggacatcacgtctgcctgcaataacgcctggatagactctcaccacaactagggtacatctggaataatcagtgaaattatactgagtgaggcaaacagctacccttcagaagggttgaaactgaggaaaaaggagagaatgatgtaacaactgatgtagaaagatgtgtcataaatattaagccaccttgggtaccaaaaccctggatggcaaatcctgcactaaagtttaacaaatgacccagcctgtctctgcggtacatatagtatcactatatttctccaagtctgatacttcctctgagtttttcataccctagtctctgtcttcccttataagaaataatccctgtccctaattcctaaccaaaaaaagggaaataaataaaacatatacctaacaaaacatatccattttgatctgtacaaacttgttcaaatttctctatataaacccttccttgaaaaaaggtttagtgctgacatattagatttcacaggaatcacccctgtacccagggctggcctcatgagtgtgtgagccactgtgcagtcgcctaagaccccactttcaaaaggggcccaggctcagaagggctctgggcttagtttagtactctgctgttactatcttgaaattcttaataattttatctctgaatttgtgttttgtaagtgaagtcggatgagcagaggataaaactttatattttagtacttttaatggtactttttgcccgactttgaacaatggaatttttgttttgcactatgccctgcaaattatgtagccagccctgcctgcaaccctctcccccagaaatgggttgtgtgtgcttaggtactagactcagtaatccaccctcccttttattcatttccttgcattatgtaccttaatacattatacacacctttgaggggagagccactatcttttccatctctttatcacaagctccccatatcctagtgcctaacagagtgctaaggatgcagaaggtacttgataaatatttgtaaagtcaataccccactctagttagacaattctcaactactccatgatgaccaccactgaaccttttcaaaacttcaaaatctatctggtttccagaacattataaagtatcaatctccttattctatggaaagctacaaaaataatgacctctccttttaggcttgtaaagaaacaacatttcatactaatacaacaatgataagtgtattaggtttgtttttaagggctttattttcttttaactttttgttaaatctgagcatcaaagcattttttgaaagtttactgttccagcatcttagatccctaaagatggcaactcaactaacttttcctaagggttgaatgctgcttcatgcaatgcttaatttgagtcaacaatggctgaaggaacatccttaaatgcttatctcaagaggagcaaatgtagctactggcctctggcaatccaaaggaaaataactgaggtcaagttctgtcttaaattctcagtaccattacaccttgtactattgctagattctcgtgttggcccattttaggctctttataatgatatgatttatatctcatgactcaaattcattacagatggaccatacccaagataaatgccacaaggcacaaacaactcttcatctactccacagcttccaatggttggagtcactggacgctaaaaaatcacttatatgaaaaatatggattgaattggttacgtatcttacaagacttcaggttcaacagttttctttttcccattttggcaagcatagatagagaactcagaaatgtgtccttggctactaagaggggaggcagatccaggacacacatggaataaagcaaagccaatttaataatggtgccctttatccaaagatgaatgaaagacatcagtcgtcctctaaacattaatggagggacacaaaaccaaaaggcaatggttgagaggcaaaggaagtgacctagagagggtattgagtagtcaaaatagtggagaattgagaagaggaacttgggtttggggaggtgtcataagggtaataagagtgtcaattgcaactttttcattagcttaaaagaagaagttgttgatgtttaacattagttgtaataatctaagagggaccaaatgtacactgtgttgagatattttaggcagagtaatcaagacagagagagcatactttattcacactgtgactaaacctagcgcactgccaaaaaataggatttggaacaaattttggaataaaaactactcatctgttttgcaaaaagaaatcagaagcacatcagcataatcagtaattttaaacttgcctattaagtcaggacactgatcgctaacagatgcatatatttgcaaatttcttcaacaaagttgacaagttctgtatcacaggtctcttcttgctgccctgtaatatatgtttctgaatttctaactatgctctcattgctaatgattctgtgtatctctgtcatttcagagatacccagagtggtttctattgaccagtcaaattctgcattgtgagaaagcccaaaagtaggcctttaaccaggtcttgatagttaataattttctgaactcaatgcaaattgagcaaaaacgattggccattagtagtagtcaatggaaaaagcccctgctttagtctggagactaaatgtgtaaacactctgggctgtacctgaagcactgtggtgaagggcatgggcttcaaaatatattctgaatgagcaaatgggctcccagggtaacttagaatgtagtttatgaactagctcattttggaagttacaaatacaatgtaccacagtgggggaaatgtggtattcacagctgaagacttatctaacagtgacagtgagaatggaataatggaataatgacacataagtatgaatgaagctgtatctctttgcttcaaatttggccaacaaccacacgtgagctgggaacaacatggctacataccacaatcccctacatcctcaaactggtgacatttatcagccagccatttctcacaaatgtggatttttatagataggagttatgaaaagtacatgcacattgaagatccacaattctgctgaaggtctttcatgagaattttgaaaatttccttcaaaatcaaactgttttccctcaaacaaagcctgagctatgaaaacaggtttaagttgccaaagaattcacctgtgattgtttgtagtctaacatctaaaggactggaatggaatgtcagaatgtcagtcagaaaatattttctttctatctatctatctatctatctatctatctatctatctatctatctatctatctctactttggcctggaattaaacttgagaaatttagaaacatcattcttgtgcccctccttttaaaaacgaaaaacaaacaccaaaaaatacagctaatgggcatatttcattagaaacaaaagaaacataaaaaactgttagaaacaaaagtaagcgtatcagtcagtaactttaaacacaagaagcacacagacttcccaaactaaacatgaagagtattaaaaggaatctttaacaatggcacacaagtgtgaataaaaatctctccatcttttctgatagtctctcactaactccaccttaaaatctcacaaaagccttacttttgcacttccataggaaactttccttcagtaaccaatttccttgccatcgctttgccacttaggtgacaggaagaactttgcttaatactggacaacattcccagcactttacgtataataatttcaaattcacacacacacaaaccagtaaggtagttaaatattctcggccgggtgtggtggctcacgcctgtaatctcagcactttgggaggctgaggcaggcagatcacgaggtcaagagatcgagaccatcctggccaacatggtgaaaccccgtctctattaaaaatacaaaaattagctgggcatggtggcgcgtgcctgtagtcccagctactcaggaggctgaggcaggagaatcgcttgaacccgggaggtggaggttgcagtgagctgagatcaccgtaccaccgcactccagcctggtgacagagcaagactgtgtctcaaaaaaaaaaaaaaaaaattctcaccatgctatagatgaggaagctgtagaacagtgacagtgaggttgaataacttgcccagtggcttcggtggcagatctcaagtccacactgttatccacttatgtattgattgccgcctctctatcacagagccatttgcacttactggtaaattattttagagtttggtagtgctatatttacaggacattagataaatactgctggatggttacaaatttgtaggggtacgagcatctgcgattacatgtgattttgtgtgtgtgtgcctgtgtgtgtgtgtgtgtgtaagaggggttatagctgaagtttatttcaatgagttcacatacagaagaaaagaaatgtacattttgttgagggcctacaatgtgctagtcagcatattatgttttctgctaacttaatcatcaaaacaatcctgcaaaacaagtgttctctttctagtttttaaattctaatgtgtgttttctttttcttttttcttttgaataatagttattattattttaaatagggaggagttctcactatgttgtccaggctgctctcgcactcctgagctgaagtgatcctcccgtttcagcctcccaaagtactaggattacaggcatgagccaccacgcccagcccgtgtttgttttttaaacagatatgggaactgaggcttcgtgaggctaagcaaactattaaattaatgtcacataggtagtagatggcagaagacaagacacccccactccaaacataccttctggtgtcctatactatttgcccttctgttctcttctttagttcccaaagacccagagagctcaattgttcacaggatccagtctgtcccccaggtgactgtatttataatggtagagcatataatatttgtctcatattttaacacttttaagaatgctttattggaccgggtgcagtggctcatgtctgtaatcccagcactttgggaggccaaggcgggtggatcacctgaggtcaggagatcaggagttcaagactaccctggccaacgtggtgaaactccgtctctactaaaaatacaaaaatagccgggcgcggtagctcacgcctgtaatcccagcactttcggaggccgaggcgggcggatcacgaggtcaggagatcgagaccatcctggctaacaaggtgcaaccccatctctactaaaaatacagaaattagccgggcgtggtggccggcgcctgtagtcccagctactcgggaggctgaggcaggagaatggtgtgaacccaggaggcggagcgtgcagtgagccgagattgcaccactgcactctagcctgggtgacagagcgagactccatctcaaaaaaaaaaaaccaaaaaaacccaaaaatagccaggtgtggtggcacatgcctgtaatcccagctactcaggaggctgtagctgggaggaggcacaagaattgcttgaacccaggaggtggaggttgcattgagctgagatcctgtcattgcactctaacctgggcaacaagagtgaaattacatctccaaaaaaaaaaaaaaaaaaaaaaaagaatgctttattgactgtttttgtttacatctcccaagtactggcaaacccctttaaatttagaggctactgaatccagaagcctggttccatccatggtcttagtgtaaacactgtcttcataattgtggccacagttgtttctgggctataactgaggtgacatttcctagatataccccagaaatcatttcttagttctgctttccagagtgtctgaaaagccacaccagaaaaattaaatacaagtatttcaaacagtttgaccataagtaactgtaagaaatattttgatattgagaccgagtacacatggatatatgtgtgtaaatacatatgcacaacaaaaaagattttttttttttacaaaacagtgtgttctcttataacaattgatttttttttttaacatgaaatccacaaaagtctgtatatgactccctaatcatgctgcaaccaacagtttgaaaaacagggatggagaacatactgttccaattttaattaatattttgcacagaatggaattaaaaaagtcttgttcagacaaaataaataacatttattgatttcctttcatttatttgttctaaatgtacttaaaatgaggctgtcattgttatccatgaggtggggaatggataggttcccttttcactacatgcacccttctataccttttgaattttgtaccagcttgagtgcattgtccatgtgaaggttaggtaaaacaggcggggtgcggtggctcacgtctgcaatgtcagcactttgggaggccgaggtgggtggatcacctgaggtcgggagttcgagaccagcctgaccaacatggagaaaccctgtctctactaaaaaaatacaaaattagccggggtggtggtgcatgcctgtaatcccagctactcgggaggctgaggcaggagaattgcttgaacccaggagacggaggttgcaaaactccgtttcaaaaaaataaagttaggtgaaacaaaatttttactcttctgaaagtcaaatttttaattggggctggttctgccttgcttgatttcattttgttcttagtgttttaagactgatttctggaaaacagtttttgaaagaagagtagcaaaacttcaggtctgtggctttctaaagcataattctccattttctaaaagtattgatccgccttgggctctttgtcagttttatgcacttttgtaatactctttgcgttttcaagatggatagccaatggtgttttgataaacttggtcaatttctttactaccctaaaatgcaagtaactggccttctagctttaaatatattcatcttattcaaatagtatttcaacagattttctccctatagcatcttcagtttttgtcccctctaaaatggcatatgatcctggccttaaataaaatatttttatctttaaattttaaaagaaagagtggccaggcgcggtggctcatgcctgtaatcctagcacttcaggaggcccaggtgggtggactacatgagctcaggagttcgagaccagcctgggcaaggtggtaaaaccccgtctctactaaaataaaaaaacttggccagttttgcaatgaaaagagaaacctgaaggtagcataggagcacaatattgacatgttaacaaactgatcattgctgcctctttccttatagaccttctttttgagaaatgcacacttgagccaaaagaagatacataagcctgagtcctctatcacttacattctttcaaatcaaaagcagctcccaatgttgggggtcttgtctgccttcaccatttgaaagaggaagtgtagattatatgaaaacatcatcagtctcaggaaagagagggttaaattctgcatgagactcagaccttcaatacatctcagtgagtcatgcaaaaatgcacagaccggctcctgctttagttctgctgtctctaaaagcagctatatttgattgtcctgaagctgatgtagcattatgtgtcagaggagctaaataacttctataactcagaaacagactttttgtttttaatgtagagaaacttgtttaaatgccaagagtcctctgggcatatatatgaaattttaaaacactacatgtaagagtgaggagagatgagtaaccacctaagacagaaatagtgagaaaaggtatctagggaaaagaaggtgtgtcttaataaatatcaggcagactgtgaaatgtgtacatgaactgcattttagactctatctctttaagtgttaatgcattgcgactactaaatgcattattaaaatggtgccgattgctcaaacctttgtacccaaagcactggattatgttatccaaaattttaaaaatacaaacaaacacttttcataacaaaagttctctcagacttttgacctctctctttctggcattacacgaagctagaacttgcaggggttggagaatgtggcctctgatcactaaccagggttttctctttacactggcttgtttacttatttcttcaccaaagccagggaacgtccctttagctactgcagcatttctaacagatgcgacaaatcacaggggtgtattttgactgctactctgtcatgtgaacaagagaaacactgaaatcttttcccagtccctgtgcttcatccttgttttcccaaaatgtttgtaaactgctccagagaattcttcttttaatatttgagtcttctttcctctggtagattaaaatgttaatacttacgttaataagataaaatgtcattaactggaaatcattttgcatctctgttatctattctggcattgtcatttcagtattgtggctgattggaggtccaagaaactattttaatgtaagattacagaactagacactagaaattatttctatgttcattattttaaggttttgaaaatgagctgatcattttcattagaatatcctggcagtagtattcatgtttcattataaataaaatgtccattagaatttgtgaaatataaaacaaaaggtgcttcatattatatatgtaaatgcaaaggtgccttaattcccactgatctttgacagcctaaatgaaagatctccctgcatttctgtgtatttgccatcattgttaaattgccacaaagttgctttcgactttttaatcatttgggagaaggcagcagtactggcaggaacttcaagtaacttagcaaagtgtgttgccctccttttcctccacccaacaacctaaaattaccagctttccataaaaattgtaaactttctaacattcatttcattcactcaaatatagatttgtaaggtttttttaaagcatattattccagcatcactgatttgtttagttatgaaacaccccacattccatagaaagtaatacttaggctttgtattacatttgctaggtaggtaactgtttcaggtcaaaaaacattgccctgaactctctggctgctgcagacattcctgcttacaacactatggactgcgaatattgtgcacaaactcttttgtcttcagcccaagagatggaattcagcaaacatgcagttgactttttctataagaacaataattgctgcactactaaatcttgcaacttctatattaagacaaacttgatgaaaaatgggtcaaaatttgaggctcaatatcagcctcatttggcaacagagccaatcctcagtaatctgtggaaatggcaggcagggagagtagggaacatctccaaaacccattttagcaatattccaacagttccagttatcagagctcttaacaaagagcagaatttaaggttcttcctcaattctcaggccaccctggaggtgaggtgagagaaagggaggaaagggcaggctcctgactctctttactgaggaaaaaaacaaaaacaaaaagacagaaaggaggagattaagaccaacacataaggccacaaagaaagggagaatgatgactgttttgaagcgatttgcattcttttagcagacctgagtaaaaggaaagccctcccgaaaaacacaaaaacactgccccactcacttcatttcttcctgaagggcaggctcaacaggactaaaaatctgctccttgaacaggagatttgctaaacaatccatgcatagtagtaacattcaccttacatttaataattactttataagtgtcaaagcaatgacaatgaagtaaaacaagtagattgatttttcaataaatgagctacaaatttaagacttccaaaacactggtctaaaaaaattgtcaagataggcaatattccaattgatactgtcactgctaaacattagtatttccactggaattatctagagagttagttaacaagacattcaagacaaacagtctcaatgcctagtagatatcacctcatctttgaccatatctggaagggaaccaacatgattcaaaatattcaccagacttggctctgaataaccgccagctaaataaaaaataataataacctgcaatacaaagcccaagactgtccaacaccaaggacatctaaagatgacaatggtttctgaagaaattatcgcattattttattgatcccaacaatgactccatcaaatcagtaaaataaaaaaaattttaaaaaaatcaggccgggggcggtggctcacgcttgtaatcccagcactttgggaggctgaggcgcgcggatcacgaggtcaggagatggagaacacggtgaaaccccgtctctactgaaaatacaaaaaattagcggggcttggtggtgggcgcctgtagtcccagctactcggagaggatgaggccggagaatggcgtgaacccgggaggcggagcttgcagtgagctgagatcgcgccactgcactccagcccgggcgacagagcaaggctccgtctcaaaaaaaaaaaaaaaaaatcagctctcacaaagactgtggaagaagtccttagtgaagtgataaaaggccaaattataagacagatgcctagcctgtgccgggagtggaaaaagccctccgtgagcagatttcacgattcaaggttaagtctctagagtgaaaataagtgtagtttcacagaagttggcatataaggaattcaacctttagaaatatatactgtgaatatccagagttctatacattatggctttgtagattataaaactgtaaaatttaagtgtttcaccaaacttccaccattattacctcaaaaagttgtattacacagaacttcaactttctatatgacccgtttcagtaatgtgtgcatttcttaaaatgagcacatttctcctgtaatcagaagaggttggttttttgttgttgttgttgttttgttttttgtttgtttttaaataaataacagaaaaaggtgtcagtatttggaaatactattcttcatgggtagaaacttgatagtgattatataggtggttagggtgaaaaatagcatgagttccatttttaacttctttcccagaacatttaacctaaaacaacctaagacaccgaagttaaaaggcttgctaagtcagaaaattcaggaagggaagcttgaatgcaggcagtctaaccaaaggcagtggaggaaatgctggaaaactacggtcttaaaagagcataagggccgggtgttgtggctcacacctgtaatcccagcactttgggaaaccgaggcgggcggatctcgaggtcaagagatcaagaccatcctggccaacatggtgaaatcccgactctactaaaaatacaaaaattagctgcgtgtggtggcacgcacctgtagtcccagctactggggaggctgtggcaagagaatttcttgaaaccaggaggccaaggttgcagtgagctgagatcgcgccactgcaccctagcctggcaacagagcaagactctgtctcaaaaaaaaaagagcataaatgtttaatagacaaaccaaatattgtaaatttaaggtagcatttctagcgatacctaacaaattaccatcactttgtataaaaataacagattttaaatacactgtttatatgtgttcttaaaatggcatgcaaacattataaaatccttttatagccttgtaatatttcagatcaaataatagctctgaaagagatgagagaagatactgtccatccctttagataagcaaatattgtagtcttccagaaataaagattctataactggctgatagtcctcttcatggttttgattgttttatgggttccatgcttgtatgcatcccatgaagtctctcagttccctagctcttatttggtcactctcctttgtatcactaaagacaacaatttagttttgtcttgaatgattgaggacttgcattattactcactggctgcatttaacccaggctatgcaagttgaaaaacaaacaacaaaaaataatatttcttttctttttttttttttttgagacgaggttttgctcttgttgcccaggttggagtgcaacagtgagatctcagctcaccacaacctccacctcccagcttcaagcaattctcctgcctcagcctcccaagtacctgggattacaggcatgtaccaccacacccagctaattttgtatttttagtagagatggggtttctccatgttggtcaggctggtctccaactcccaacctcaggtgatccacccgcctcggcctaccaaagtgctgggattataggtgtgagccaccacgctggactctttttttttttttagatggagtctcgctctgtcgccaaggccggagtgcagtagtgcaatctcggctcactcacaagcaattctcctgcctcagcctcctgaatagctgggactacaggcatgcaccaccacacccggctaattttcgaatttttagtagagacggagtttcaccatgttggccagggtggtcttgaactcctgacctcaggtgatccacccacctcagcctcccaaagtgctgggattacaggtgtgagccaccacgcccggacttctttctttttcctactttcttttattcaattttaagacatctctattagttttgaaaactgagtatagaaagctaatttcattttacaagttaaaaatatgcaagccaatgaatttaagttggtaagttttatctcatataggttaagcatccctagtcagaaaatctgaaaaatctgaaaccacctttgcaaagattatgacagtgagagaagtctagcatgactgattccatcttgcttctaacctcacaggctggctgtcctcactcattcccaggcacaggccaagctaaccattggagagatttagtttaaattttaactttgaaacaatgatgatgctagttgctccctaaaattgacactttccttgttcagggactgaaactgcctctgtaagattaattttgaaaagccacaagattagaattatgggaagggcctgaattctggtaagatgcaggcatagcttaccttcctataaggcaccagaggtcacaagatttgtgacttccccacttgctactataaataacatcactattgtagaacttaagattggtcctttgagatatttcttcatcctgcatcctggcaactgactgactccatctagacctgtgactcatgactcaaccagttctgtggccccacccacaggctgactcagcacacaagggctgttctccacacccctatgatttcacttgtaatcaatcagcagcacccattcccttacccccccacccaacaaactacccttgaaaagctctaacctctgaacctctgaggagacagacttgagtaataactcccatccttccactaggctgccttgcaataattgaactctttctctaatgcaataatgctgtctcagtgaattggcttcatctgcacagtgggtaagaagaacccattaggtgattacaaaatctgaaatatttcaaaatctgaaactttttgagtgctgacatgacactcaaagatcatgcttaaagttaatggttattggagcattttggatttcaaattctcagattagagatgtttaacaaacaaatgaaggatcatagggaacttcaccccaaaacactactccctggtataatgagtattttgaattaaaggctcttggagaacaacagacactggaagagattttttcccactctacctaaagatccaagggaatcacaaggagaacaactgtttttcttctcctccctgttatcttgtacctattgcagaaaagaagaccaagaatgtaaggacacctgagcagacccaaagagaactatttacaagttaatctctgttcttcatccattaattctcccaagtaatcatttattgcccttcatcagaattcctcttgtcccccatcccataacctgttttgccaggacccaagtccccattctttttttttttttgagctagagtcttgctctgtcgcctaggctggagtgaagtggcatgatctcagctcactgcaatctccatctcctgggttcaagctattctcctgtctcagcctcccaagtagctgggattacaggcacacgtcaccatacctggctagatttttttttgtaattttaatagagacggggtttcgccatgttggtcagtctggtctcaaactcctgacctcaggtgatccacccgcctcggcctcccattcttttttaacctcaagatcgtatataagcttctgagctcctgaacccctttagggtgtatgtaatcactctgtggttctgccctgtgtgcaagttaatatatttgtgtgccttttctcttcatctgcctttttgaattgatttatcagtgaaccttccaagggtgaagggaaggttttccctttgcccctatataagtgaaatacaaatattcctaaacccaggccaggcgcggtggctcacacctataatcccagcactttgggaggtcaaggcaggtagatcacctgaagtcaggagttcgagaccagcctgcccaacatggcaaaaccccgtctctactaaaaatacaaaaaactagccaggcatggtggtgggcacctgtaatagctactcaggaggctgaggcaggagagattgcttgaacctaggaggcagaagttgcggtgagccaagatcgcaccactgcactccagcctaggtaacaatagcgaaactccatctcaaaaaaaaaaaaacaaaaacaaaaacaaacaaacaaacaaacaaaaaaacacaaatgttcccaaacctgaaaaaaatccaaaatgtgaaacactgctagtcccaagcattttggataagggatgctcaacctgtatcaggtattcagtttaactatctccttaacatccatacataagttactcttttattaagctgaacatcaggcaggcttttacattataaatcttcataaaatgattacggatattagactcacagaactttagagttgggacactttttaataatgttaccttaatcattccactattgacatggcaaacattttagatggtcacaacacatttggttgtcccttaattatgtcaataatctttcttttattaaagaattatgtatattagaaaacatagcttgaggtgtgtatgggtgtgttgctggtgctcaggacacaccatcccaaaatatgactgtgagagaccagaatgtgcaaccccaaaatacacccctttggcatcttttgagcttgttctgaaaacctatacttttataaaggaaagttctatctctaaaagaagtctacattagtaaagtaactgtatcaggaagaaggctgctctattaccagagagactttatctgcataataatacaacttttattcaccatacagctccattcctcaccctcctgtaacttgtgtcaccaccacccagaaggcccaagcccttttcctttctgtagctgaggatgttctataaacttcaatcatctgacctttcccttgtctcatgttttgtggaactcctttgcggctaccggtaattaaagtggtttttctcctgttaatctgtcttctgtcagttcatgtcttaggcttggttgttgaacattcagagggtagagagaaagttctctctcccttatagtgtataatatataatttgcttcctttgaattttttccaagtgtttgtcgttccctgtcaagtaatcttcacgaaatccctgtgaaagagatggtaagtagacagtgaaaaaggggcagtcattgatgctcctggccatggaacgagtgcaggacaggttcctcttgcaggccagtttcatgggtgtgtcacctgtgcagtcacaatccacaggactcataagggcccacacttgctttaacactctgctgtcactaccatgaaattctttatttttaaacaagaagccccacattttcatgttgctttaggaccacaagttatgtagcctttctgctcctttgtctttaacaccggctccccaccccatgacaattaatgaacctctagaagagttgcaaacacagtaaaattgtttttcctcaggcctccacttattgctgtgtgctgagaagctcatcacagcatgctacagacctcgctcaaatgcaaccttattttcttacctcagtacagtctatgttaacctcctcatgctacattttacatataggacattccctctgacttttctgaggagtcaaatgccttataataccttctaaaatatcttctcaaaatatattctaccatcttatgcatatactgtcatctatttccctccctcttatttaaaacaaatttttgagaacggagagatcgatttcatggttggaaagaccaactctgtaaatgatgataagccaaagaaaagcaaagacaacagcaaagaaagtgaatttgccaacatgttaatcgtggtgcgtcctctacttttctctcaagttctggcattggatttgctccgcctttgtcgcctctgccctgtgttgcatccagctctctgttgaaactgaaacatcataacaacaatgaggataatagtgtgtatggaatcttcatcagtatatttgaccttagaatccacccgtgagcacaagagagagcttaggcttgacatatttccctaaaatggtgtgtctgttcactcacatgcaaacatgtgcaccctggccagtcatttttattaccttcaaatgaactgtcatgaagtggagtgaggtctgaatgtgctttggtgttttcagcttggtatgtctctgccaggctctcctggttctaaggcattgacacagagctgtctcacctccagtcccaaatacagctccacagaattatcaggggccctgcagccacgattctctaggctattatgataacttcactactagctgcattgttaccagctcaggttgacattcccacaccacccagaaggagcatgttctgtcagagtttctgggggaatcagtgcctttgtggaagaaaaaaaaaaaaaaaaacccaaaccaaaccaaagcaacaacaacaacaacaacaaaaacccacaacaaaccctcccaaagggaaggctagaaaaatgagccagaggcagtaaccagggtcttttgaaaactagtttttaaaaggcctccttttccttcccattccatctgttctctaacccttccattaacccccagagcctcttgttcttgctcccttccccagaacttaagcaatagacaaaagacactctcacttccttacacgtcaagaaaatcggaatggacttcagtatggctaaggcaaatctgaagaggaaaattaataaaccaccacattactagatagataccataaacaatcaggatttgaagaataattctaaaaataagaaaaaggggtaaacatttttttttaaatgagcagcatttagaagtaccgaaatacccatataatcactaggcttgttgcctagtgaagaagcacattccacatgttcatcatagtttttaaaaaatatctggattcaaatccaactgtaccgccaagtttacctgtattttggtttacataagcacaaaaactctaatgcttcacaaaaccattagctcaaatgcacatttttttttctgtgaatttcactttaaaggtttagtggattgatttataatttgttgccttttgtctttttcaacagtatgtcattaagtctttaatttggtgtttcctgtagtctgcagtaggatatatgctattttaaatccaaggattgcagacatagatggtgggtaaaaatctgtgaaccataagtaaattcttataaggaacatacaaaaaagattgttcttcagtcagacttaagccattacttttttctaaagaagaaaaggcacaagttaagaaaaaggcaccgtcaaagaccttctgcccaaatgtgcatctccatgaagtttcctgctgagtgcatatgaatgcaccgtgatctgggaaaaggatccaaataggatttcaaacatccaaaaattttaactcaaacatttaggtatttcaccatgctgctattcattcattcactgattttttttgtcttagtttaaagagatgctaaacaaaaggaggcaagctctacatgtatttacattccaaaactaagctcccctcaccatcccccaagtctgtcatcccttcacagctaaacaaaccgtaaagtctagccttaacttggggaagagaagtaacaaacatgtaagaaagtttctcccttttcttcaacaaaacagaactaaacacccggagtgaataatctattatagttcccaatgttgttgtttttttctataatctgcacaatttaagataatgcatgtaggctaaattaaggaacaagatcagattctttacgaatttggtactattgagttctttattgttaaacagttttttgtcaatgaaatgcattggcatcttaactactaaatttaatgaaaaaatatgtatgttaatttatttataaaattgatgaatttattatcataaagtataagactttctgaaacaccctgaaaaagataaacaggttttttttttttctttttatgttcctaacccagttgagacgtacctaagtttgtcatctaacagtgaaggtttttccaagtgattttatttatgcccttatccacatatgtcaaaggtaagtaaacgacgtattgtttaagtaggtttccatttgctttgagataaggctaaagcaattaattctctggtagtttttatttttaagagggtctacattattatttcggaagctttatcttaacaaatgatctgagaatcttcatatctacttaaagtagtgttcggtaaaactacagagggctatacctagaaatctattatttgttggaaggatttcttaaaagccttcaattaatatcatattgaacgacagttaagtatgttggggccatgaagtcactgaattatctcaatctctgaatgtatttacaaattttcaaatttcaactttagatcttctgcatatgcataattccagaaatgtaataaactacatcctaaatttgaaaaggaaatgtgaatattatgacattctaatgctcatgccaatgtagccttatacaaacatacacttgattctgtaaaaaatctggaacaaaaagtaatatttataattgggttgttataaattgaagaatcaagtaggaatgtaagcaccatctatttccattttttaaaaaaccagacctatactttcactgcttttcacaaaatatctacaaaagcattaaactctttcatctacagcacactttgcaattattctcttcttctcacatctgaaaagcaaattagcagttctcaaatgtgacgctacaacaccagacaaaattgtaagctctgagctttgttaaaactagtatgaaaaaactaaatatatctgtagatctaaaagaaatataaccaaaaaagtaaacatatgaagtattaaagttacttataattggaaatatctgaaatattaaaatgagattttaaaaatcagtggtgaccctccccctctcacactgtcaatggagactgtgtacgttccaggaacctggactggcactgggggaatgatgtgtcctttcccctccttacaggagcagtgtcagcggaggcctactagttaggactttcaccaccaccttgcagtaccaaggccacccccctgcagtgtcagtagagactgtactcagagcagtaagaatccccacctctcccagagtgggggtatcatgggaaggctggtaaggagcctgaactcctgcccctgccaagcaataatgaggtatgcctacccaccagatgccaacaaagacttagtgggtaacccagacatccaaccccattgaacaagtaaagaggtagagcagtatcagacgacatctactagacagaaggtctcaaaaagatccatccaaaatttcatgaaataatagccaaagtgtctaaaatttgatgaaaaatgacttgtcataccaagaaccagaagcacctcaacttgaataagaaaagacagtcagcagggcttcgtggctcactcctgtaatcccagcactttgggaggctcaggtggccgggaggtcaggagttcaagaccagcctggccaacatggtgaaacctggtctctaataaaaattaaaagaaaaaaaaattagctggctgtggtggctggcacctgtagtcccagctactcaagaggctgaggcaggagaatcgcttgaatccaggaggcagaggttgcagtgagccgagatagcaccattgcactccagcctgggtgacagagtgaaactccgtctcaaaaaaaagaaaagacagtcaagagacactaacaccaagacacagatatcagaattttctgacaaggatttaaaatcagccatcataaaaatggtttagggccaggcacagtggctcacgcctgtaatcccagcactttggaaggccgaggtgggcagataacctaaggtctggagttcgagaccagcctgaccaacatggagaaaccctgtctctactaaaaatacaaaattagctgggtgtggtggcacatgcctgtaatcccaggtacttgggaggctgaggcaggagaaccgcttgaacccgggaggcggagattgcagtgagctgagatcatgccattgcactccagcctgggcaacaagagtgaaactccatttcaaaaaacataaacaaaaacaaaaaagctttaatgagcaataataaagaagcataaaacaaaagaaaaaatataaaacatcagtaagtagaagatgtaaaggatcaaatataaactttagaactaaacaatacaataactgaacaatacaaaagctcagtgatggactcaataatagaagagcgaaaacaaaagaatcagcgtacctgaatttctttaacagaacaacagaaattactcaatctgaacaacaaagagaaaaagtctaaaaacaatgaacagagcctcaggaacctgtgggaccataatcgaagatttcctttgtgtcactgaagtttcagagggaaaaaagaaagagggtgtggctgaaaacttcttctaagaaacaatggctgaaaatatcccaaatttggcaaaaagacataatgattgaagaagtttacagattgaagtttagagaacctcaaacatttgaaaaacccatggaaatccatgccaagatacaacataatgaaatttctgaaaaataaagacaaagaaaaagcttcaaagcagcagggcagaaagggacacctcacctaaagaagaataaaaattaaaatgacagcagattcctccccagaaaccacggaagccagaaggaaatgatgcaacattttcaagtgctgaaagaaaagatctgtcaagacagaatctgattctcagtgaaaatatccttcagaaatgaaggggcaattgagacatactcagacgaagggaaactcagagaatttgtcactggcagacctaccctaaagaaatggctacagaaagttatcaaaatggaagagaaatgataaaaagaagaaatactggaacactgggaataaggaaaattgaaaagagcaaaaatacgcgtaagtattattggggctcaggaaacaatgtcccaaagtatggtgctttggcatgctgagtgctttgaatcaaggtttctctgaccttctcctcaccctcctccagtcccctgctgcccctgtctctcatctcttgcccctctttccctcccaaagtgcaggaaggtgctttctctgaagttcccttatctgactaagggaagttcctccagaagaaatgcaattgctttgagcccccctctctataatcttatcaaacagagaagattagctcacaggaaaggagactaaaggtcaaaaccacctattctgaagattgctagctgagagactttatccgtataacaagacagcctctgctcatcacacatttttctcccctcaaacctctataacctgttaccacctcccaccagaaatcccagccccttatttctttctgtagctcaaaatgctatttaagcttccaccatcaggcccttttttgagtctcatattgtgtggggctcccgtctatatgcatgtaataaacgtgtgtgccttttctcctgttaatctgtatattgtcaactttattccagagactcaaattattgaaccttcaaaggatggagggaaagttcccttcacccctatgcccttctcctcttgagagatatcatgtttgatggtggaagaaaaaattacaacactgtctgatgtggttctcaatgttctcaaagaggagatataaagaagaataagtagaaatcgttgaactgaaaaatgtaataatgaaattaaaaactcaatggataggctcgacagcaggatggagaagtcaggtcagtgaacctgcagactgaaaaacaggaattacccaatctgaacaaccgaaagaaactagactgaaaaaataaaaaatatttaagacaattatattataaatgaggagggtaaagggatgtagagagagataataatttttacattggacttgaattagtaaaatgttgacacaaataggctgttaaagattatggatgtacagtgtaatacctaaaacgacactaaaaatctaaacagacacatttaaaaatattacagatatatggaaatgcaattataaacaaagttcaaataaccctcaggaaggcaggaaaaacaaaacagtgaaaggtaaagagacggttaagtcgaaaaagcaaaaaatgaaatggcagacttaagctctagactttcgaagatgggaaatacaggattgactctaaaggggtacgactttatcttgatcatggtggtgattacccaaatctacacatgtgaaaaaaaaaaaagacatggaactatatgtacacattataccgttggggctcagaaactgatacaccaaaatatggcgctttgatgtgcttaactgaagaagaagccttaggcctctctgaccttcctcctcccttccttctctcaatcctctgcgcctcccaaagcaaaagatgaagttattctctgaagttcccttatctgctgagagtctggacttgccaaagaagaaaacaatcacctctggtcccttccctgagttttcattaactgaactcatatcacaggaagaaagactgaagtctgtcaacacacctgagcaggtttttgtcacgaaccatcgtgtctgctctgctggcccaacagactttgtcctaggccggtgtatgttcttcaagcccactgaattcccctaaaaatcatttactactctcctaaaatcatccctacttccccatcaccctttcccctgagaagaagggtatataaccatcagcaccccactatgtggtggattaatcactctgggattcttccctgtgtgtgttaataaatttgtatgccttttctcctattaatctgccttttgtcagttgattttcagtgaaccttcagaaggcaaagagggaggcttgcccttggcccctacgatacaagtttcctggcttggttgttgtactatatggttttataaaatgcaaccatggagaaaactcggtgacgagtacacaggatctttctcagctatctttgtaacttcctgtgactctataattattccaaaataaaaatcaatggcagttatgtaacatgaagctacatgcaggtaatggtacttttgcagatttgtgaagaaaaccaaattcgtgagtaacatgtactgcgatgttagatttatccatactttttaatactttgtattgtataaaaacttagtaaaaagacacaattttaaaattaatatctgatacaattttacttgttattttagggtcggtatggtactaactcaattcatataattattatgtctccaggaataagatgtataatgaggattcctaagcaagcctatgagttactttgcaaatattcaagaagaatgtatttatgttcatcataacacataaccctatttcctcatatctaaacaacatatggttactcatatttaaccagaacagctaacaataacaacctattactcaataatctggataaagaatttgtagtgtcaagaaaagagatatatatacaaatacatatgtatatctatagttaatacaaatactcacaaagtataacatataaaatccagaggcttttgaaaaggcaattcaagaaggaaaaaaacattttttatgcatttaccaaataagttaatgtggaataaacatttcatgaagtgttcaacataaagtgatacaaaaaatgataaaagtaggttttatatgtctatttgtagtatgtgtgtttatgttatatacacatattttttaacataaattttccacttttactaaaaccaataaagataaaggaaaagtagggccaaatcccaggcagatttgatatctacagaaaaacatgagagcactttcctgccactaaatggaaatgaaacaatcctttctttgtggaacaaatggaaagtgaggatagcgaccaaaagcttaagtttaccctcacctgagttttcttatatctgctagttgaatacacacatatgatatgattgcagagagacaaagggaccaaaaaaaaaaaaaaaaaaaagcaaacaacagtcacatattgaaagcacttcccatgccaagaacagcaaacctaatatcatggcttgtgaaggcgattctgtaaggaaacagagaatttaattcaatttcttaaaattaattggaaccttgaatataagatgctggactgataaagaacctgaggcaaatttctagtacatcataatcacattttcatgaacaagaatttaaaaatcggaaagtgctataacgaaaagacatgtgtttctttctgaataaaagcaataccaagtgataagggataatcactgcttttctttcctcagtttagtgggaaagatcctatgctactggcaagttatttgtttgtttgtttgtttgtttgtttgtttgtttcggtaattacaatccgatcacattagtgagaaagctatttcccagggataaattgaccaggaagggattttgaatattttatgctactagagcatcatcttataacagtaataatttccgggaggattttacttgccttgaatattgtgcatcttcttggaactttttcttagaaatatttatagaacttttcaaatcataggtattgttatttcttaaggtgcctctttgggaggaatattagaaataccaacttcctataatagcctctaccaagaagcagagggcttgatgggataatttctaaaaacaaaccaagaaaacctaaatacatttttagtaccaaggtgatgaccatttatcaaagaagtaaataatttcatgcgttaaatcatttccttatagtttttcattagtaactgagttaatgctgaatttttagactgactagcttgtttcaactttgacacatattgtgttcaagaaataattattaagtgaataaaaatcatattctgcacatagtaaaaatcaaagtctatcttataatctgtcacataccaaaattatagctttcaatttattttctttctttattttttgagacagggtctcactctgtcacccaggctagagtgcagtggcataatcagagctcactgcagccttgacttctcaggctcaggtgatcctcccaactcagcttcctgagtacctgggaattacaggtgtgcaccacaatgcccggctaatgtttgtattttttgcagagatggggtctcactatgttggccaggctggtcttgaattcctgggctcaagtgatcctcccacctcagcctcccaaagtactggaattacaggtgtgagccagtgtgcctggcctatacctttcaatttataattctgagtcgaacattcaagagagccaagggaaattttcttgagattgtaaggagtaaaattcctaatctagttacagaagctaagtgggactacaggagacatgggtagagctgaggcctaccatcatcacaaatattgcctgagccattatgccattatttttgcaacaacacctgttcctgaagaacaacatggagagacaccaatgaataagccacattacattttagggggcaggactgggcatttgagggttgtgagaaacatgtaaactgagttgccagaaggttactagaaggaatcttcttctctagttcctactgacagatgtgtgtgaccacttgatgcaaagctctcttcttaaggatataagccacatgaaccatagctatggaaggtatagaaaggaaaatcttaagattttctttctggatatgaggcctcacttgcgactaactaaagtgcattttgttattattctttccttactattcattttaaatgagtgggtttgtggtgtttctaaaaatttaattgactgtctttggcttgtaatgctctgaagtgtaaacaggtgaaactgggaaaagaaaatgaattatccaggatttctagacagtaggatcctgttgaaagtcagcatgaccaaatattttgcacatcccctgtgcaccacacaaaacaagcaataaagctgtgcttatagaaagtttttgaaaaaaattacatcaagtcttgtcttaaccagtcggaaggcaattgtgaatggtgagattcctctctttattaattacttaaacttccataatgaaattcaggtgtgatccctaaggctctgcagcccagaacagttaaatgaactgcagaatatggtatttgccaaaggggaattaattatgttaagagatgtatactatgaataccaacaagcctaaatatgtgctgaatagtagaaaagggataaactagaattttacattataaaattccaccaacctcacaatcatggcccatcatctggttgaacatttttggttttgtttcatttttacttttgccattttgatctatgcttgcaccaactgccacatccaacctggccatctgcagcacacggggaactttttcttataccctcccctccccagtaatccatgggacctattatttaatcaaagaatcaaatactagccctcaggtcaaacaatgagaacaaactcactccctgtattttgcgctgaacattcccagaaaagagtcattactaatatgcatattaaagtgtacttatgccaatatcaaccagttagtaatagacagtatttctttctttcttttttttttgagacggagtcttgttttgtcacccaggctggagtgcagaggcgtgatcgtggctcactgcaagctccacctcctgggttcatgccattcattcttctgcctcagcctccctagtaggtgggattacaggcacccgccaccacgcccggctaatttttttgtatttttagtaaagacggggtttcaccatgttagccaggatggtcttgatctcctgaacttgtgatccgcctgtctcggcctcccaaaatgctgggattacaggcatgagccactgcacccggtgacaatatttctgttttggggtagcaatgataacttatataaatgatgaatcattccaagttccataactgcaatcggtcaaaagattaaattattttcaatctgccccacagccatatgtgttataattttatagtcctttcttaatacaaagtcccataacaacctcagagcctcaaaagctctttcactaatttgagcaaattttctcttttcccattcaaaattcacctccttaattcaccatcaagggggtggaccaggttgaggggaatcttctttttagtaaattaaaaaaaaaaaaaaaccacaactgaatgcaataacattttctaagtttctagcaaagtgttagtttccttagatttttaccaatatgtcaaaagttgatatttaataatctgttctacccaacacttaattggcagtctatccattgaaggcaaagagcagaaatgaatgtctctctctgaatacactaagtgtagtcaatcagaattactaacaattggccaggcatggtggctcatgcctgtaatcccagcattttgggaggccaaagtgggaggatcatttaagaccaggagtttaagatcagcaccatcaacatagcacgaccccatctctacaaataataatactactactaaaaattaaccaggtatggtggtatgcgcctatagtcccagctacttgggaagctgagatgggaggatggccttagcctaggaagtcaaggcttaaggcggcagtgagctatgaggactacattgcacccaagcctgggcaacagagtaaacctctgtctaaaaaaaaaaaaaattacgaagaattcatggtgtaattgagaaggctgcaaatagttgttttagattgcaggttcttgagtcagactctctgggttcgaatctcagctctgtcttttacttgccctataaccttgggcaacttccttaaggaattttctcagatgtaaaatggggatgattacagtaactacttcctcaggttgtcaggagtacatgagataatgtttgttaaatgcctctcacaatgtctggaaaatagttaatttataaaaacagttaccaccaccaccaccaccaccaccactaccaccaccaccaccaccaccaccaccaccaccaccaccaccactacacctagagaagcatgctaaagagaagacacaatacagctctcaaagagtttacaatctcaatttgcaagtattaaaaacccccactctctaaaaatatggtagacatattaagcatatgtaacatatgcaataaatacacacatcatactttcagtaaaatataaagtattcatattcaaaaggcttctgaaagtaggccgggcatggtgactcttgcctgtaatcttagaagtttgggaggccaaggttgcaggatctcttgaggccagcagtttgagactagcttgtgtaacacagaaagaccctgtctctataaaaaataaaaagaatggctgggcgcggtggctcacgcctgtaatctcagcacttcgggaggctgaggcgggcagatcacgaggtcaggagatcgagaccatcctgactaacacggtgaaactccgcctctactaaaaatacaaaaacaaaattagccgggcatagtggcgggtgcctgtagtcccagctactcaggaggctgaggcaggagaattacgtgaacctgggaggtagagcttgcagtgagcagagatagcgccactgcactccagcctgggtgacagagccagactccatctcaaataaataaataaataaaataaaaagaattagccaggtatggtagtgtgtgtctgtagtctcagctacttgggaggttaaggtgggaggatcacttgaacccaggagcttgaggctgccatgagctatgatcgtgccactgtattccagtctgggcaacagagcaacaccctgtttcaaaaaaggacttctgaaagtgagtcaggatataagtggaaaagtacctgctatacgacaagcaaagccaaagcagcagttatgtataagacacataagggcttcaacacagagtttttggaggggggataatattttaaaaaataaataaaaggttgtggactgctccatagaaataacacattactacatattgtaactatcatttcttaagagaaaggacattaatggaaatgttggaaggacataagatcagaatttaaaagtcttttcaattttatgtctttggatttttacattttgaacactgaaacagagagatgtgatagggagtgactgaggagtgtgagaaagctacctgagctgagagttgaagccagacatacaaagatctgaagcaaggtaattctgggaagcatcaccagctaattcaaaggtcccgaggcagcagtgagtttggcttgtgccaagaacagagagagaaccagtgggataaaataaaggcaggcaaacaagcagatgcaagattacataaactcttgagttgggtttgatgggtttcagcagagatgtgccatgatatcaagatgagaattagaaggaatctcctacctgctaaagggcaaagagcactaaaatggaaggaaaatcagttctaatattagagccacattaacgttgaaagtgccattcaagctaatgaaaaaactagaaagtaatgatggttgaaaagattaggatgatttaggtcaacatgttaaatttaagaagagaatgtgacacaaacaaggagccacctggaaaccactgtaaatgcaagtagcacatacttagagtctgcttatttctatacacgtggaagctactatgtacagatggtacatgtgtacaggttgggacaagataaactcccccaaaccagggggagtctaagatcatggttagaagactaaaagatttaagctttattattgaggcactcaaaatgagaaaaaagtttgtgccgacatagcattttttaatactaagacagacatttaagactatctagacaaaaattaatacctgtaagccactcttgtgcatcactttgggaaagataacttgatgctcagaccattaaagtaatgccatctagttcctggaactaccagctcaaatgtcatcttggccactcagtcaaagtagatgaatagacgacattctatttcatgatgggaagattctggaagaggtcttaaaggaaacattcaagttttatcttgtgcagaagaagtgtagatagaatacatggcacttatgagaaaagaggattgtcctattctagataacatttgcccagctgtagaggcactaccctggaggcaacagaccatgcgacctgttgcttcagtgatataattcacttgagaaataaagctgtgttatggaaagtttattcagagctgcatcatataatggcccacctgaatgtgccccattctaccaaaaaacaaattccaaaatataccaccattcatggcgagagtacttgacatgctcttgtctttgttgtctaaaaaataattgtccttcacccgagacttcgcaaaatgcaagaactaaatgcagtttccccatgacacagatcatctacatccttccacaatccccaacacacacacactagatttgtgatatcaatgacaaagtttttcttgggctcgttatatagaaaggaaaaaggatgtttggaaattttgtgaaacacctaattcctaagaaaaacatttgtatcatcatcattccaatcactggtcaggtatgattaaataatatataattggcatgattaaggtagagcagcctttctacttactaacagaaaatacattttccacctcatactgactacaggcaatcaagctctagaaactcctactctatccctctcaaggctgagaatggagcatgtgaggactttatcctcaaaagagagaaaatttagaagactcttctggcttttaaatttttcttaggtctaaatgacacatttgtttattcatgggtttttttattcttcttcttattttttttttgagacagagtctcactctgtcgcccaggctggagtgcagtggcgtgatctaggctcattgcaacctccgcctcctgggttcaagcaattctcctaccttaacctcccgagtagctgggattacacgcatctgctatcatgcctggactaatttttgtatttttagcacagacagggtttcatcatgttggccaggctggtctcaaactcctgacctcaagtgatccacaggtcttggcctcccaaagtgctgggattacaggcgtgagccactgcacccggcttgtttattcatgactccttttggtacatctatgttgagaacatattacatgccaggtacaatgacaaaaaaaaaaatgtgacaggcaagagaagaaatttctcacaatgcaaataagactatagggtaagagaagagactacttaagcatgggaattactgttgcacaaaactaaaacttaaggatagggatgtttggtattattatttcaatcatgcataaagctactcaacctcttgactcttattgtaaattagaattaaacataaaaagttctggttcctgacattttctgatggcccaaattttctattcttcttttattttaattgtaatctatttcctggattaacaggccaccttgaactaaaaatgttggttaatgttttacttgatccccatatttggagtcaggtaggtatgtctgtatatatgtacatatataagtatttttcatgcctgtggaagttggaatctacagctatataaggttaaaaaaaaaaaaaagactggctgggcatggtggtgcacgactgtactcctagcactttgggaggctgaggcgggtggatcacctgaggtcagcctgactaacatggtgaaaccctgtctctactaaatacaaaaaattcgctgggcgtggtggcgcatgactgtaatcccagctactcgggaggctgaggcaggagaatggcttgaacctgggaggtggaagttgcagtgagctgagatcacaccactgcactccagctggggtgacagagcaagactccgtctcaaaaaaaagactgtacagactgtaccagatagtgcttagaaaatgtttgcttaatctatcaaaataaatcactttagttgggcacagtggcccacgcctgtgatcccagcactttgggaggccgaggcgggtggatcatgaggtcaagagttcgagaccagcctgaccaacatggtgaaaccccatctctactaaaaaaaaatacaaaagttaactgggtgtggtggcgcacacctataatcctagctactcaggaggctgaggcaggagaattgcttgaacctgggaggtggaggttgcagtgatccgagatcgagccactgtattctagcctgggcaacagagcgagaattccatctcaaaaaaaaaaaaaaagaaagaaatcactttaaaatcttttagagttgttgaatattttgttaagaaaataccacagaaataatagtttgaaatggcactttaaattagacatcattaaaattttactgacaaatatttacaaggactgtcttttttattgagacagagtctcgctttgtcgcccaggctggagtgcagtggcctgatcttggctcactgcatgctccgcctcccgggttcacaccattctcctgcctcagcctcctgagtagctgggactacaggtgcccgccaccatgcccggctaattttttatatttttagtaaagacggggtttcaccgtgttagccaggatggtctcgatctcctgacttcgtgatccgcttgccttggcctcccaaagtgctgggattacaggcatgagccaccacgcccggcacaaggtctgtcttaggttgtcttgtcattattcccccagaatattttgaaaaaggaagagaaggtataactagtgtttgcttaagcattaagacgttcccattgttttcactaaaattgaaaaattaatccattttgttgtggattgatttgattcccaggatgagtgtaaggcaggactcatagaaactgcctgtttggcccttgctgaaataaataaatgacttacaaaaataatacccatactatggaccctaacattcttatcctctaagcttcaaccacatgaatcttgaaattgacaatagagccagaaagaacaaacagtaaactatttacagtcactcccttctactactgtgaataaaatgcattcaaatgctatttgttaaagtaaaggtggtcaccctaccaaattgctatgtaactacttctggaaatatttctacactgtaggcaggcataacaaatttctgaagtaaaacataatttggtgggtatgaaaagatactttgtaaacatcaactaataaagaaatacacttaaaaacaaaaaaaaagacagagagacagggtctcactctgttgcccaggctggagtgcagtggcacaatcatagctcactataacctcaacctcctgggctcaagcaatcttcgcacctcagcctcctgagtagctcagactacaaaagcacatgccgccacactcagctaaataactttttttttttttagagacggggggcggtctctcattgtgttgacaggccggtcttgaactcctggcctcaagcaatctacctgcctcggactcccaaagtgctgggattacaggtgtgagccaccacacctggcctaagaaatatactttttgaatgacttaatctaaaatattaaaattctaacaagtcaaaacacatgcaccctttgaaaacgacttctggctgagaacataggcaagacaaatatagcaaatgaaataggttaattaaaaaaaaacctgtcagttatttaaatttttaaaatactttttaagttcagagacatactgaatcatattcctcagttatcagcaagtgcttttgatagctttatgaaatcagctcacaagtttgttaaactcacattaagaactcaatcccagatgtagttatgatatcaaataaaggaactgtctggaggaagaaatgtacagacatagtaatcaaattctcatacaggattaatgaatgacatgtaggccaaaagatgattcatcttattttaaaagtaactttaaaaaaaactttgattattttagaataaaacacatatccttataggtttccttaggcagtgtcaaaattaattaaatgtatttatgatatattaatacttggtcatcagaaatgtaacagaaagggaaaacataactcttttgaagagtatacctcatcttttccaaatcaagatgagtcaaatgaaatttgcacaaattttccaaacaaaggaatatccaggaactagacatcattactaaattagcaaatctttaagaaatatcttaagataatgtaatgataaagcccacttttaaatatgagagctatttccaatgcagtgtctatttccaatacagagtctatttccgatacattttttgttttaatagagtcatatttgaactatgtttctttcaatagaaattgactattttttaaaacccaagtccattaaacagtgagttaagaaaaattacttgaaaaaattagctaaagtctcccaactacttacttataaagtgagaaaaataaaattaatattaggctgaggtgagaggatcacttgaggctaggacattgatatcagcctaggcaacatagcaagatcccatttctaaaaaaagaaaaactcagcatggtggtgcatgcctacagagtcccagctactcaggaagctgatgtgggaggatcacttgagcccaggggttcaaagttgcagttagctaagatcacaccaatgcactccagtctgggcaacagagtgagaccccgcttcgtaaaaaagaaaaaaaaaaagggattttgatcagatataagaaacattctgggaatcaaagaaaaacatcaaattattcaaaatgaaatatccctcatgtaaattacatgtttaaaagtgactacacattatttgcaatgtttttaaaatttcaaataaaatttatccaataaattactttatagtctcatttctggcaccagtaataatatcaatatgttaaatagaaatgctttttatttaaaatcagatttaaaagatatagtccatccaatttctacttctacatttctacatattccaatactgactgaaggcaaacacctcatttccttcagtgtttactcccctctgataaaaacgctgagggtataccaagcgtaggactctgttttccttcaaatccatactttgttcctgtgaactcacttgggggaaaaaaaaaactatatttttgtataagctgaatgagaagcacttgtaaagattgtcagatacttaatgtggcagatggataaaagggatgggatgagctctattttcagactaataaaaacctaattatttcagaatcaattatatttatgactaattttttaaagtccaaaaatgtattttgtcatgagaaatttgagctccaaaattaaatagatttagtgttttgtttcctatactggattatatttcaaaaatggttttaggtggaattgtaaagataagcaattttagcacatcttaataaatccaaagacacaaaattcaaagggatgattttatttttaaatggtaatttacgtaaaagcgattcatcatatataaggaagaatatattttcttggtttatatcttttataattaaaactgagaaataaaactgtggggaatataaatgtcttatacaggtttttatttgtcagaaattagtctattattaggttacagaaaatcttagattttaaatgacattgaacctactaagccatacatttttttaaatccccacaatatctaaaacttttacccttgaaagaaaacacactactgtttcaactataagcaaagttgtctccaagtattaaatgtatatttcttaaagacttaaaaaattaataaacattttaaagaatatatttattaagtttccaggaaatattctgtccttaccctttatttttctatttggaatacattgaacttagaaatatgtccaagataaagaaaaagtttacatagttttctgtgaaaaatgatgaccaatacagaaaatgtagtaaatacatgaatgaaatgtaagaaagtaatcatttattttttatttgcacagattaagttaatccacactgaaaactagccactgaactaaaaaagcaatagctagaaaaagtttacgtgatgtctaatgcctccaccctaattatcattaggttttacctgccaagtaaaaatagacactctagaaaatatttcaaaggttttagtatgcttgacccaggactattggcaaccattgtgaacttcagggatgattacggtatttaataatgaaatgcttaagtacacctgaaaatggatgataggcacttttaaaacttcatttgtttttacctccatttcattagagtcgttatagtattaaaaatattatatttgcaactcaaggggacatcatagtatgctaacaagctaaaacaaacctatcatttatttccactgtttcttggcagcaatataatgattttaattcaaggctttccaaattctgcaaacattatggacctttcatcacagtattagattatctatccgaatctccaaactattacatatcttagaaataattttttatttagtaatcattttaattgtctaatcaacaccttgaattgaaaatcatactttaattgccaactgtatataacctatgtaattaatttaatgcccagtaatttatagctgattatagcaacatatattttaatgagagcatgtacaagtgaatgtaatgaaattgctaattcctaaaaagtttttgcttatttataccttgcttagagttaacaggaaaattatattttatccaaacattatgcactgcaataatggcataatgaagacataagactctcctggcctaatctgattctctgcagagcagatgtagttagtacttagcagtctagactaaatataaggagatttattttaaagtgcatctttaccaatactcttgtgatggtcccaagatgaacttaagtttacttaattataatgataaattgttaaaacatatataaaatcccaaacagaggcattccaaaaataacagagaactaagttccaccaagagcccatcaaaactcaagtgtaaacctcatgtaagtcattgaaaacaatgaaataccttaaaggtaattgaataattgaacagtgaaataaaccaaaattagagtgatataaataagacttccatttgtttccatctcactctgtgaatttacatgtaagattaagtgataaactaacacttataaatataatttttagcttaataaaacagactggtcttatttgtaaacatatatatatatatatgattcacagatataaaataagggacaatcaaatactaagacatttgctgtctttggagaaatcatcatcattgccatatattcataccccatttccaaattataaattcacttgggaaaatcaaagactttcattatattgacacaaaagttaacagagttgatctatgcctttacaattctttttaaggtgtcagacacgccaagctcttcctccatgctttgtaatttcaaaacatactccaagatgcaataaagttcttagtgatcaaaatgaagtgctgagattgccagagattacaggagaccaaccactaggtctctgcgattccagcaatcatggtgacagggaagagttgccacttgtccactcttctattcatatatctacctactcacctactcatccatgcatgtacgtaggcatccacctactcaactaaatacacccaatgtttgtcgtaccttgtatagtgaggctgtccaagtctttagaagttcacacttttaagaaagggaaaaggacctgaaaaattggcagatgaaaatgaagacagaaaagaggaaaagaaagaaaattaagactaaagtagagaaaaacaaaaagtgtagaataggttatatacatcttgtaaaacaagatattcatccttattatatttctatcactcacttatctcttagataatgaggtttctacagaacataatataaaatgacatattaaagaatatggtgacatcaggagaactgtaaagttctttgaaaggcaaatagtgccgggtgtggtggctcaggcctgtaatcccagcactttaggaggccgaggcaggtggttcacttgaggttaggagtttcgagaccagcctgaccaacatggtgaaaccccttctctactaaaaaactacaaaaattagatgggcttggtggcagatgctgtaatctcagctacttgggaggctgaagcaggagaatcgcttgaacccgggaggtggaggttgcagtgagccgagattgcaccactgctctccagcctgggcaacagagcaagactctgtctaaaaaaaaaaaaaaaaaaaaaaaaaacaaggcaaataaattaataaatgcagctagaaatggatagaaatttattttgaaaaacgtatttatttttgaacttttttctggtccactggagaagaagccacaaaagatcataaacaatgtgtacgtaaaattataaaattgtatggttgaaactgtaatgcatttattccaatttcaaacaagaaagggcagattagacatttgactcatttgacaagcatcagctttagtcctctttggatttattctcctgtaattcacagaagagctctgaccaaattctaattttttgttcttcaatatttcttatctttacatttcgtcatgcattaaaatcctatttggacttgtctggcaccaatggcacattcttcctggctaacagcattatgcagatattaataatgttttaaaagtggtcaagggcatatcagcaatgcactttgtccctcttttaatgaaagaaagctcatacttaaacaggtgaactatcacatacctaaagttccagtgggaagagagaatcaaatatcaagtctaacaagatatttgttaataagagcaacaacaggatcttgaaaatacaaccataattttcagaaagaatacctaaaatttttgcagaaagtcatatttctcttagtcttatcatgaaataacagcacctaaaagcttggattctatgttcattgttcccacaaagtatgaaaaaggcatgagaaacattattaaataagactgatcacagtagagctactaactgcattcattatgttttttaaatcctcaaagccaaatacagtttttaccaccatgtccaacagagtttcagtgttataatgaagtttagtaattcctttaactacctgtgaaggaagtaaagtatcttctaaaaacttctgggtgctattgacataataaaaaaagagggagggaaattgctctataacagattttataaattttttatggtgtagtttttatagtgcatctataaaatacactgaaatgtgattatcaaatattgttcagctcccataatgaagaaggctaacattaaggatctgtccttgtttttactttgtaactcctattgtctgagccagattctcctcaggaccttattttattgtgattactgcaacatccctgccagcaagtgtagagcagacttggtcactcctttgctgaagtcagccaagagaatattctattagacaaagtaacatacgcctcaaaggcttggaagccaggggaaaaagtgagacacatacaagacaataatacataaaccaattaacttagcctctcaggaaaaccatcctcagtctcatcaaattgtgtattatctggcaatataaattgaaaatctatttatagagtagtcaggctaaatctcttattgctaaaacagaagtagtgaaggtcaaagaatgcaaaatcctaggaaacacaatttttttccaaaggctgtttaatatgcctttgatatagattactttattgacaatggttcttttgtctttctgaaaactacatctgcacaacaactaggtcaccttgaatttcaagtacaacattgcctataaatttaatttaacatcatattatccataattaccatgaacaggaggcaggtgtgacccttatggttaagctagagggaccaaggacaggataggttaatagacttgctcaaggctccagggtctgagttaactacaggctctacatgagccacaagtatgacctggctattaaaatattattacaatcacatgcttctttaaagagtagtacttccaaatcaaaggaggtaccagttccattgctggatagtacactcttcactccaactctgaggaactttattttagcgttagatggcatctttcatttcatagttggaattgaaagcatccatagagggcaatgagaaaagcaagcaatctgaaattgacgccccaggaactctgaatcagggaactctgagttgcagagaaaaggcggagcaaggatttgagggctatgtagctatgtataaatatccaaaggattgtttggtaaaaaatcctccaatagatcatttattctagttgggaatgaaagagaagaggtttttttgttcgcttgttttcgtttttgttttttttttttttgagacggagtctcgctttgtcgcccaggctggagtgcagtggcacgatctcggctcaccgcaacctctgcctcctgggttcaagcgattcttctgtctcagcctcccaagtacctgggactacaggcaagcgccaccacgcctggctaatttttgtgtttttagcagagatggagtttcgccatgttggccaggctggtcttgaactcctaacctcatgatccgcccacctcagcctcccaaagtgctgggattacaggcgtgagccaccgcacccagctctttcattttgttgtttctaaatgtaattagggctaccataaaataaagggatttttcctaataagtagtatgcttcatatcatgaaaatgttctaggtaatgtgacagcctatcttgtcggtatcattatcagaggggtacctaaatttggaaggcagtgaaatgatacatggaagatctttaaatctaagcttctgtaattacaggtcgtggagtctggcagagaaggagccaaactcagaactcagatctatgcagattagctctctgcccttcctttaataactggactcttggagcatctgattgacaggtctctaccccaatctttctactctgactgaccttacataacacgtagggttctctaatacagctgatgctattaacttgattaaaaatatttgataacttttaagtcgtcataggacaaagcccaatctgtctaaagtgacatattctggtctacacacctgaatttacatggtctcctaccacacttctctaacttccctgagagtgcctcgggtgtcaccaagtgggggtggggtgtaacacggctagcagctgtgacaccaggccttctttcctgcttggagaaggcagctttgcttttatctctttttcatatatatagatcatgtatataggttcaaaaaaaaataaacctatatataggttcatgtttttaaaacggcttagctttagaaaaccactgcttcagatacacaaaggcatcatggcacctctaacagtacaattaagtactaactacatgccttcctgcctttagacactatcttcacctcctcatcccttcctggcaaatgcctgttcgtcttttggggctgtaaaacaagcacaaccttctctgtttcttcaattcccaaggctgaattatttgctctttctcttctcccattctacacatgcctctttttttttttagtactttatacattaaaaatagtattaaacaagcttatctttcccatatacaattaccttcccagagctaggggtatgccttatttatatttttatctccacactttgcacagtgttttggatgtagcaggctctcaataaggctctgagtgaatggtagtcactggttttcaacctgtaatctttgacattctaggattctgctcaagattgagataattatgtaataataaccatggtaatactgtccttatattttccagcaacatttttcacaacccttgaattggaaatatgggtttgtggtcaatgagatgggtaaaggctggaaatttcctttaggaagtgatctccagatacatgatgatagaagtcatggaaattagatttgcctctccaaatgtcaggctacatttccatcatagggaaagagaacatttaccaccacgggctgagcaccatcaggcatattgcatatatcatttcatttaatacaacaccgaaaacaaatttgctctattatttctactttataaacaatgaccatgaaacttggaaacattaaaataattcaggctcttaataagagaaaattctagcctcgggaacatggcaagaccccatctcttaaaaaaaaaaaaaaaaattagccaggtgtggtggtatgctgtggtccatggtcccagctactcaggaggctgaggtgggagtatcgcttgaacccagcagtctgaggctgcagtgagccatgttcgtcagggtgacagagacagagagcctatctcaaaacaaacaaaaaactcagaaaattctatctcgtcactcctattgcatcatgactactagttcactcgctcattaattcactcactccatttattgatgtttatgaaatttattaagcacattagatgtgcctttaacatacaaaagtttcttgtaagtacattacttggatagattccaaatatttaatttccaggtccaagctgctttgaaatctagaaacaggccattatttaatttttttttttttttttttttgagacagagtcttattctgtcgcccaggctggagtgcaatggtgcgatcttggctcactgcaacctctacctcctgagttcaagcaattctcctgccttagcctcccaagtagctaggattacaggctctcaccaccacgcctggctaactttttgtatttttagtacagatggtatttcgccacgttggccaagccggtctcaaactcctgacctcaggtgatccacccgccttggcctcccaaagcgctgggattacaggcgtgacccactgcacccggccaaaacaggcctttatttaaagacacattttgaatttaaaaaaaggtaaatatgcaacttttaggggaaaaaacattgtatctctcatacataatatttttaaattataatgtgcccaagataggaggttttatattcagatcattttcttgagctagtttaaataacagttttttgtgtgcctttaaatactggtctatatattgtttgcaaaattgtgaccattacattttaaaaatctctacaaacattagatgatatcacataacaaaactttgacaatttcacaattttattccttttgacaaaattttattttaaactagtttaacatgtgtaaggcaattttggatttaagatttccctattggttttgttttaaaatgcacctctctggccatgatttcagcaagccaaatttcacactacacattttagaagtttcttcaactcagaacaattgcagtaatcccagttataccactacttcttagctcaaggatttggctataccacaagttatataacgttcccagaaatgtaactgctgagaaacagtcgaaatgtggttcactataccttacctgtaccaaacgtggcactcctacccccaataccagtattataaagtagttccctggtcagaaaacacaaagcatacctttaataattgggacaaacacacacacacacacaattgggccaccatttgttctaagtatagttgcataacaaagctgactgctttaaaagctggactaaatcatgctgattgcttgaaagtccagactacaagaacattggggctaagaactgtattttcttcataacctttggctaaatttgtcaaactgaactccaaaattctcctaaagattctagttctgtctcctattcatttattgtagatgttaaagtgtgactagatgcacgtcatatcagatacagattgtttaaacaacatgtgacggcaattctattatgtgtcaaatagagatttttggtaagcaggcaatcatttaccttagagcaaacaagttagaaatcaagaaggaaaaaaaaaaagccaccttaacatggctatcatttcatttttggctgtctaatctttaggtcatagagagagtggggcagagcttgccaaggttgcaggttcagacatagagagagtggggcagagcttgccaaggttgtaggttcagaaatgacttagcatttaccccccagtcaacagaaggcaatgaattccagtcaccatttctctgtacaattcctcagtggactacaaagagccaactcacttgaaggaaatgctaaaaacagaataaaagagtagtcaccttcaattgctcttagttttctctttctgtcctacttgattggtatttcctgcattacctatgactgctttctttcctcatggaagggtacttattagaataagattatatctgtaataaaaagaatagttcaaaatatctaaatgttcagatagtccgtgtagactggttataaacagatctgtaaaaaatgactaaattatatattcttattgattgaactagtatgtattaagtcctagaaaggagaaaagaaataaaagtattcatagttcttgaccataaggaacatacaattggattaaaaatagaatgggctgggcgtggtggcttacacctgtaatcccagcactttgggaggccgaggtggatggatcacatgaggtcaggagtttgagaccagcctggccaacatggcaaaaccctgtctctactaaaaatacaaaaattagccaggcatggtggcatgtgcctgtaatcccagctacttgggaggctgaggtgggagaatcacttgaacccaggaggcagaggttgcagtgagccgagatcatgccactgcactccagcctgggcacgagagcgagactctgtctcaaaatacataagcagagagagagagagacagaaaataaaaatagaatgaaagtgtttgaaaaaattaaaaaatcatgcaaaatacaaaccagtttgaatgaaaaaaaggaaagaccaggacattctatgattagctgccagattaatgatagaggcaacagaatgtcctagggatttggagagggagatgatcatgttagaatcatgggtcaacaactgctgtagagcaatggaattgactttattgatttttaaagaaatggctaaattcaggtaagtagatgaagggcagaaggggagccacatggtgggaaaatgcagggcttactggggacagcaagtaagccagattggggcaacagagtttggtcaggaagggagtggatggttagcatggtacggcaggccagggccttatggggaatgcctggacagctgtgctcaggagtctcaacattcccactgaatgctcaacatgctcggtctttatcaagggctttccatttacactgtcatgcttcaatctctcagtaaccccgggaactgggactttggatcaggagggtcagtgagttgaagagacttgctcgttagtgaaagagccaaaattcaacctcagactctatggctcacaaagtcagtgctcttgctggtggggacatgggaatttcttgagtaagggagtgaaataaaaaatttagtattccaggaagtatactctagccagctggtactgagggactgcattaaacaaaacaagtcagaagtagttccactgaaagtttcaaaatgtaagggagattgacttgttcatgtaagacatcaacagagctagactgatactagcataccaaaaccaactaatcaatagcttggtcatgctactctctctgtgttggtctcattctctcctactgcatgtttcatgtctccccgcaacatggtggatgtggggctgggggtaggcagagaagaaagtaattatcttagccacagcagaaaaagagacaacccctattacaacatcttcatataaaacctcagtaaaggactctgctagggcatcgctgtggcccggaggtagagtactgacagtgacagcacaactgaattaaaaagttgtggagggagttgcagactaaaagaatatagaatgctcttctcaggagacattgaaagaacggatggaaagacaacagttattcactataaccagtatgcactgaagttacactgaattaccaaggtaggataaattcttccacggttgaagaccataaacatgacatggatcatgcatttaattatgttatcctgagttaattcgttatcacataacggagtttgcatttttattcacagacatgttaaagttatatgagcattgcgtgtcattctaatggtatgatgatttccaaatttaccctatatctttctctactggttcacatgtcttgtttttagaaattactttaggaaagatgatttcagttttgtctccctttgtttcatttctgtttttgttttgaaagggggtaaagttatgttgcccaggctagagtgcagtagctattcacaggagtaatccccctgctgttgagcacagaagttttaacttgctctatttccaacctgggccagttcccctctccttaggcaacctggtggtcgcccctcctaggaggttaccatactgatgccacttagtgtttgatgcaaacacccaatgtgcatgatgcactacagcccagaactcctgggctcaaggaatcctcctgcttcagcctccagagtagctggactattggtgcatgccacctcacttggcttatttgtttttaaaatatgctactttcatactcaattacctttcatcaaaattttgtatatttataaattatatatatataaattatatatatatatatttttttttttttgagatggggtctcactctgttgcctaggctagaatgcaatggcacgatctcagctcactgcaacctccgcctcctgggttcaagcgattctcctgcctaggcttcccaagtagttgggatttacaggcacctgccaccacacctggctaattttttacttttagtagagacgaggtttcaccatgttggccaggctggtctcgaactcctgacctcaagtgatctgcccacctcaacctcccaaaagtgctgggattacaggtgtgagccactgggcccagccaaaattctatatttcatgatactatatatttctttttctcagccttccccaaaggaaccatttgcctattaccaggttgactatgctataggaaaaaaaaaaaaaacaacagtccgacatttggggattactggccctgaactgacacattccaagagatccaaaacatcactgtggcccaccagtcagagcaggagttagtggaggtcaggtgatcaaggagttttacctcaggtcagtcccatagtgggtacagtgggtccctgaacccatcctgtggttatttcctcagttccaaaatgtataattggaaaaaaactactgagcaactggcagaatccctgcattggtggggaatatagaatctttcttactttagaatcttctctaccttccattctgggtagtaaaacaaatatctagtgtgctcagaattagtactttgatttcaaaagtaactgcctataatgtctacgtgtatacctaagatatggacatagagaagcaaatattataatgcctcttaaattacttattttttgttttaaagacaggatcttgctctgtcacccaggctggagtgcagtggcatgatcatagctcaacacagcttcaaaatctgtgactcaggcaatctttccaccctagcctcccagtaagtccctcagctgggactgcaggcatgagccaccatgcccagcactatacataggtatcttaaatccatattatctacatttatcttaaatatacatcttaaaggatatatcctatggtttggaggtatcaagaaagtaaatatccaatttttcctaaacttattttataagcaactggaagccaatccaattaaattaatcaatgataggcaaaccatttggtgacacagaggttttgttgttgttgttgttgtttgagatagggtctcaccctgtcacccaggctggagtgcagtgacacaatctcggctcactacaacctctgcctcccagactcaggcaatcctcctaccaccaccacgcctcactaattgttctgattttttttttgtagagatggggtttcgccatgttgcccaggctggtctcaagctcctgaactcaagtgatcttcccacctaagcctcccaaagtgctgggattacaggcatgagccacgactcccagcctgaaatatagattttaatcttcagcttgcattttgttctaaacaacttgttttcaataagaacgggcagacaagtttaagccaccatttgttggagcagatcatttattggtgtgttcagatggtactgtactagccttcctcttcccctccatcctcctagccatgtgcagggaattttctctttttgttggttaacactcttcctcatctggattgccttcaactatgtgacaacgaagaattcaagcaccaaaatagcagcagctacatatcctttgcatgacagtgtaatttcttctgccttaaggctgtgtctagcactgaaatcatagtctgtttacttcgatctggtgctacattacaatgggagggatttaactcttacttataaacacacaagggaattatttctcagctctgtttagattagaattagagatgaaattgtgcagttcttgttgctgctgagccaatcaccccattgagcaaaaacttaccttcctactttactagacaagcaagaatactgtgctgtcttttaaaatgttctgcaatataactattagaaccaatacagaaaatttttggtggctagtgagtataggcaattaatcttgaaagtttcccacttgacttgaatgtttgactttctcttcagatgctttctgctggggaaggagcacttctgaattaaagaattttgcaaaagaaaatgtggccagggatattatgtgcgtgtgtctaaaactggggattatcagtacatgctaagtgaatatgaggctttataaaccaatattttaaaatttcatgatcagaaaaagtaatctttaacaccattctcttacccgtgatcgcttagtaatcttcgtgtctatgaaattctacctctgaaatatctcttcagctgttcccttctctctattcccaattttatcttttagatcctattgtctcatctgaatttttagaagagcctactaatttaatcttctgcttctgatcctttccctatgttaactttctaaattatgaatataatgtcacaatttggctcaaatgtgattttaaactataaagtaatttaaactgtaagtcatataactagtttgatgataccgtaaaggtagatataagatattaatactactactcagagacccatgaatgtatctcagtgcctggcacagaataggcacttgataaatatttgcttaatgattagtaagctttccatcgttgggcttatgagaagccaacatttattgagcatctcctttgtggcacatgcgtcaagtctccagcacttgcttgatctttagctaacactgttgttttaatgattttctcacaaagaaacagatagggtaggtattagtctcattttaagtatgaagaaactgaggtcttaagagtatataactttctcaaagtcgcaagactaataagtaccaaggctggagtttgaagttaagtctgaattcttaatcgaccctcacacttacaacatgcagctgaaactttttcttcctgttcctttgctttaatagtttaacatactatttgatacatacaaaagaatacatgtaacaaatataaattgcagagcctaaaaataaatagtaagtatcttagtttttaaaagtgagcaaaagataaatgacaagtcaccaaacagacaagtaagcaagtaaatgatgctcaacgtcatctgacattagggaattacaaatttagacaaagaataccactacacgtttgctaaaatagctaaaattcaaaacagtaccaccaacaactgttgggtgcaaagcaaatggaattctcattcattgatggtgagaaaatggtacaaccacattggaagacagtttggcagtttcttacaaatacgacccaacaatcacgctactaggtatttactcaattgattttaaaacttacgttcacacaaagcctatatgcaaatgtttgtagcaaccttatgtatagctacaaaaaactagaagcaatcaagatgtcttccaatagaagaatcgactacacaaactgcagtatagctatacaatggaatattattcattgataaaaagaatgagctatcaaaccacaaaaaagatgaattttgaatgtatattgctaagtaaaagaagccagtctcaaaaagctatataaggtatgattccaattatatgacattctagaaaaagcaaaaatatagcagtcaaggtctgtggatgccatgggttcagagtgggagagacaaatatgtaaaacataggggattttttttatggaggtgaaactattatgtatggtactctaaaagtagatgtaagacattaagtatttgccaaaacccaaagaactttatagcacaacgaataaatctcaatgtatgcaaattaaaaaaaattaactagaaagtcggggaagcctagcatgaaatgcaatctaaatatattataaataatctaaacatattacattgcatacaacaacttcccagaaaagtattggggtataaagtgcagaactaagtaactcttgaagaaagggaagtctgtaagactaaaggtaaaggaaactgtacgtaagaattgtctcccacaggggtatggattaattttgaaaccattatatatgtatactaaaattaaacaattgagtaaatggatggtggatagcgtgagccagatttctcactgttttactgagagattacagataagcaagggtaaaaacgctagaatgatccttatgggaatgaattagagctgaagacctcagtatgaactcatatttagtttaatatacagaggattacatataaaaatgtttttatatgtatatacatgggccagcacacacacacacacatgcacacgtgcacacacagagttcgctctatcagctgaggtctagaagcaataataccccagtggcacacagggcacgcagatcttggtttctgattccattttccaatgaccagggcttcttcaacaaaaggctgatcctgtctgcggcaagaaatacccaagatgagtgtggagcctcttacagtgccagagttaggaagtgccaaaagaaaaaaaatcacctaaaaccccacaacgatgaggctatgtcaaagggacgtaggagctaattaaaagaacatcctatgccaaaaatggaacaatttaagcaacaaaataacagagtattgaattataatccaaagtatgaaccaggcttgatggcacacacctgtaatcctagctacttggtaggctgaggcagaaggatccctggggcccgggaggatccctggagactaggagcaatatggcaaaactgcatctccaaaaacaacaacaacaacaaacaacaacaaaacaaacaaaaaacaaagtataaaataaatatccatgagtctctactgacataagtaaataattgaataaatcaacaaataaatggggtagaagagataaacctactatgtagaaaaattccaaataattccaaataatttgtgtaggtattctatccaaaagaaagtaaagcataactactctctaagtatggctctctaagtatgacctgtttccaaacagtagagtatgaaaaaagaaaaaaaataaaaataaaaaagagtggctctagagtggaaaaagtggagaaacctgacaaacactacctcaagcaggtgataaaagtttatatcaacagtgataagtcacattgacagtgtttacccttgatatgatgtgatgtggcactgtacctctgggatcttccttctaagtgtaatcatgagaaaaacatcagacaaattcctattgagaggcgctctataaaatacctgaccagtacacctcaaaactgtcaaggtcgtcaaagacaaggaaagtctaagaagctgtcacagctaagtggggcctaaggagatgtgaaaactaagtgtaatgtggtgtcctgtatgggatcctggaacagagaaaagcatacataaaaactaaggaaatctgaataccatatcaactttagttataagcaatgtatcagtattggttcattaactgtaataaatgtccccctactcttaacagaggaaaatgggtatgggatacacaaaacactatgtactatctttgtaataattctgtatatctaaagtcattctaaaatagagtttatttaataataaataactagctatgaatgtaccacccaatcagaaactagaatattatctgtaacctacagccatcctctgtgctccatctctccccttacttccggtacctcgcccccacctaaataaatcactatcctgaatgttgtatttaatatctttcctcgttttagcacagtcttattacacatgtatgcatatatacctttaaagagtttgcttatttttgagctttataaaaatggcactgtactatcttctgagacttgcaccagtggattatgtataagaaaatttattgtggcactctttctgaaagaaaaatctggaaacaaagcaaatgtcccaaataaataaacagtggtatagcttgcacaatgaaatattacacaaaagtgaaaaatataaactacattcaacaatgtggatgagctttagagaaacaatactagagctgggcgctgtggctcatgcctgtaatcccagcactttgggaggccgaggcgggcggaccacaaggtcaggagatcaagaccatcctggctaacacggtgaaaccccgtctctactaaaaacacaaaaaattagccgggcgtggcagcgtgcgcctgtagtcccagctacttgggaagctgaggcaggaggatggcgtgaacccagaaggcggagcttgcagtgagccaagatcgcgccactgcactccagcctgggttacagagagagactccgtctcaaaaaaataaaagaatactagatgagaaaaggtaaaggtgttaatctgaagcagaaggccctttgtcaaatggccacaacctacctcatctatctcacttcaccgaatctatttccagtcacaccaaacttctccatgcgacctaaacattccacactcttggacacccacttagcttttatttttttaaaaaggcatgttgtgatacaattcacataccacacaatttatgcacttaaagaacacagttcagtggcttttagtacatacagagttttgcgaccatcaccgtaatcaattttagaatatttttatcacactacaaagaaacatcatactcattggcagtcaaatcccatttcttgccaatccctacactctccctggccctaggcaaccaccaatttactttttgtgtctatggattttccttttctgcacatttcatctacagtaaacggcatagtatgacatgtggccttttgtaaatgactttcttcacttagcataatgtttccaaggttcatccatgttgtaacatgtattagttgcatcatcattccttttttttttttttttttttttttttgagatagattcttgctctgtcgcccaggctggagtgctgtggcgtgatcttggctcactgcaacctccatctcccgggttcaagcgattctcctgcctcagcctcccaagtagctgggattacaggcatatgtcaacaagtccagctaatttttgtatttttagtagagacgaggtttcaccatgttggctaggctggtctcaaactcctgaactcaggtgatccacccgtctcggcctcccaaagtgctgggattataggcgtgagccactgcacctggcctatcattcctttctattgccaaataatatgccattgtatgattatactcacttgcctttgtacatccagtttcttctgtcattgctctctgcttgtcaagttcctatttacccttcaatgcccagatcagagattacttccctaactcccatggcattccactgaaatattattacacttgtcacattgtattataattatcatgtgtatttctcctcctccacccactagtgaactgtgggctccccagacgcggggacaaagctttgtgcatctttgggttcatggcagttaccagaatttgaccaactatatctactcaacaaatgtttattgaattattgaatgagtaagttttcccacatttgtcaattttacatttattatacaaaaggagtatgcatactgtagaaagtgtgtgcaacaatgcagggttactatggtctcaaatctgggttcacatacgagttctgcttttgataactcaatggtcttgggcaagttgcttaatcagtctaagttccatctgaaacatggggataatatcacactcatatggttactgaatttaataagttatgtttttaaagagtttaacccaatagtggtagccattattatgaccaataataaaagccactaacagaagggtcggggaaggggcggggacctttaagcagtctgattcaggccaggtgcagtggctcgcacctgtaatcccagcactttgggaggctgaggtgagcggatcacctgaggtcaggagttcgaaacagcctggccaacacggtgaaaccttgtctttactaaaaataaaaaatcagctgggcatgctggcgtgcccctgtagtcccagctactcgggaggctgaggcaggagaattgcttgaacccaagaggcagaggctgcagtgagccaacattgcgccactgcactccagcctgggtaacagagtaaaactgtctaaaaaaaaaaaaaaaaaagtctgattcaaattcttcattttacaaataaagaaactgacacctcgtggggttggggggatgccagaggccactaaaggagggagcatggtgtgatggaataatcacatactatgaggcacgacatagctgatttttgaatcctagctctgtcttttactaactgcttatctttgggcaaatcgttgttttccaaacatcaattccctcctgagtatacgggggagcacaaatacctagctcacagatcagctttgtgaattaaatgagaaactactcatgtagtaggtttgtgtcatgaacacaaacatatacacatgtgcacatacatgaacatacacatacgaacatagaataatgcaataacaaataaattggaagaaagaaaagttttagaaagaaaaatgtatagtctaataaaaaaaaaagaggatagaaatcaccttaaaaggaagattaaattttgggaaaagtgatttatagtcagcctgcaataggaacagcatcttataaatatcagtgggtacaataatgtaggatatttaggaataaaagatgtttataaaattaatcattgttcatcttgccctctctccaaactggcttattttaaactttctagtattttctgtctgatattcctggagcagagctgaagaaaataaatgttctttctgaagcctctaaaaatagtccatcaacatgattttcctccaaaaatgaaaaccataagactggtaacatatttaaaggtgatggggcaggttttaacacacaactgtgccactgtttaaaaagtaccatcatgttcttttccttaggaagtgtttgtccattcactaaacattataaatgaagtagtagcatactcaaattgcaataacccacagaaattgtatagcaccatttaaagcatactattgatggggcataagtggctcatgcctgtaatgtcagcagtttgggaaactgagatgggaggatcgtttgagcccaagagcagtctgggcaacatagtgagacctagtctctacaaaaaaatatttaaaaattagctaggcatggtggcatgcacctggagctacctccagctactctggaggctgagatgggaggatggcctgagtctgggaggttgaggctgcagggagccatggttgcacctctcgacttcactccagactgggcaacagagtgagactctgaccctgcctaatgaataaagtaaaacacagtatgagcccacaaataatcccaataatttgataatatatgaagatctcaagaaactgtgaagaatacacagtggtattttatctctgtctccactaatttactggtgcctttatttatttatttatttatttatttattttttttgacaaagtctcgctcttgttccccaggctggaatgcaacagcgcgatctcggctcactgcaacctccgcctccgaggttcaagtgattcccctgcctcagcctcccgagtagctgggattataggagcctgccaccatgctcagttaatttttgtatttttagtagagatggggtttcaccatgttgcccgggctggtctcgaattcctgacctcaggtgatctgcccgcctcggcctcccaaagtgctgggattacaggtgtgagccaccgtgccttgccaattctgattttttaaaagatccctcacacttcattttttcctacaactttgtagcttggctgttttacatgaattaagtattaaataaacaagtatttgttgaatcttactttatacccgccattgttctggcaactgggaccaaaataaatggagatcctcctctccaggagcttgggttctcatgcagtgtgataaacagcaacaaacaaatgaatatgtaatatgtgagaaggaaatacgtgctatgaagaaagtcttgaagacagcaagggagtgagctctggggaaatctgggcagagggaaaagcacaaaagctccaaggtaagattacccgtgtcaggttcaaggagcagaagcgggacagtgtggctggagctgagggagcaacagggagagagctgggagatgaagtccaggaagtggtggaatccagatcagatagagcttttgcttttccccatgggagccacaggagagtcttgaacagaggagtgatatcatctaactacagtttcaaggctccctcgggttaccatgagagaatagcacatagaggagcaaggcgggaggagggagaactttcgagaccattgctgttgcacatcaggagtgatgatggaagcactggggctggtgagacgtcattaggttctgaatatattttgaaaggataattttaattgcacaaccttgttccatttgtcacaacatgttccctttttaaactgcagtctaaaagccaccttctccaagaaaggctttaaataaccttatggtctccaagccacttatataaaccctcctatttttccttaatctgtacccgcaaattgctttttttcttctatagactaaaggtcattgctgtcttagcctaatagaaacacaggaattaagtcagccaagtgatataacatggctacttcctaagaaatgacagtggagcaggcttaaaaggctcatcagtctagaacactcttgtctgattagggcctccgttccgacagcatcttcactgtgaagtgagacgaccttgagaatacaaagtgatcaaccagaactcatcttgtgggtcctctggtgtttttccgatttttaattcaacatagtgcacggacttcgatgttcaagtgacagcttaaccagttgtatttaaataatggcatgagcctgttcatcacttggttagaagaccaggatgcactggtattatagcatttatgcaaaaaccacagagacagaaaacagtatttgagaaaatgtgagaaagaatacagaaaggtctggaaagatatacactaaagtttcaatggttacctctaccaagtgacagttggaaccaggatgagaaagcaggatgattaaaggacactttgcttgatagtaatgtacaacctacttttgagaataaattattcttattgtgtagttaactttttaaagggtccattttagttatttggctccttcagcactattgaggcagatggaattccataatgtgtataaaaaacagttttatggaacattaatgcttgtatttcatattctacttataaccaaatattagaaatagttgaaaagttcctttccaagctgatatttagattcatgaaaggaacactggacccttggtgataatgaatataaattttcttaataactgataccctctatcatgttctatactgatacggtttggctgtgtccccacccaaatctcatcctgaattccagtggaaggtgactgaattatggggactggtcttttctgtgctgttctcatgatagtgaatgagtctcatgagatctgatgactaaaaaaaaaaaaaaaaaaaaaaaccccgggtgcggtgtctcacacctgtaatcccagcactttgggaggctgaggtgggtggatcatgaggtcaggagttcaagaccagcctggccaacatggtgaaaccctgtgtctactatacaaaaattagatgggcatggtggtgcattcctgtaatccccgctactcaggaggctgaggcaggagaattgcttgaagcgggacccaggaggtggaggttgcagtgagcccagatcctgccactgcgcagcagcctgggctacagagcgagacactgtatcaaaacaaacaaacaaaaaacaaataaaaaaacatgggagtttcccaagggagtttccctggacaaactctttttgcctgctgccatccacgtaagatgtgacttgctcccccttgccttccaccatgattgtgaggcctccccagccatgtggaactgtaagtccaattaaacctctttttctacccagtctcaggtgtgtctttatcagcagagtgaaaatggactaataatacagtacattggtaccagtagagttgggcattgctgaaaagatacctgaaaatgtggaaggtgactcttgttatgttttagcaaagagactggcagcattttgcttctgccctagagatttgtggaactttgaacttgagagagatgatttagggtatttggcagaagaaatttctgagcagcaaagcattcaagaggagacttggatgctgttaaaagcattcagttttaaaagggaaacagcataaaagtttgaaaaatttgcagcctgacagtgcgatagaaaagaaaatcccattttctgaggagaaattcaagccagctgcagaaatttacataagtaatgaggagccaaatgttaatccccaagacaatgggaaaaatgtccccagggcatgtcagaggtcttcatgatagcccctcttatcacaggcccagaggtctaggaagaaaaagtggtttcgtgggccaggcccagggtcctccagctgtgtgcagcctagggacttggtgccctgtgtcccagccactccagctgttgcagaaaagggccaacatagatctcaggccgtggcttcagatggtgcaggccccaagccttcacagcttccatgtggtgttgagcttgaggctgcatagaagtcaagaattgaagtttggggctggacatggtggctcacacctgtaatcccagcactttgggaagctgaggtgggtggatcacctgaggtcaggagttcgagaccagcctgactaccatagtgaaaccccatcactactaaaaaatacaaaactacctgggcatggtggtgtatgcctgtaatcccagctacttgagaggctgaggcaggagaatcgcttgaacccgggaggtggaggttgcagtgaactccactgaactctagcctgggcaacaagagcgaaactccactcaaaaaaataaaaagtaaaataaaataaaagaattgacatttgggaacctccacctagatttgagaggatgtatggaaatgcctgaatgcccagatagaagtttgctacaggggcagggctctcatggagaacctctgctagggcagtgcagaagggaaatgtgggcttggagtccccacacagagtccctactagggcaccgcctagtggagctatgagaaaagggccaccatcctcctgaccctagaatggcagatcctctgacagctcacaccttgcacccggataagccacagacactcaatgccagcccacgaaagcagccaggagggaggctgtaccctgcaaagccacaggggcagagctgcccaagactatgggaacctacttgttgcatctgtgcgacctggatatgacacatggactcaaaggaaataattttggagctttaagatttgactgccccactggatttcggacttacaaggggcctgtagcccttttgttttggtcaatttctcccatttggaatggttgtatttacccaatgcctgtacccgcattgtacgtaggaagtaactaacttgcttttgattttacaggctcataggtggaaggggtttgccttgtctcaaatgaggctttggacagtggacttttgagttaatgctgaaatgagttaagactttggaggactgttgggaaggcatgacttgttttgaaatgtgaggacatgaaatttgggaggggccagcggcagaacgatatggtttggctgtgtccccacccaaatctcatgttgaattcccatgtgttgtgggagagacccggtgggaggcgattgaattatgaaggccagtctttcctgcgctgttcttgtgatagtgaatgagactcacgagatttggtggttaaggaaaaaaaaaaaaaaaacaacagaagcttccttgcacaaactctctttttgcctgctgccatccacataagatgtgatttactcctccttgccttctgccatgattgtaaggcctccccagccatgtggaactgtaagtctaattaatcttctttcttttataaattgcccagtctcagggatgtctttatcagcagtatgaaaatggactaatacatataccataagaaaatctggcaagaaagctaaaagttaacaggagaggttaacagaaaacatgagctgagcccaggaatgaaaaaatggggaatggcattcctcatcaggaagcccacaaaaagaaacagcaaggaaataaaatggctagtggaggatgtgaattttagcagatgctaaagatagagagatccaggacttgtagaatcatagtttcaagaagtagttcctctggagtttcttgttttcttcttttatatttaaattccccattgtgcaatctaatttccttagctctcacaataatgctttcacagtagaatcattctacataacttcaaaaagaaattcttcatacatgaggcataggatgtcaggaagagagaggggggaaaaacccctaaacaatgggtaacagttgataataaatcccatacaaggcaaggcatcacaaggatgcagcgtgtcttccgagtacaactggcttatgccttgacagactatgggctggtgacaagttgagggatctgtggcttgatagacgtttcctaggaaatgaggattctgcagttggttttcactgtgctgccaaactgttctgggaaaaacagatttagagaaaccaatgaacttctttatctccatgcttccctgtgtccaccagagccacactcattctgtaatccctgagtccagcttgtgggcagacacaaagcagcatgcttacctgatatagtaagatgagcagtaaacccaaagatttaaatgaggtacagctttctcacacagcacaatggtacactgatggcacagcacctgaatttaattgcttctactactttgactttggtgttgaggagcatggatatgtatgacaaactcctaattcaacactgtgaactcatttcttgttattatgtttcacttgaaactgtctaaatgagttagaataactcattatttttttcacccaaagggtttgcctgctacatcttgtttttatctcaattaattttgtgtctgctggactaacacaaattaccacttccatgtcttgcacttttgatgtaaaaataaagctaatttgggaggtgtttaaagctttattaatatgtatatggccattagcagcgcctatgatgttagcaagcttctttctaaaacttagaaattctccttctgattctgagctgcagcattcccactctgaccacatcatttttagcatttttcttagggcacaaagaggaatttcacacagggtcatagaaaagttggtttgagttttcctaccatttatcttacccattctgctcagtgagtcagacttacataatacatttctttctctgattttcttcagaaatccagaggcagcactttctcccacggaagtgcatggctgctgtgtaacaaccaagcactattccgcctctgtttccccttctccagcctgaacttagactgggcaagtaaaaaaagagtcacgagtattctaatgtgataccgaaatacagatgatgagattctctcttaaaaggaagaaaggatgcaaaggacaagatccatactaaataatgtggcctatgactccctctgcactccccctgtaagttcccccagccttaaacaaaaaagcccaccagtgctttcagcatagtagggcagctaaagaagaccaaagaggaaatgtgaccatcaattgggaataataggtcctgaggctaaccacatataacaatggaacaagtaaaagtaattgaattgtgcttagagaaatgaggattgagaaaaaggcagcattgcatcagtctttgagagtatgaagctatacagccagttttcctgaatacttctcccaagtcttccattttctggatgtgtgacctcaggcatgtgatttgaccactctgtgccttaatttcttcatttggaaggtagggataatatttgcactgttctccctgaggttttatgagcactaaaaatctagtgagtaaaaaaaaaaaaacatttacttagaatagtgcctggcacatattaagtatagtcgatcctcaggtaacaggggtttgaactgtctgagtcaacttatatgcagataaaaaaatacagtattagtgggttacaaaacccacatttatggatagccaactttttgtatacttgagttccacaggaataagcatgtgtagatttggaatggggtgggggtagtcccagaaccaatgctctgagtatacccagggtcaactctactccataaacatttgttgaatggaagggtttggacaaactaagtcaaacattaaactgaatagcaagtaagatataatgtacattaaaatgacaggatctgtaagctatttctagctacagccacagaattaaataaatttgagaagtaaaatgcaaaataaaagagttttaatagttttctgctattaaaaaagagaaggttaagattaattaaaactaatctttaaagtaggtattcccaccatgtttagtaataatttgtcattaatgcatatatattaatctggcatctttcacatattgcttagagctatgctagcaaatataatagccactagctacatcaggctattgacagcttaaaatgtggctggtccaaactgagatgtcctggctgggcgcagtggctaatgcctgtaatcccagcactttgggaggctgaggcgggcggatcacctcaggtcaggagttcgagaccaggctggccaacatagcgaaaccctgtctctactaaaaatacaaaaattagccaggtgtggtggcatgcacctgtagtcccagctactccggaggctgaggcaggagaatcacttgaacccaggaggtggggtggttgcagtgagccgagatcacgccactgcactgcaacctgggcaacagagagagactgtctcaaaaacaaacaagcaaacaaacaaacaaaacaaccaaaaaacaacaactacaaaaaacaaattgagatgtgctatatgcataaaatgtacattacatttcaaagacctagtatgagaaaaataatgtaaaacctctcattaataattttcagtactgattacatacaaatgttatgagttaaataaaatgcaatgttaatcataatttcacttattctatttattttaacacagctattagaaaatttagattacatacatggctcacatttgtggtctgcattacatttggatcaataaggaatataaaccgcactattattaccactacttcaaactaacagttattgagttcttactctgctagatgttttaaatacattatttctagcatcacaatacctctgtattttctctccttttataagataagatgttctcagagtatatattgccccaaatcacaaagctactagtgtcaggggaggaatgaatccacatctgtctgagtgcaaagcctggtgctttctcctatactagagaccacatggaactagaaaggcctaagcccccatttgccaacagaaaaggtaggaaaagaattcacgagcgacatagtgcatatatgaaaagcaaaaatgtaaactagaaaaagtatactcataaggaggccatttgccatgttttcataaaaaattcaatagagaattaatataaaagtgctaaatctgatacctagttaacagcagaaaatgcttagatgttatatagcatgaacaatcagaatacaacactatccatacacttactacagctctgtaaaaggatctatatatcatgaaagaagactgacagggacattcaaaattgataatatctttgaataaaggcaactcaaaaatgagcaggtggggtggggactttgatcctcaggggacatttggtaacattgggagatacttttgatggtcacaactcaggaggtactactggcatctagtggactgaggccagggatgcttctaaacatcctacaacgcataaaactacttcccaacctgctgagattaagaaatcttataatagggtaatggtgttacaaatttcctcctctactttccacattcgataatgttaaattgtcttactatacaagaaactaaattaaaaaatataaaaaaattattactaaaaaagtaacagaaactaaagcataatcgccaacatagaaggttattttatatatgggggtaggtgctgggtaatacaagagggtcccttaatatagtagcaaattccttctaagtacttcttagattcactaaaaacgacatctgaaaaggatatatgcaattatacatagattaaaatttggccgtgtttcctcaatcactacttgccattggaatgactgattcaacatctaacaggaaattggcactcctttcactgttgggatagcatttgctaaacatcaaaatattttttctcactcctttgagcaagtagtgcttcacacgggtgttattattactgagattgacaatatatgctgctatttacactgcatttaggaagagatgggaagagagatttttctgacaatttttttcagtatctgcatcattatgataaaaaacagaagcttaaaacttacacttgtataaattctgtgtaaaaactactcattttgtgagcttaactatttgtactaacagattacctgattaaagatttcacaagagtaagtatatatgccatgcttgcaggcatgaaagaaaggaaatctgaaagctgtgtatatactcatctttttcttcatttattcagttacatcaaaaaggggatttcagaataaaaatatgtacaggaagaacctatttaaataggtttattgatgctataaggaaggcctaatcacagtctatgaaatgcttgtgctacatcatttgaccagagaaaacgcaagtgctcttttactgaatatagccagagcaatgaacaatttagttttttcctctcagcatgaaccatcgtcttggtaatctccagtaaacagcacattgcctggcacgtagtgagcactcaataaatgttaggtgaatgaatgaacatttataaaatcataccatgtgctatccagagttgtgccaaatctcttgacaagaagtcatatttcagttccctttctcctaagtttcactcacacattcattcactcaccaaaaacttactactcacctgtaagtttttatagcatgtcacacacaccacctttatgatacttatcactgctgttttaattatttgtttgtaggtctatctctcccactaaagtgtcagcacttcaaagacagagaccatgtcttgacactttgttctctgatttaatcttcaataaagagctggaggataagaaaataatggttccaagaacttgcctacagtctcataatttaaaagtcgtagagccatgatttgaactgaggatggctcactccaaactatcttcttcccattttaacagactatagagaaaatgagagtgaaggcagagtgtggaatgagaagactgtgaattaagacaaaacaaagcagaacaaagaagttttagaagctaagtaagacccaatcagtgggttctattgcaccagcaccaaggaacagaaagcacaattcaagaaactgatatggacaactgcagagacctcagaaatagtctctagaaagtcaacgtatccaacatttatggaaaatcgaccacaaccatttggaccaatctaggtgaactttttgagggggaagaactgaatctcttttctgtttctttatctctaacttataatttgttggaagaatgaaagactgtatgacataaccctagtgaaagagatcccagtcctgtagagtgaccaacagataaaagaggtgagataaatcctattaataggcagcaaattgtcagactggagaattagccaaaacaaagcagacaagagattctgcagtaaatttatcctaattggaattttccaagtacaaaaaattgaaatgcttatcagggtcatgccatctcaatgtaatgataccctgaacaggctcttagtaagtacaatatgttaatattggttttatttgttgaagaccaaatggcagcgtaattaggaaaatgagttctggagctcacttcactgcttgacttcttagctcagctctgccatttcctagctacctgactttaggtaacttaataatgccagttgagagctatgcaaagcagaatagtacctaatacgatacacatgcttaacaaatgtttgctgttaattgtattgtcattttcaaaatgttatattaacatataaatttttaaagaatcatgggacttcttcaatgcgacattctaaaattactgaaagtgaaaatatatttttttaaatatttggataaatccagaaatctggaacattttcattaattcaaaattaatgaagtgaagccaaacaaatatggatgatgagggtaataatgatgataatagtaataattcttctaaaacataattgtatgtactatggtttgaatctttgtcccctccaaaactcatgttaaaacttaatcctggctgggctcagtggctcacgcctataatcctagcactttggcaggccaaggagggtggatcacctcaggtcaggagttggagaccagcctggccaacatggcgaaaccccgtctctactaaaaatacaaaaattagctgggagtgatggcgagtgtctgtagtcccagctactcgggaggcttaggcaggagaatcacttgaacctgggaggtggaggttgcagtgagtccagatcacgccagcctgggtgacaacagcaaaacgtctcaaaaaaaaaaaaaaaaaaaaaaaaaaccacgaaaaaaccaaaacttaatcccaaatataacagcattaaaagatagggaagacttttttttattttttattttttctgagacggagtttcactcagtcacccacgctggagtacagtggcgcaatctcggctcactgcaacctctgcctcctggattcaagcaattctcctgcctcctggattcaagcaattctcctgcctccgtctcccgagtagctgaaattacaggcattcaccaccacatctagctaattttttgtacttttagtggagacagggtttcaccaccttggccaggctgttctcgaaatcctgacctcaagagatccacccacctcggcctcccaaagtgctgggattacaggcgtgagccaccacacctggctggagggcttttaagaggtgtttggtcatgaagggttttgcccttatgaatggagtagcccattcatagattaatggattatcatgggagtggtttagttatcaagggaaggggtctgttataaaagttggtttgggccaggtgcggtggctcacgccagtaatcccagcactttgggaggccgaggcgggtggatcacctgaagtcaggagatcaagaccatcctggctaacacggtgaaaccccatctctactaaaaatacaaaaaattagccgggcgtggtgccgggcgcctgtagtcccagctacttgggaggctgaggcaggagaatggtgtgaacctggaaggtggagcttgcagtgagccgagatcgcgccactgcaccccagcctgggcgacagagcgagactccgtctcaaaaaaaaaaaagttggtttggctctcagttcagcccccttgccatgtgatgccctgggtcacctcgggactctgtaaagagtccccaccagcaaaaggccctcaccagatgtggctcctccaccttgggcttcccagcctccaggactataagaaatacatttcttggttgggtctggtgcctcatacctgtaattccagcactttgggaggctgaggtgggtagatcacctgaggtcaggagatcaacaccagcctggccaacatggtgaaaccctgtatatactaaaaatacaaaaaaatattggctgagtgtggtggcgagcacctgtagtcccagctacttgggaggctgaggtacgagaatcacatgaacccaggaggtggaggttgcagtgagcctagatcacagagccactgcaatctagcttgggtgacagattgagactttgtctcaaaggaaaaaaaaagaaaaagaaatacatttcttttcttggccaggtgcaatggctcatgtctgtaatcccagcgctttgggaggccaaagagggaggatctcctgagctcaggaattcgagaccagcctgggcaacatggtgaaattctgtctctatgaaaaaacacaaaaattagccaggggtggtggcacatgcctgcagtccctgctacttgggaggctgaggtgcaaggatctcttgaggcagggaggtcagggctgcagtgagccatgttcgtgccgctgcactctagcctagatgacaacgtgagaccctgtctcaaaaaaaaaaaaagaaatacatttcttttgtttataaattacccagtctcaggtattcaattatagcaacagcaagtggactaagtatgattatgtgtgcatgtctgcttaaaatggtatctttagatataccaataaataaatgtttttaattagaaaaaatgatgagaagcctgaaaatatacacattgaacatctcaaatttcaaaggagaagagcaaatcactcccataagatttcaaagtgacaggtaatcacaggcaagataaataacagttacagttcagtctaaatcagatttttttttcaagtatagatgctctctctcttccaccgcctttcccccccccccccccgcaaagccagacccaacctctgcattcaagtaggaaacctggaagtctcaaaggaatttttggtacactattgttcagaagcactttttggtacattaatgttcagaacctcctactgaactgtgtcagggaaagtggaagctgattagaaaataagagctaccggccaggcgcggtggctcacgcctgtaatcccagcactttgggaggctgaggtgggcagattacgaggtcaggagatcgagaccatcctggctaacacggtgaaaccccgtctctactaaaagatacaaaaaaattagccaggcatggtgctgggcgcctgtagtcccagctactcggaaggctgaggcagaagaattgcttgaacctgggaggtggaggttgcagtgagccaagattgcaccactgcacgccagcctggtgacagagcgagactccgtctcaaaaaaagaaaaaaaaaaaaaaaagaaaaaaaaagaaaataagagctacacattgactataataataataatgaaatagacatcccacacccacaaacctgccactgtatcactcttattgttttcaggacatttgcactgacactgggccaatttttgttttactataagaggttttaggatatgtctttaaaaatcatactgtgtacaagacaggttggttactatcagccacgatcactaacaaaacagttccccatcatcagtcctaccatctgtactcccagttctctccacacacgggcttggttgaacagattttgaactggccaaggtcactgcacagctagcctccacagatggggacagtgtgaaaaacctaattgcagctgtggataaacacaaacaaggacacacatggttggcaatacccctgtctagacttgatggtggctcagtgtcactaagcacaaaaaacaaggacatagtttcaaggtaactatctctcagcgctggtacaaatgctatcatcatgtggtctaaatgtctccgagatatttaagtatcaatttaagaaatggtaatagacaagcaatatttcctatcatacatacattctctcaaattctctagggaaaaaaatgcctttcttaaacaaaaagataaagcttgggaatcagcacagtgccataccccatgtgaatgtcacaagcattgcctgcacacaacacagaagatactgcattagggaaaaaatgaaatatcctctttccacatatttatttcatatgtatcaaaatttccttttcccactccctttccaaaacaaattacttggttagagactttactttgtttttgtttcaacaaaatttaattgggtacaccttctattctatacccctaagacactcatcaaaatagaatcacgctgaagatggtatcctagattttcccccttgaaatacatatggccctcagggaatgtggattgtcaatgtcttttctagacactcaacatgtctggtcactcaggtttaaagccaaattggttatgcattactttttgagaagttgttaaaacttaaaataagttatcaagtcagtgatatttcaaaagattgttgataaaaaagaacatataactgtaaccatactgaacagttgattatagaacgacatgtcagtgcacatatggcagtcggataaattatgcacatctggattacttttggcaagaaacatagctaagtgtctaaagccaagtttagcaatctgtcactaacaatatgtacatttattttaaaatgtcaagggctcaaagtcatattttctatttcttcataaactttccagctcttcgtaagacagcaaacaggtgacaaaacacattgcccaaactgccaaaggctgtataaataaggggtaattttgaacttctcaccacatatataagaggactcaaagtctgaaacaaactcatgtgttgtgggatgtactgacatataggtttcaagtgagattgttaccatttcacttcagaagttggttagaaaatgctttcatttaaagatatggctggcttacatggagtagtaaacaatataacactctggggaaagcaaatggaaatagtctagtggtgtctccttataaaaggaaaagaccagtgtctctgtgatcagctcagattaagtttccttttttccattgccaattactgacatcatttaagccccaaagaaatgttttcctacttctagtccccttgattaaaagaaaagccaagagacacgaaggtggctctcaaactagcagtaacaagaaactttacaatgggatgtatgggcagcagccaggtgggaatgtagcagtacctgtaagcacaaaactcctcttgactattatgctgcttcctagtttttctagcattccaagcttcttaacagcttcagtgggaatgccaagatatgtcatggagactgggtggggtcccgtcattccaggtgttgccttccagtctcatttgtgctggcagcagagaaaaaccagagtggaactattttatttacagagtgatagctgaatattcactctgtgtcagtctttcttctagctcacccatttggtaattttactgttgactagcatctttactatataccagatctggattataacatgttcaaatggtgtgggtggtgggaaatcctgtgtctctaaatcatacagattggtattcaaacaccaggtccactgcttacaaactgagcctcatctaaagaaggaggatgattatgaagcacctacttcacagtgtggctgtgagaactaaatgcctaaaacctacaatacatccaaaaatagtggctataatcatttctgttccttttctccttcttaaagtgacagactgggactaataaagtccacaaaccacagattgtcaataaaatgttgtaaatccaagagtaagctaataaacaactgagaagaaggaagaagaataaagaagataagatcctaagaggaaaagatatttaacttttaatttttatctgcttttctgcttttgtaaagtttgatgcataaagctattgaaatctatgtgagcttaagtgtctttccctgatgaaataaataaaagacaattgcctgtgttattaagaaaaggcacatgttttcagaactgtcagtttctattattcaagtcagagagattttactttaatagtattagaggcagagtgaaaaatacatctatttccttcttaattttgatattttctatttgactctgaagcttaatttttaagttatatcacattaaaaatgctcaaataaaagacacatataagaaggtaaaagagtaaaaagaattttaaattaaatgagtccatttgcccatatttcacttccccaggtctcagtggtagcaatcttcacacactattaatgttctttagtcttttactccttacactcctgaggaattttatatccccacaagacacaaaaactctagaaatataaattaagagaaacactcacagaaaaacccaaagcagatctgacagaatgattcttagtacagaatacaggaaaaaaaaaaaaaaaaaaagtcctggcctatcattatactgtattactttaaataagttaaagtctcctggcccaaagaagctattataagataatttataatttagatggttaaatgaatgttcatgatctttgccaagttcaggacaataaatatagggggttcttccaaccctaggaatctgttattgtcactagacaaacaaggtaggcttgagaaaactgatatactttccccaggtagacgtgaagcttcttcatattgaattacagaagtaaagttttagtgaatactactttacataatttttctatcacggtcatttaagattttattcacaaggcagccaaaggcgaaaagcaaaaacagaagctagaacaaaacagtctttgggttaataatatatattcctttttttttttgagataaggtctcactttgttccccaggctggagtcagtgccacgatcttggctcactgcaacctccacctcctccgcctcctgggttcaagtgattctcatgcctcagccttctgagtagctgggaccacaggtgtgcaccaccacacctggctaatttttgtatttttagtagagatggggttttggcatgttggccaggctggtctcgaactcctggcctcaggtaatctgcccaccttggcttcccaaagtgctgggattacaggtgtgggccactgcacccagtcatatagttcatgtggagttttaaaattgtagtaatttaatcttgtatttaagttatacccttaataagtaccatattaaatgtggtaaaatgaagagtacggactaggtaagaggataagatctagaattagaaagacctggatttatacactgactctgcagtttgtcttttaacccattatactaccttatatctattcataataaattatgtatctgaataagtgtgtgtgcatgtgtaaataatacatacacacgcaccacagagttggtacaacgattaaatgagtacccagcacaatgcttggcagacactcaatagcaaactaagaaatcaggataatataggccaggcgcggtggctcacggctgtaatcccagcgctttgggaggccaaggcgggtggatcacgaggtcaggagatcgagaccatcctggctaatacagtgaaaccccatctctactaaaaacatgaaaaaaaaaattagctgtgcatggtggcaggcgcctgtagttccaggtattcgggaggctgaggcaggagaatggcgtgaacccaggaggcggagcttgcagtgagctgagatcgcgccactgcactccagcctgggcgacagagcgagactccgtctcaagaaaaaaaaaaagaaaaagaaaaaaaaagagaaatcaggatagtatagcagtaatttgatgaaaaattatggattcatatcataatatacgtcaatattaaatcctttctgataaactatttgaaatagtgacaaagaacatatacaaactctttgagaaagtattcttcactgcagaattaaatcacaagtaagaatcctgtaaaaaaatcaccttctcaaggccaaaacttacatttttagctgacatctcgttacaatggtactacgttctaatagattgtggaggtatataattacaacacttaaaagatgaaactaaatgaaaaataaaattcatagtgttaatagagtccaatgtaggagtgcttttttttttaatcccccaaactatgtagaaaacatccatggaggaagacatcagcgttaattcctaaaaaggctcctgtgctcatcaagaggcctccaaccactggaccactgcagttgccacataatctgtctgaagcaaattcttcctcttagcagttgctgaaggagtggtgacttcttattagcttcccttatgagaacatcttctatgctacgcaggatgtttcaagtaaccccaaagatgtttagttgtgcttcatcatcataaatgaagacttaacagggagaaattaagagtaccgttaaatttttcttatgcctgttaacatattgtcattcatttactcaagttcttcaaactctgacctccttttggctggaatgcaacaggatgaaggatgatatcttctcaaactgtgatgtttatttaaggatatctactactcaaagaaagaaaatgaatgtggtaggaatatcatgaaaataacacggaaaacatggctccagagaagcaacgtaaaaagtgtcttaccaggcccaagtagaaaatcaccctctttagacagttcattaaacttttcagagattaatcactagagagattatagcagtggctatgaaatttatggaagcattcccccagaaaaatgaacgcagacactgagccataaatgtaaagaactcaaaaggaagcaatctaccttccaaacaagtgttgaaaaggtctgaaggaatttggttgtctatgtcagccattatacggggaaacatgatgctcactgttctaaggggaaaaatgttcaaacatgtatactaaatgttgccctggggttctcattacttaattaacatgcacacataaaatctggagtgtgtacaacaacagctagccttaataataggtaagtcgcgtcagtctctttttctaatattctattttaagttgtgaaccttaatccaggtaagctgtctgtcatttggcaaagatgtgaggttttctcaggaaagggtaggtatgtaaggcagctctaacatgacctgatttttaactacctttcaagggatattttacaatgtttttgtgaacactctggtggattctgggaccttaagacgccattcctttggaaatatgtaattaataaagcgttatgggaaagatgtgtgatgacaatgtctttcttgagttatgctaatttgattacaataaatttaagtaaattctaaagtaattatttctttcaaataacagcatttccagtatttaaaggaactgtccccacaagagtcttctgaattgaatttaatttgtctattacttataatatgctcttaagtttaacaaaaagcaagcacaatgagttattcctaacacccaaattgatggggttttctcattactgaatctcatctgctcctaagtatgcttacattgtaatcaactgaaaaccctcagaatagcttttgcttaggatatacgttgtgcttactccacaggctggtctgaataaaagcaaagtgtagaacccaggacaagtcagacagtagcagtaccacactctctgtatataattcattgtccaacaccatatgagtgaagaaacaacacgaacgaccacacacaaaaccttcaagtcactaaatgatacacacaggaagctcagtaactccttcggggtaaattttattttaaatttctatttagacacatatgagaaggcatactagtactccacacattagttttaaaagcattggcccatggcaaatattcaaccctgactctatccttacttcatgggatggcataagacaggagtatcctccaaaatttctgacctccctaacattaatagctaaaatgactattctcgctaaagtaacattgactgaacatttcctaaacaaaacaattatgagcatcattctcaactaccaaaaacatcttaatagatgcaaaatattaaatcataaataaaaataatcacatataagctaactcactatcctactaaaccttgatagcataaaaatcagcttaaaataatcattaaattttattacaattaagtgctattataaataacatgcttgttttagtagtaaagtatcgcttaactaaagtgataaaagggggaaataattatttaaatgaattactatcaataccttatttaattcaaaagaattcagtggtttgtgcatttcactaaaacatcagatttaatttactgttatttttaaaaagtaaacgatatttacagattaatagcaagtatttaaaattttacaattttaaattacaatttatataaaaataaatgatcagaataaagtcagatgctggaatagtcatacatgtattaattcctatattataccattatttttagttcctgaaaataagttggctttttgtcatctcatccctttgctatgatttcgctggataattatgcactgaagttcattactcaaagcatccagttgttgaacagaatcaaaatcacccaacccaataaccacagagtaaagaattgaaagaaaattggatataaccatggatcttaacagaaacaagtaacaagcaaatagggcccaatattaagtgctaatgcaaaattccattgccttcttttcacttgcaaacctacacaatgtcaacattttctgaaactgattttgaataatccctcttattttcaagtataggaaaattaagatatattgatgagaaaaaaaattctatcatttccctttctaaatgctattttcaaatgaacaagatagatagatacctgtagaaaattgggcagtgagtacaggcagtgatgtaaactgtattagaacaccaaaaattcaaaataaaaacaaatttaaagatgcatattaaggccaggcatggtggctcacgcctgtaatcccagcactttgggaagctgaggtgtgcaaatcaccagcggtcaggagttccagaccagcctggccaacatggtgaaaccccatctctactaaaaatacaaaaaatagccaggcctggtggcacatgcctgtaataccagccactcaggaggctggggccagagaatcacttgaacccgggaggcggaggttgcagtgagctgagatcatgccattgcactccagcctcggtgacaagagtgagactccgtcacacacacacacacacacacacacacacacacacacacacacacacacagacacagatgtatattaatttaatcatttagtcctttaggaaatgaccttctatgaatgctatgagcactttctatgaacaaggccctatattaggtatatgtgaatcaccatgtacttccaaggaagtgtaatcactttcaataaaacacaggacataggaattctaaagttgaaacagctttgggtattctgttagataggaatacttttgaagactaacaatttttaaatattgcactagagagaggtgaagagttgaaaggattagagacagaaacaaaagacatcgctgctacgcacataattcattcagtgctgctggttacaaatgatatggtattcaagttactttttcaagcttttcatttttatgcataatttcttcaaagatgcctttggggatggacaatttcagccagtaaattattttttacataagcatttaggtatggctataaaatcatttttgcttgtatcatgttctcatcatccccaagaaaaaccccatcgtccccaagaagaaaaaggcctaacgttttgtgtttttagattttaacttcatctgaaataataatagaaacatgttaaaaccaactatttgagcgttaataaatttctaataatattcatattcaaagtagttcaaaattcataaaatataaatatcaaacagggagtacaaaaaaaccctgagatgtctattcatcacagcaaattcagctgagtgctctgaaactccccctgtcctttaaatgtcacaacagaggagtgaggacaattctcttcattcatcagaagaagatggggacctgaacgttttctaaatttcaagtctataagcatcttagttttccaggaagtccacgatcaagacgccaaatggtcagtttctggtgagacctctcctggcatgcagatggccacttcctagctgtgtcttcacgtagggaaaaagagagctctttcactccttcttcctcttaaggccatcaaccctatcaaatgaggatcttacccttatgacctcatttagccttaatttacttcctaaaaaccctatctccaaatatagtcatgttgggtgttaggacttcaacatatgaactgggggaagggcacaagttggtccataacttaaatcaaaaattatgtcctatgtcattcatgaaagtatgcgttatataaaggatttttgtgtcaagttattggttattgtgtgatgcccatttagccttagtttgaaaacttttaacaaagcagttaaaagtattcaatctatttgtttgaaataactccttccatgggtactctactaatgatggaattgtatcataagcatattaaacttgagaaagaaagaactgaaacagtcccttaccaccgctccatctgaatttatgttctgaagatggaagacatgaatcctggtatgtttaggctttgtgtccccacccaagtcttatcttgaattgtaatccccataatccccacatgtcaagggagagaccaggtgcagttaactagatcatgaaggtggtttcccccatgctcttctggtaatagtgagttcccatgagatctgatggtattataaattgcttttccccctttgttcagcacttccccttcctgctgccttgtgaagaaggtgccttgcttcctcttcgccttctgccataaatgtaagtttcctgaggcctccccaactatgctgcactgtgagtcaattaaacctctttcctttataaattacccagtcttaggcagttctttatagcagtatgaaaacaggctaggtatggtggctcatgcctgtaatcccagcactttggtaggtcaaggtgggcagaccacttgaaatcaggagtttgagaccagtctggccaacatagcgaaaccccgtctctactaaaaatacaaaattagccgggagtgatggcgggcacctgtaatcccagctactcgggaggctaaggcacgagaactgcttgaacccaggaggcggaggttgtagtgagccaagactgagccactgcattccagcctgggtaacaaaaaaaaaagaaaggaaggaaggaaagaaggaaaggagggagggagacaaatacaaatccccctaatgggtctcagttctctggggcttctcatgatgagaacacttccactacagtgtgtgattctagtatttaaaaacgagtattctttttcatcctgacccttgaatgcaaatcaaatactacatcttgtgcataacaggagaaataggagaatgctccactgttggaaagaaaactacagcatgaaagttctaaaatattttcaaagggaattttaactttttatgatttttctccttataggttgacttttttttaaccaccataatattcgctgtggttttagaagttttaccctttcaaaaactacatatacatacgtgtgtgtatagacagatactcacatttggaaggaaaaaatcctggtaacattttaaattatcatcatgaaaaagtatctcttgtgactgcaagttgaatatgttctatcttccagagatacactaaagacacataatctaatcaactcctaccaagataaaataggaagaagccctcacaccagccccttggctctcctttttttctgtgtttttctcctctttgtttctgagtgtatattgctcttgcacctttaatgctcagaaggaagatgaagcttcagctaaggccttactttttccttctcaagcctcatatttagaggggggaaaattagatgcaaaatcaccttttgattatatgcaaatttgtcaaatttttccattaaatggtatattaaggaaatagaggctgctgaagaattgggcatagtaaaagacctagatttgaactaattttatcattttatttctgactctggaggagtggctacctttgttgaaaatatgggaaaaatgaaaagacagatgaggcctacgaatcttcatattttagagtaaaaataagggaaacagaaagaaaaatatgtaagcaaatgtggtatgtttaaaggttaggatttcacacaatgcatttatttttctcactagttatgtttgacaatggggcttaatttaccaaggaagaaataaccatgacgtctttctactgtctagagaacaaatcaaagaattgtatttcatgagcagtgccttccaattaaaaaagaagaataaaggaaagagaaaagctcatatattctgttgagtgtgtagcaaatacatagtaccactgtggctatttaaacaattgaggctaatggaactaaggagaacttctaatgcaactgaaattgatgcaatggtacactttaatttttaagtgtttctcttaaatattctatgcaatagggattgagtgctcatttgattaacttattgcagggatggttgcgcaagaattaaatgtgctttggctggacattgacaatgaaatgaatctgaatatacttaaatgtgatatatactgttgctttgggtcaaaagttttttcatgagaaaatatcaccaattaactaaaatcaaagagaaaatgtcattttctcctcatttaggttcttttaggaatacattaactatattatcagtgcagcacctgtctttattaataatagatgtaaatgttggttctctgagctgtcaaacttacaactcaaacttcctaaagtaaatcgataactataatacatgactataataatgtagaactgtgagttctgcaaaatatctaataagttttgagtaccatttaatctgggagtttttgtttcaaaggacaacaatacctcagaaaaggtttatcactgatgagttgttcattattcaatgaagatttatcatacatatgctaaaattaaatggagtagggagggggctggagaattaatcatacagaaaagaagatgactgaatgatctatatgggggtagtaatccccacactgccagcgtttattccatagccagggtgccatgggaaccaaggggctgagtcgcccagtctttgggaggagtctcatctcagaggaaaccaggaagtcttccaggaggaccactggacattagccaggctaggggtgaagggcaggggcactgcaggccgttggagtgctcttgtacaattagccttagccagtgggcttggcactctcagcctgtgtaaccaaacccagaaggggtctagaaggcctttcaggacaccgtatgcttcagaataggagcggattctcagtccacagatggttcctgatagagtggctgggtggggtaagactattcttgggctcatctagtcttagagatctggagactcccagaggggtggaggagtaggatacttttggggccactacagtggtactgactcttcaaaaaaaaaaaaaagagagactgtaacttaaagtgatctaaatttattcatttttaagggaaaaagcacaacagaaagaacaatcactctgtctaccctttctcctcaacgctgcccctcgacatctccctgggagaagctgtaagactgccattgtttttgtacgacccccagatgcacaaagttgtggggagccttcacattgccatctcccctccagagccagatttgtctgtggcattagtgcactgaaagctgaggggtagggttgggtattctctggaggacaaagtgctaatgttcagtaattctgcaaacatatgaagacaacattgcctacctgccaagggtgtggcaccatgttctggcgaaaaaaactgcaactgatttcactcatccaagcaaattcttagggtgtaatgggagttgaaaaacatcatcttggaacctactaaagggacaaacatgatatgaaaatgattgggcgggagaggccatatttatgaatccttagtgaggctgttttatggttcagatattatggctttggctaatgtctgagtatatgtatacacagattttaataaaaacaaccgtgaaatttgagaatccacttcactgaaattatagaacaaatatatcttggatactacattttgcgtaaggctgcagtcattccctttaggtgaactgaaatgacactgctaccatgtcttttctgtacagaacagggaaacaatgacaataagaataaatgaattgtttaaccctgtgagcttcagaatgcttagcaaactactgtgaatcaaaagatactacagaacaatctttggctttacttgacagtatttaacaggtcttataagtctatttattttatttattagtcctttattttactcccaatgacctcatttccttctcctttgctatagtttacagcaaagcaatttgaaatagcaaatcaaaatattatccgaggacaaaatgtaataaatgcagaaattgagaataagtttttttagaaatttttgttgcagtgtgacatagctgtgactcccaaatatataatcagtggcttcatgtcactgaacgtacagactaaaattgccagttggtgatgaattagggaggaaacatgggtatttccccacaaatatttttattagtattggtttaaaacatctggcaattgtacataaaatatttttaaattcccttcagctatcaatatataaattattgcaaaatttattaggctaacactttctaacttgtactcttagatacagaataaagatattcttggtatctggaacactgtagttgcttccattgtctttggcaggttttcactaggagaatggtcagcgccataggtggtaaccacggcttagaagaaaagagaagaggtggatgggtcccaggagaggcagactgaaatacctatattctctcctaagcgtcccatggctccaggcaccacacatgagcttttttttttttttagatggcgtttcactctttttgcccaggctggagtgcaatggtgctatctaggctcaccgcaacctccctctcctgggttcaagcaattctcctgcctcagcctcctgagtagctgagattacaggcatgcgccaccacgcctggctaattttgtatttttagtagagacggggtttctccatgttggtcagagtggtctcgacctcccgacctcaggtgatccgcccgcctcggccttccaaagtgctgggattacagccatgagccaccgtacttggcctctacacataagctttagcatctggatacttcagctaatctgggacaggtccaatgaatatttccacagtttatcactttggaagttataggcttttttcaaaatcccctttaattgcttattagttctatagctctataaaggcaaatagcctcatcctgctcataggaactttagggaagtgctttacaatctccagccttcaagacattgagacaatgaaaaggcctttttttttttttaagtatatgtgtttcgcagtagcttaaatagacatttaccagatgtaaattttatcaggctttgtgttgaagagatttcttcaagtggtgattgttgactctaactgtaatgtattttatgatctctccagatagaataggagggaaaaatgagaatattaacccttcctctacctgctattagttaatcctaacaaatactctatgaaacatacatgctatagccaaaaaatacacactggtccgctatactagaagcaaaagaaatcagaatgggttaaaaaaaacaaggcaactagcctaatgatacgtacaatgaatttggccttcatttttctaggctctgggtttgcttttcacaaaaactggaatcaagttcctctaggcggttgacttaatgatttgaaaacagtagtataaacaaaacatgaagccacatgggagagacgaggaatttatatatgcaaagtcaacacatactttatggctaaataattttcatggttttaataatttaaaaaatgttcaaagctgaattaatagatgattttcatgttaaacctgggtaagcagaagtaaggtgtttaagaactcagagtcactgggcgtggtggctcacgcctgtaatcgcagcactttgagaggtcaaggtgggcggatcacgaggtcaggggatcaagaccatcctggctaacacagtgaaaccccgtcgctactaaaaaattagccaggcgtggtggcaggtgcctgtagtcccagctactcgggaggctcaggcatgagaatggtgtgaatccgggaggcggagcttgcagtgaactgagatcaagccactgcactccagcctgggcgacagagcgaggctccatctcaaaaaaaaaagagagaactcagagtcatataacctatacatggtactgccgagatcttgggctgcagctcctggtttctatactaagccatgttattatgctactttagcaatttctagccctagatctccttaataacaaaaatcaaaagcatgtcatggttagattctttgaattctgccactttcaggaagtagcacctctggtttggatagctaaaaggaatagcagaggtattaagccacaactgcacttaccacaaatattccactcttttaaaatataaacatgtgactgttaaaatataaacatgtgactcgtttccattggcattcaccgctttcacaaagacaatggaagaagccagtaacactgctacatctacaggaaacaaaaatgaaactaaatggctccaaatatatatatatatttgagtctcttaagttcaagtgattctcctgcctcaacctcctgagtagctaggattacagtcacatgacaccatgcccgactaatttttgtatttttagtagagatgaggcttcaccatgttggccagactggtcttgaactcctgacctcaagtgatctgcctgccttggcctcgcaaagtgctgggattataggcgtgagccactgtgcccagtcggctccaaatattaataagcataaccagggtactgtattttggatattagctgattgattgtacagttacaaaaatatgatgcatcctaggaactatccattgaaattttcctgttaagatagcaagatatactgccaactagcatgactgtttccagaaagcatatgggaaggtgataaagaaggggcaaataatagagcaaaacacaaaaagaccaagagaaaaaaacaattaattctacaattggggaattgtcaggacaaagatatgtataaattaagataaaggaatgtgaagtatgcagtgctgactgaagaggtcatatggggttgtcaaaactgggctatacgtatgtgactgaaatggcagaaaatgtgaagtaaacgagtaaaagaaaacctgcaagactaaattaaacagaacaaagacacatagtatgtacacatagtactttaaaacaaaactgtaaaaaaaaatcatctatttggccattgaaaacaagcattttcccatccttgcccactgttagcatgaaaatgatttactcagcttggtcagaggtagattaacctgatgaaacaaccaaggcaaaacccattctcaatgtgaaaagtaatgaggattttcctcagtttgtgtccaaggacaacactaggcagcacagccctagtgaagcataaactcctagcagacagaaagcttcctgagggcagctataatttgttgtttacatggaggcctagcagagtccttttcatactgtaagtgttctatgaatgtttattaaattaaattctacttaagtagctctcttttctaattagccttggcaatcaagtagtttattaaaataaaaaagtccaagtattttggaagtgaattttgtagcagcaaattcaggatgggaccaatgacctacaaattgagctgcagcaaaatattggctgggaacaaagtagatcctaaaggtggttttgtcagacaaagtgcaacaaatctcactgaagaacaacagtcatatggagtgttgtcgcatatgaatgattacttgaaatcagtgttagaatctcaaaaagaagtaacttggtaatgcaaagtaatgctattcaaagtgctgtaaaaagataaacaggtattctagtctcagctccagcaccccccgcctcaggaagctggctcagcccactgcagtccataacggtttttgccaactgaactcaaagccccattaatgcagaaaataattacaatctacccttgtggcatctattaacttttctttaatcatgttttgtctctccaattagactgtacgttaattaagggtaaagagtttcagacatttcttctgtagccatcacatctaatactatacaagggtgatttaatattagataataaatttaggtaatttacaacattaatagttactattaataggaaaaaaatcacataatcctccccataattatggaaaagcatttgataaacttcctcatccattcataataaaattcacttcacaatagaaaaggatatcttttataaaaaagttttttacctactacgagattaaaggcatttatctatttaaataagtaaatatcccacagaaaacatcacacttaaaggaaaaatgttgaaagcactccttttgtaagccagaggaagtcaggaacactttctgtcaccaatcctattcaaaattgtccaggagataccagtcaatgtaggtagacaagaaaaagtaatcaaaataagacatgaaaaggatgaaagaaattttcatctgctaatgaatttaatatgtgcaggcatgtattaatattatattcaaatgaatcaaaaggattaaaagtctaggttttctggctacaaaaaccaacatacgaatgtatatttcttgtattttatagcaacaattagaaaatgtcactttatgcacaaagatttgcaaaattttaaaacccagataataccatatactgataaggatataaacaaatggaaattcttatctactctgggaaacttcttggtagtacctaataaggttggatatgcatataccctataactctttctattcttaggtacataccattgagaaatggttgtacatatacaaatgttacattcattaacattcacagcatcagtgtttgtaatgtccaaataatgaaaccaacccaaatgtccatcaacagtagaatgaataaatcaattgtgatacactcaatatgatggaatattacacagcaataaagacgaataaaccatagcctcagagatgagtatggatgaatctcaaaataataatgaacaaaaatagaagaccacagaagaatgcatttagcatgattcccaatttatataaagttaaaaatataagatggctattacatatattatttggagatgtatatatgggtggcagaagtattgaaaagcaaaaaaaaagaaacaggcaacacaaaattcaaggcagtggttacttctaggtgggaggtagaggatgcatgaaaatgaggggctcagagaataatacagcacagggagttttctatttctatttcttaatgtgggtagtggagacattgccatttgctctaatactactctttaaactacatacacatgttccatacattatacattttttatatatcacagaaaaggaagaaggaagaaaggaaagaaagggaaagaaggaaaggaggagggagagaggaggataggaaaaggaaagataaaaaaggataattataaaatccttggaatgctaaggaaaagaagcttgccatgggactctcttttaaatgaaagtacacatacttctacaaacactacttagcaagaaatatgcacaacacaaccacaaggggctataacaagacatcacgcttagggctgagattagactcctttcactaaaattgatgagtcatttgtcacaatacagatgttttatggctgaaaggaatgactgaaaacactggtattttcttatgtaaaaaacaagagtttctccagattaaatttcctctaaaatttttaagtactaggttgaaaaccagaggaatctactttcacttttcttcaattatttgcaataaaacaagaatatatatcagaccatggggaaaatctttttcttccacactttggaaatctaaaaggtactacttttatgtactaccatctaccataattagatttaatctaaattgtgctattgagaggcgagaaacgcaattaaagtgtcaacactcccaagaccagccaaacaaccttttggcaaatgctaatataaatgttttcataacctatgttttttaaggtcactattcaaattccatagttatacatatctctgttttcagagactttatttctcaggttttgaagggctggagaatgttactcaaacataaggtcggtaaagaaattttagcttagaagtctcctataatgctacagagctgtagtctgtagcagtcctacagggcactgctcatatgcagtaagcaaaggtggggcatggggaggaggaagaaaacagatccagagactgtctgcagagcatctgttccagcaacccagttgtgggccttctcctggaccagtaaaactccatctggtatgggaagctaactgttccccaggtggtgtgcccacctgtcaactgacagtcgggcttgtgccactaagaacaagggcagacacattttggcacagacctttggagcatttctttaacttaatggctgagcaagacttgagatgaagagatgaggaaacacagaaaaaaaaaaaatgcaatgggccctgctggtcccaggcatcagctagggaatctaggtcacgcctacaacaggcgtctgatggggtataccatagagggcggagagtggcagggaatggtgccagcctctgcctttctgggcttgccagcccttggcagggattctggaaaatgagacatcccaagtcaaatgcatttccgcacattcctctccctctcctgcctctagctacttacatgtggttaatagactgctcaaattgaaaacacacacacacacacacacacacaccaccaccaccaccaccatcaccaggatatggaatctatacacgttcgttccggaatgtttaggttgaaaatacacgtacaaatatagtctcctggtgaagctctgtgctatgtatttattccaagtgatgtccacaatctttttggaattcttctggcatctggctttagaatccttggcatattcttgtcaataccctcaggtgatgaaagatgttttattctaaagagtacattttatttaccaggcttatggaattagatgctccatcaatccatattgaatataagaataaatggatgggtgaaacaagcacatacctatagttcttagacaaattcctaatgaaatgaatgaccaagcatggaatgtacaattttttaattttaaaaaagcaaacaaaaaataaaaaatagagattttcttgtatggctcatatggtagaacccagaagaccatttcagtggaacaaaggagaccactgaaataaccagagaaccactcaaggtgatcctggatataggggctattaaccttttaatctttgcattattccttaaagcgtttagatccatttgctccttgtcttctcctatcctctagtcctgaaatcaccagggcaccaagcctcgagaggctgctctctcccttactgggctgggtttctaagatatctctgaccagatctcagagataactccaatccagaggatctttaggcggatctttattctgccaaatcctacactgatactaattttcaaacttagatgtattttaaataggaaaagaagacccaaattatatcattttaacttaccttattttttcctgtaaaacaatatatcataaattttaaaagtctctgtgcttagaagaaggtggcattcatacatttctggggtgtcttttaaagagccttattggtccatagttacatcccatacacatatatattataggcacatttacatgcagacatataaaggaagtattcataaaggatgagtgatgaacaaacacaaagccatgctttgatgttaaagatgcagtgcttcactgttgagaaggatgtgtaattgaattcttggtaatcactgagaatggtgtctattgttgaatgtagagtgctcacagaagtcttgcctagggagtttgctctgttctaaggtgaattctccatagctcaactcaaacatgaaaggtgtcctggcattgagccaaatgcctaggccagggtgttctctggatcctgctggggtcactgaaagaccaaagaaagcaccccaaacctggcctgacatgaaccgagaaaacttgggcagcatttggccccagggtaaggatgtgacagagcctgctcattctccctgcactcactttggcacacattcagcaatgctctatttgattgctacctttccctaataaagagctaggcttttagtggatgttctgattctcataatgcaaagacagaaggtatgtgtgaaagtctccagtaacactatgcttcctgcacatagtctacccattaaatgactgacttggatttcttgcaaagattgaatgctggaggtaatttaataatttaagtataatataaacatttaaagttaaaaaaaaaaaaaagaaaaaagactgatctgggttattaaactttttaaatatgaaagtgatttctgaaaaatgtgcaaaaatgacttttactcttttcttacttaaataccattatcatacaatattcaagtgattttgctattggtgggaagtttagaatgcatcctgatgaatatcaaggatctgctataaaaacagattctcttaaatataatttatgtgcatgcaacacacacagtgtttaaaatccacattcttaagtgcagatgtgttttcagtgtggtctcagagtgaaggtttctatacagggtttagtctgagaaacaactcgggaaacagatgaaaggcatttcagatgattaccctagagacacagtggttctcaagacttgaggcatataggccatcctgggctagtagacaaatttttgacatttaccacctgcttagcaaatgtcataccagttcattttgatactcaccaaatttgtgacttcctagaccagaccacgtagagtctcatatggcttttatttggattgccttaaaaattgccatattttcccaatacctaatagtacttcaatttcttaaaatacagaggaaaaaaagaataattttgctaattaaatcctgtcagaagtacatgaattctgttttaaaacaacaatattaaagatttttgattaggaataaaacatggaaattcccaactaagatataacatagcacaaaaaaaaaaaaccagtaatgatatagagactacacaaaggtaaaataacagcaacaaaaaaggcactggggtatataattcatatatgtattttaagtaactattaccattttctcttaaatgccctaataaaataaagcattttaagatatgctataataccttaataataattcattaccattatctacatgattcattttacctacctctaaaagagaattactatcactttgctataaagcaaacagttctgaaaactacccacttggaatgctgtacagtgaccaggcctgggtctgtattgctcactactctacatccaggacacaatgcactgtttgtcccatcataagcactgaataaatttgttcatctgacaagtatttatgagcatctactatgtttaaggagctgttctaggcacctatatatacatcaataatcaaaacaaagatacctgcccaatggatattgccgacttgctaaaagttagatcagcagccttctttgaatatcaactacttctgacatagagatgtggcacaactatatgaatgaaagaagaaaacagtgtgaaatcaagactcgaaattcttttgagaactaagatatattttctaatgcctctgtccttcagtgggcctgcagtgggcttgcataggacagggaaaaggatttaggaattcactgccactttgaggtcatatgagttgatctaaaatctcagttcatctttcctccatcatatgttacctgggtcacagagggcatgaatttaataagaggtattaaaaaaaggaactactatctaatgacaaggccgccttttaaactctgtaatagttgtttcctgtttatgcataggaagatgtatatttagaaaatttatagttctttttagaatggctaacaattaccagaatatgacacgttttatagccccgtgccttttcttaaactcttccctttgtccccaaagacccttttctactgtccttttcccttctcatctcttgtttgttaaactgatgaatgaaaaaacacgtgaatgaatggaggttgagagctgctaaaggctggttacaaccaggaaagcttagggaggaagctggatgtttacagaaatggctttaggtgtcattagttctgtaatgtagtcctgtgttgtttctgaaaacaaagatagacaggacagtaagttaagcccaaatcagcaggctttctccccccaagtactagaatacaatagccactctgtctcacaaatatataaaaacacacttggcttagtttcttcaatatattactctcatttcaattgagctcatttgtaaaaagggcccatctgcaaaatggcaactggggcctgtccaagtagcaaaaaacataaaaaaaacatccaaagagaaaaaaacttgaatcaagacttcaaagttaaaaaaaaaaaattagattacattttaaaaatcaaataataaaatgtttttgttatttttaaaaaaatttaatgacaggagattgttgtggtagaatgaaagagcatatcacacaaagtccaaagagtcaggtttaggtcagtattagaagttggatcttgcataatttattacttcatttttgtggaccttaagtctttcatttataaaatggataaggagataataccacatttcccagaacaatcaggagaagtgcctgatacaatgtatgtgaaacatacttaccactgttcatgttagttcatattaatttcagttcctcctctgcactccttagtactctttacatatttccagtggcttttaccataatatattgtgattatctgttatatgtaggttattaatctttgtacctgtcattctgttattcatttttgtacctccttacacaatggtggcacacaataagtgtgcaaaaaatattgtttgaagagaatgaacacaagttgttttgttaaatgagcaatgacatttcatttcatttcattttttattttttagaaaccaagtcttgtcccgtcacccaggctggagtgcagtggtgccatcttggctcactgcaaccaactcctgggttcaagtgattttcctgcctcagcctcctgagtagctggaattacaggcacccgccaccacacccagctaatttttgtatttttagtagagatggggtttcaccatgttggccaggttggtctcaaactcctgacctcaagtgattcatccaccttggcctcccatgtgctgggattacaggtgtgagccaccgtgcccggcctaataatgacattttaaaaacacagaagtatgcttaaaattctaaaccaaggtatttctcatctttgaaaaagttgcttttgccaatttgtagataggcaggcctatctacaaacaggacagttttctacagctaagtcttcacatactggttactatgtaaggcttaaatttggtctatttaatgttgaacaaaattctttatcctgttgaacaaaattattcttaacacagccagagtacctgaatcaagactatgggagtagccagtccatctcctgggcacccttactgcacaaagaaaacaagttacatatattttatagctctaaggcaacaactacccatggagtaacttatgtctaacacaggccgggcacagtggctcatgaggtcaagagatcaagaccatcctggccaacatggtgaaacctcgtctgtactaaaaatagaaaacaattaactgggtttgatggcacacacctgtagtcccagctactcgggaggctgaggcaggagaatcgcttgaagctgggaggcggaggctgcagtgagctgagatcacatcactgcactacagcctggtgacagagtgagactccatctcaaaaaacaaacaaacaaacaaaaaacttatgtctgccacaaccagccaataacactgccatttgtttaggcttccatttttacttcaaacacaaagttttagattctctctctatcttaactaaaatcaagaagctggcactaccaaatgttatttaattctatagtgagatggcttttaattggctagtcttacaaaaatggtagtcaaatacaagcataattgtgatcaataactgtaaaatagtttgtagtatataaattccaaaattcttttgaatatgaagaaaattttacattcaagtagatcacttttaggttcctataataacatttaagcttggtaacatgctaccagaacttggttattttttggtaagccatctttttcatctaaaaggagtaaaagaagaataagatgtaaaatatactcatttaagcttaaggtggaggaaggaagaactttaaaacctaatttggtttgaccaattaacgttctgattgtactctacagggagagcacacaaagtgtatacatgcacacacagacatcagtgctgatgtgcagggacaaatttaagagctacctcccattatgaggacataaattcacaaacacactcctacagcatttccaaatggaaagcatgggcatctcattaggggtcgaacatagggcataaaaaagtacaacgaccttgctgggtttggcttctctttcacatctaagttccttgtaaaacaggccaaccatgagaggatgtttaaaacctgtagcattaaaaaagaatctagggtcatataattatttcataaatatctgtaagactgaggaaagttggatgctcctctgtttcctgcaattcaaaggtaagtgaaaaccaactttggaattaatagctttcagagatctgaaagcgttctaataccaggattttcaatgctgcaatttaacgacaaccctgctgttggccttttctgacctgttgtgaagtaaatcaggcaaactaatgtgggctaacaagtctttttcacaccgttcgatccccctgcttctcttttctccgcagacatcgcctttctcccactttctgtctagccatcctccgtcaaagcacacaaaatggccactgtaaccctgcatcactgctcattagatcacaggttagtcaagtggaactgcccggggttcccaaaggagagctatacttcaaaaatctgtccatgtcaaatgaagaaaaaaaccctgagcgtggggtcacccagatcaatgatcaaaagaaactgagaatgaagggggaaaaaagcacaccctcgtttttgttaaaaacacacaggtctgatttattataaggaatacagagatacgatggggtttcctcctcttctgccctgttttcattttttaactaagtaatttgttttaatcaggtcctgttggttgttaaacttcagactttggaaagtctacaactaatccttaaaatttcccccaaagaaaacccattctaggaaatccagttttaaggaggactcctaaatgtttccaaaaacacttgaaaagcaataaaagtaatacaaagtaatccatctttaatgcttgagaagattctatttaaatctgagagtaagagttggtgcgacatacactttaatatgctttaaaataatccgagtaacctcttgagccttcaaagaggggaaacaacaatctgtcaatcacgttaggagcacacacaagtgacatactataaaaaggcagatttctggattttggtgaggctgcaaagatatgcaggtaggcctataccttgtttaatcatctccctcatttcttctatgctattcaaagtacaacattctatatttgcatttgtactttttgaaaaaataacactactaatataacagtaccgcaaacttgacatattaaaaatgagggcagaatgatatatctggaacatcttaaagaacaagacttggtatcaaatttcacaagtgaaaatcaccaaaagatttggttttcctggtttcctcataactagagagaaaagtacattttatcggctaatgattaaaaaaaaatttctgcccgcaataccacatatatgaatgaaagtaaaataagttaactgcttataatttaacctagcaaaagttgtaagggttgtgtaagggctttatagctttgcagtattttcttttttacatttggaatttattctttaagtaccctcaaaggaatataaatatattcctttgtgactaaattaaatattttttgtttgacttttgtgtatttaaaaagcactcccatgacacttactctataccagacactgatataattgccttatggaacattaactcattcaaccctcaaaacaaccctgtcaggaggagggggaagaaagcagggagcaactgttaataatgagtaagactctctatgtgctatgccctcctttaatcctcaccattcactacaaggtaggttctagaattagccccattttacagatgagaaaacagacttttaagtttttgcccaatataatttagatggtcaacagtgagaaggatttaaatccaaaagttctgacttcccagtcttactgtttgtcatctccaaaccaaagtgccaagttaaatattcatcaagttaaacctgggtatatcctgtgacccccccgtaactgcaattttacatgtattcacttgagaaatgcttgcatatacaaggagacatgtacaaagatatttatcaacagctctgtttataatcacaaaaaatctagaaagaacttaaatataaagaaaacaccagaacattttttaaaaagctgtaaggcatcacatataaatttttatcacacaaaccattatcatatattatttagagacacatgtatatgtagtcaaagcatagaaatgtacactgggaaagatacacaccaactttaagatatttcttgcttctgaaggagaaaggatgggaaaatgatgaggaagggaaaggaaggggctttaaatgcagctttcatgatttgtttcattaaagaaaagatctgaaacaaacatgataaaatgttaacattttatcacgggtaatgggttggatgggtttgtctgatattttctatacttacctatatgtttgaaatttttcataataaacacggtatgactgcttagatgtttacctcatgcaatcacaaataaattgtgaaattactgcacatggttcctctaagtcctctccctcatttgactcagtaaactgctaaaaattcataccttggtaacaagttagagattaaactattaaaattaattttcttaaaagtgttttagaagtaccatctttaagaaaatcactaaatttgaaggaatttaatgaattcaaatacggactatattaatatatagtctatgtttcattttgttgctaaagaaaattcattaagttggcatttctaaccttttgacattcaaagtttagtaataaagcagcctggtttcagactgagaattgtaaattagagctgaacagggcacttgactagaaaagtgaactacttttcactgtatacctttttgtaaaattgtaccacatggctttattaatcattcaggctgattattaaaataagattgaagatttaaaaattatgtaatatcacatggggatccaaatgaaaatgatagaaatacattttctatagaaccttagttagtcatacaatcttaattgacagaggatggatcaagcaatctcaactacaattctttacaaatgtatgcatatttgtaaacaaaatgagtgagagaagagttgttattctaaaaataattgtggtgaaagtaaacccacaaattacagccacaactcttcctttaacatcttaaaaatatgatacaactttaaataacatatatttttcagttcggctttaccaggctaaagaaacatatgacaaaattttgactaactagagtataaataaaaacaaataatgaaagaattataatttttgtattccatttttaacagatgaaattacaaaattacagattcatattgagtgttttataaaaaagcaatgtctaggacctaaaagtcagtcattgcttcaacaaaattattttctgcatctacactgctagaactaatgttctaaataattgaagggctactacaacattcagaataattaaagaagcctgtatttccctagagcagaaaactgtgctgtattagcttaaaactgtattagtttaaaagatttaacaatatgaaaagaaaacaaggagcttctctggtaaagaaaaaaagatagctatagtgctcaaaaacatttccattaacagtaacaggccattcattactcaagtacctgatgacctcatgctttgccttaaaatctattctcattttttcacttaaaaaatggacttaatttgcttattaacataagtcattaaaaagccagtgttaagaaaacagaaaaatgtcccaacttatacttaaagaaaaacatcaaagttaatatgcaaaattggtatccaaaatatgcagaaacatgtatttccatattcatggctgtctatttaaataatttacatattaaacatttaaataattcaaatatttacacttaactctccaataaatttgaccaatactattttattttttgttttgtttttttttttgagacagagtctcactctgtcacttagactggagtgcagtgatgagatcttggctcactgcaacctctgcctcctgggttcaagtaattctcatgcctcagccttccaagtagctggaattacaggcgtgcaccaccacgcccggctaatttttgtattttagtagagaatgggtttcaccatgtcggccaggcttgtctcaaactcctggcttcatgtgatccacccgccttggcctcctaaactgctggcattacaggtgtgagtcaccatgtctggcctaataaataccactttaaatgaaactatatgaaaactgagtaaaatgtaaatctttatgtataacaagaaagaaagtgttctttctaaacaatttgtgccatgttttggaaaatcgggacatttatctggacacagtgatttgctttcccataataataataataacagtagtaacaatagtgttttgtgcatatacattgtacctccatctcaagatcttttttggcctatttttcaggatccctctaatgattattcagtcttctcttcaatgaaatatgctaacgcctgatgagagagcatctttctttcatagcacagttaacaactgtaattcttcaaccagctgttctctaaggattcccctgacaagctcttattttcattgcattatttctttgttctccttgtctaaactgtacacaagttacccagattttccactctggcccctttcaataaagaactgctttggcttgacaaataattagtcataaccagtattaaaaaataaatattacaaattctacatgctaaaattatattgttctatgtgacttctaaattacttaacagttcatatgtagaaccttcttcccataaggctccattggtttaacttctcatttatgaaaacaatcccagttattttatggagctagttaccatgtaaacattatagcccataatcttatgtcaggtgtagcatgaactaaaactcaatctatgtatactgtgtttagggcaactgaatccagatacttgaacatattaagatataagcctaaataaaacaaaattaaaccctacttgactcttctcctttgtaacctagtaaaaaacttgtaaattttttttttgttgtcaaatatttatatgtgtaccaatttagatcttggaatttctactaaagaaagtaattaccacttcactattagatactgtgataacaaacacagcaaagaccataacaggcccagtcagttgaaagctatgtgctaccttcaaaatgagatatttttcttcattagacctttgtagtataccttcttattggtattgaaggtgtgcctcatatcttcactcaaaactactagataaccttttttcatggtatcaatcctcgaagtggtaatgtgactattgaaataatagagtcatggctgaatataaaattctatataaagagatattattaaagaaaaagaatgagagactgtagataccaataaacaaaagtgaaaggaggtactataaacaaattactcaggtttggattagttcatttccaagcctatgtacactggaagagtggccacttctaagttgcattcagtctattacatgtaccgttgtacatgtccagttcattgttttcatcaaaggcacatgcaattcataggtaaggaaaaaataaagtggcaaggagaaaaagcctgtttctaagtaggagagtattctattcattgcaaaagatgaaagcaggtatctcttattacatgtttttgttctcagaggaacaaggccaaaaatatgtgattttcgtatttgtgctaacgcagcagaacttttcaaagtcactgccagaaatggaccagctttcttacctgttttttccatgctttaagttaaggatgtctgcctcattatgaacattgctggttcccccagacttctgtagtctggctttgctgtgattactggtcaaaacctttaattacagtatatagtttgtgcagctgcctggaaattggtctcagggtcagtggctcttcccgttcccctctttccattcttttgaagcaatattgctgaactgaaggcattgttccagctttctggtgtgctctgtctgctgcacattatgaatagctttgcaatcactctagcaattggttcttcaactgcctttaggttgtcaattgtaattcattggcttcaggcaccttttctcttttcattctcttgaggtcttttattacttaatttgcaataatattagggaatgtcttcttcagacatgtcactaatgccttactgattatgaggctgggggtacatttgactttcatacatgcgcctgttaaaatgtttcaatatttccttcatctctgtgacttgtgatgccaatatttgcagtaccttgcaaagaagtttgcttaatgctgaagtcttctctctaaagaataatctaaagactcctccttaagatattcttattggggttaatttatataattagttatagttatttttataacttcccaaagatatgatttctcatttttataataggaactaagatttcatattttcttcccatattatgccctattcttttttaacatataaaaattataatttcaagctccacacaactcagagatactgaagtagaaatcaatggctatgttttcagaaccttttaagaagacctgtatttgctcctcagacatatttgtagagattatataagaaaatattaagactattcaaaatgagtgacaatgcttctgcattacagaatcaagaggaagttttgtttctgttttttcaggggaaggaataaacaaatatatctcttgctccattaagaaaaaaagtaaaccatttgtgcattatgtctcaaatccttagttctggataaaatccaacagattaacccttctcattagtctcagccatctcagagcaaccaagggtattttaaagcagacactatgtaataataataatgataataattatcataattataataactaacgcttattgtgctttttatcttcaaagtaccttactgacattaactatgtctctattttcaaattaatttacctcgacaaatgttttattaactttgtaagctatggaatgtgtagtgactgagttctcttttgcaaataaaaaaataaatgaaaggaactaagggacaaggaaagggtaccttaaacttttgcctcaaatcagccattgcctttgttgaatgaggattaatgaaatgctaatttttataaaatataatattaacatacagatctaaagtgtgaagatcaccactacaacaacacaaatacatactacctcaaaaagattagaaagtagccaaataatattgtttggataaaatcagtctctaactttactagttatgattcattataaaatatttaaatatgcatacaaagtattaaatataagaattttttaaaatccttctaagtttcacttacgtaataaatgattttattaattaaaaggctacatttttttatttgtttgttttttgagacagagccgcactctgtcacccaggctacaatgcagttgtgtgatcttggctcactgcagtctccacctcccgagttcaagcaattctcctgcctcagcctcccaagtagctgggactacaggggcgcgccaccatgcccagctaatttttctgcttttagtagagacggagtttcactatgttggtcacgctggtctcgaactcctgacctcaagtgatttgcctgcctcggcctcatttgtttttaataaattgaattcatcactttaaaaccatgtcattatgttcccttagagcttcattatgtaccagtctctatgtgataaatctaaacaggaaaaaaatagattttgatgctagcaaacaacataagttctataagataaatataagcaattattttaaaatgtattaaaagaatatcatttggccaagatgtccagccaatttctatgagggattttggaaagagaatagtaccctgatatggtgttaaaaaaagtccacaaatagacaaacacaaatgtagaaacataaaatcaaacatttgtaaatacgataattaacaagttgaatctttttaaaactatgtattaacatggttagagtggtgaggattcgaggaagatgtggtttgtaagcaatattaacaggtcaggtttggtgtttcaggaaaataaaaatttttatattcaaggataaaaatagatgcattggcttgagtaaagagagagtaaggaaatctggataaagttgatggtatgaaggcagtaagaaaggatgtatggtaagattcggaggtagtcactctttcaaacaaaatacagttatcccttggtatcttttgaggatgggttccagaatctcccatggataccaaaatctgagacgcataaatccctgatatcaaatggaggagtattatcatataacctatgcacatcctcccatatactttaaatcatctctagattacttataatacctaataatgtaaatgctacgtatatagttgttatactgtattatttagggaatattgacaaatagactatacgtgttgaattcagagaatggtgtttttccctgaatattttcaattggttgttggttgaatacatgaatgcagaactcacagatatggagggttgactgtttattgaccacagagacataaacaagccgtaattcctgtccttcaacaaacttacaaccttaaggagtagacagagaagttataggcgaaattctaatattatgatttggataagcgcaggttgccaagggaaatcagatgagagagcccaactttggcatgggcattcaagactacttcctgatgtaatacatcatcttgagggggttgtattagtccatttttacactgatgataaagacatactcaagactgggaagaaagagaggtttaactgaacttacagttccacatggctggggaggcctcagaatcacggtgggaggtgaaaggtacttcttccatggtggtggcaagagaaaaatgaagaaggggctaaagcggaaccccgtgataaatccatcagatcttgtgagacttactaccacgagaatagcacaggaaagactggcccccacgattcaattgcctcctcctggctccctcccacaacacgtgagaattctgggagatacaattcaagttgagatttaggtaggggcacagccaaactacatcaggggttttcctagtgaattaggaatagtgagtggtacataagcataagtgagtgaagaaaaaggaatccgatgcacattaacatagaagatctgtggaattacattcgattccagaagggattaaaagattattaatattagaaggttttaaaatatgggtatcatgaaacttcgataggaagtttgcttgttctgctctgtgttgaaaaatagtgagaaaagaggagatctaggggtgtaaactattaggaaactctgagaagcacttcagaggcagaagtgggagaatgagactgtgaaaagtctagatgtggagaataaaaaagagtacgaattgaaaaaggcttcaaaatgttcactttacataaaatgaagatatgtatgtgactgaaggaagatagtggaaaggaatgggggttttaaaagagaacataataaattactttttgtatatacattgacatatattgagatgtataactttattaccctcacctaaataatttgcttgataaaatggacatttcttatataacgtatttgctcatggaaattttgcttttggtggacaaggcacactttaatcatattgcttggtagatgcaagaaacacaggtatacagaggaaaaaacagtgagatcaaggtggatagacatagaatcaagaaaatcaggtatacaaaattaattttatcaaagaatgcatatagaaataaatgaattaatgtataataaataaaatattctggctgttttagtacttacagcttaaaagttgctcttcaaaatacacttaaaataatgacattcttatacctaatgaaatgattgctaattcagaaatatttatttctcttgataaatattttcaagagatagctgagtcattcagtggaaaattgacttccaaaccctctcattgtttcctcaatatttaattgtaacagcgtgcagtgcatctgtaaggaatgaacgaaaaacagtttgtatctctcataccattttagaataagtatacgtcccataggggaattttcaagctgctcacaccataggtatgtacactgctccatgtgaaatcaaatcagtattctaaaatgctgccaagaggcaggtcaagatacttggaaaactcttaagatttagagtatatgacactttccaatgattattttacaaacacatttctctacacatacagaaagcagtattaaattaagctaagcattttacacgatttaaacactgctttgcattttttaataaaagatttgtcacatgaagtcagagaagatactcagtacttcataaagctaccaaaaaagaaatgatctgttatcaagcaatataaatataaaataatttaaactatagtttattatctagagacacagattgcccaagaatttcagtctttcaaaactctgtctgatcctttgtagaaaggaaaaaaagtacacaaggtagaaataatcacctataaataagtagttataattaaatgtgatagttaaataccatagaaacacactagcaccctcttccagaagatgtctaatactaaaaagcgaaaattaaataaactcttcatgcacagagtaatgaatgcattgttcaaaaaaatctgaatatttataaccaaaataaaacatggtctaaaaaaccagtaatgtttatatcattacaaaaatacttgcaaatacttttctcgcatttatatcttgtttttcaaacataacacaaagttctatgcatgtcataataacaaactgaattaaaattgcataaaaattgagaaatggcctgatcacaaattttaactttaatgttgacaccctaatttagaagctgtattttcctgtgttaatgagccgtggaacaaatagagccattcaaccttataattctgcctcaaaactctgtttcacagtcttcatatttctcaattagtatttgctttaatagaaaatattcaacaaatacttaacactgtacttttgatatactatttctgaaaaagttaaatacttttggattaaggatatagacaaacatcaaatcagatgacattgctagaaaatatagactgtttcatgttaacaaaacgtgttcttttataagacacaatgtccagtaaaatgaaaataagattttaaaaaccaggaggtaaaagaatcacaatcagcaactgtgtagaaggaaaataggattacatttattggctactatatcaacttaacttctcataaaaccctcctgatctattaaataacttcagaactgaagtatgctctcctatgggagttgtaaaacaaattagttacaattacaattcaatacaaatgagaaaccaacctatttacccttaagatttctctcattttatagctttatcatttaaattagatcagaattttccctaatgtaccaagtgggccacttgacataataataaatttttctcgaatgctttctatagagaaaaatagttgatatgagtaaattctggaattcacctccccaaagtgaatacaacaaacatctgttgcaagaattgcttggctttcagacagtatgtaaagggtgttctttttcctagagttttgctgttgttgttgtttttttaagcttgtttaaaaatacatgttttcactatcagctctcaagacataaaatcttaaaattctggtaagttaaacccaggtcattaccaggtatattacagaaagaaaaaatatgtaatgtacaagactacacttgcttttgaaagggcaagaaaataattgggcatgttgccctctctctgtgggttacatagtaattttaaccattgtcttcatttcttaattcagtgctccacacaaacatagcaacactcatagtaggggaggggactacatatacaacttccttatgatttttattctctttggagtcccactgataatttgactttctcttttgaatttcactggcttctccccacttctaaagtcaacagtatccagacacactcatcaaccaatagtgtgtttgtacagtttcactccagtgacaggataaattattgcacattttctgcattaaacataaaatgtaataatttcaatggagtgagaagaagaatcaatagcctttatgactgattatcttttctaactgaatcaaagtttagtgctttttggtaagttgaatgcaccttccttgattctgacagatcagaattttgcctaaaattcacaagtattttgcagattaaaataccatctttttagcattggtaaattccataaaacatacacaaattagcaggtgcaaatgagtaagaatgcttatcagcaatagggcacaggatgtgcaacacctttaggaaagagagaataaaaagacgaccgttatctaaatacatttctagtaacacatgactttgctcacttttcaatcttctactgcctcttctataataccaatgcctgctcccaacgattttaaagttattgtttacaaaatgtttaagattcaattccacaactccatttttatgccaacaataaggtactgatttaattcttaaaacattcctgagagcatttcaacaaggcattttaatacagtacacagagaaacttctctgtcatcaagaaatgggaaaaatctaggatatatccttttctttttaggccagacccaaagtaagtataaccatgtcactgtgcttccataaacttcaagacttataatggaattagcccatgtatcccattaaagcagtctaaagtgtagacatgcacctgtatggtatatgtttatttaattatggggaaaaatgctttacttaaagcagtccccatattggtattatgcaaattccattacaagcaaaagttttgagaaaagtaaatttaaaatggatacaaataaaaaggaaactcaaagccacatatgctccagtatacacaagtttagaatcattttcagaccatatctatgacaacgctacatttataactatcagtcttactgaaagatgaatcacaaaaagaaggaaaaagatatttgctctttacctaggaaagacagccagtcaacacacacaaggaatactcagaagcaattaattgctaaaagcttcctttattcaatgtgatcatctttcattcctatggagggtaaccataagtcatatgttaggtttaaagatacattactttcaattatatgatgtctaaggaaaacagatacacaggttcataactttaaaagcagaaagaaaaaatcttttttcagatattgcaaataacttgaataaagttatctgaagttaaaatggcacttatatctatgttttatcaatgtgtatatgtattatgtatatattacatacacacattatactgtctacatgtagtagtgtacacatacatattacaagattttttagaatgaatagctgaataacaatgcattctcagcaaacgaccttataatcataaactacccttcattacatactattatatctactctataggcagaaaaactgatgctgagaagttaaaagatttacaaactaaggtcttaaaagcacattaggagacaccatcattataatgctgaagatcttcacattaatgactttctgaatagatttttattgctgttttttacttaattacttaatattatctataaggtatttttcaaactctattctttaaaaggtgctacgtacttaatgctgaatgaggcaactaaagtgagacatgagctctgtctgttgaataatgggtccttgcctttcttttttttaaactgtgtttctaaaatttgaataaaaactctatttatatggttcttctacttaggtgtttaaacttcaaagtaaattatccaaattaatcctattaacttatcataataaattggattattctcattttagaggtgagaagccaggcacaagaataggctatctgccgtgggtcacacactaagtgtgagggaggtctggagttagaacatgttatgtccttggctcctcatttatttttcaggctgaaaggcaagattgttcatattaatcatctcattccaaaatcacttgaggaagcatgcaattttctgaaggagaggggaaatcatatcctgaaagttacaagtataaaggaatacatcaggagttttgatttcactgtacttacgttataattcactataatttaagttttaaaaactattcacatatctcattactgcagtaccatgaatcacaagctctattggctgagactctatttgcctagaattagtctcatgcttttataggagagatacaagctaagaaataaaattaaatgaggaagataaacattggttccatgttaaaatgtatttgatggcatggaatttgcaagacatcaattttcagcctagcagattacagaataggatccattaatcctagtcaacattgaacacttcagaggaacaagaacatgacacctgaaggcgagtaatgcatggaaatactcacgatatgttcctagaaaagctgaagaagagaatgaactaagtccacaggttaaaacaacattaaataaccaggcctttagcccctcaaaatagatgaaaaatataaccagaaacatcttttaaccattgctaaatagctagaaaactctgtgctctccaagtagggttaggtatgtaaacaagtgctaacagattgatataggctttctgcttcctatgaaaactaaggtttcatgttgaaagcagcataaccagcacattcctaattacatgcatttttccaggttccaacgtggcagcaaaagtacaagcaaggaagacaaagagttgtcatgctaatgagacatacctcttgtactgagcgagctgctggcttgtcttgatgattggccaatattaaaaagggtaaagtgcataactgtggatgctgaagagctgagtgcagctcatttctagcagcttctaaatcatcctctgaagaggcactgtctaatacaaatattaccccttgagatccttggtagtagcggctccagtatttccggatgttatcagcccctgtcaaaaacaaaacaaattttcgttttaaaaagagctttcagcaactgaaaaatgttcccaacagtaattcctactggaaaccaatgtaccttttaaaaattaagtgctaaactctgtggtatggattaaaacaggaatttagaaaaggcagaaatcacagtggatgggaacaaagaaggcagtagagccaataggtagatttggccttgaaggaagacacaaaatccaagccattcttaatgacttttatataaaaatgtgtgtgagagaaccaggataaatacttcctagacttaaactcaaaaggatattttcagactttaatcatctcaaatgaactacacactctctaaaaattgagactgaacctgcctcagagagctgcatggcctagacatccaccaacgcttctttccaaaccattaacattagcttggtgatacttttttaacagaactgcttgctgatcaggacagccttgtttaatttcacctagggagttattagcacaatagctttatgtgtcaaagtgctaaagtttgtgaaaaactaaaatcatggcctttgatacaattacatgattctgtttggcttcataacccatgaggaaaaataacagacaacaggtgtacacttatgatctcaatgagataagatgtttattaaaacaaacaaataaacaaacaaacaaacatatggagaggctgggcgcggtggttcacacctgtaatctcagtacttttggaggccaaggcaggtgaatcacctgaggtcaggagttcaagaccagcctggccaacatggtgaaaccccatctctactaaaaatacaaaaattagccgggcgtggcggcgggtgcctgtaatcccagctacttgggaagctaaggctgaggcaggaggatcgcttgaacccgggaggtggaggttgcagtgagccaagatcgcgccactgcactccagcctgggcaacacagcaaggctccatctcaagaaaaaaaaaaaaaaaagcaacaccacatggagagtctcatcagccaaggcatgtcatgtagtattcctctttgtatttccattatatagcacaacatctaactcaaagttcagtactggaataatgaaaattgagggaatgagggagtaaaattatatactaattaagctttacaaatttgagactagaacaaactctagagatgatttagtccaactctctgaggaaactgaggcagacagaggtaaagtaagtgatcccttgtcatgtatctaataaatcacaaaattgggatttgcatgagttagcagacaacctgcccagggaaggcataggcacttcccattacatcatggtgactgttttcatcactttcattcaagaataggaggggcaatatgtgtgcatgtgtaggaaaggggtgctactggttatataacgacaattagatttcaaggaatttcaccaatttattgcatatgatcaagtcctaaccagttaataactgtatttcagtcatccactgaacatctagctcctatgtttgacatattgttatgtgttagggaaacagtggggactgcagttggtgtgccctggctggcaagggtcacctgtttgcttctcttcccaactctgtgctcagtgacatcctgttggtagcttgaaatcaatcagggtgaaagcactgtcactatggaaatcagcaaatcctacatatcgagtcctttcatctcccagagagccaacacaccactgatgacactgagcagcttatattttctgggagaaatagaaaagaaaactcaaagattataatagagtacaagaaagtgctgtcatagagatactcattaggtcctctgggatcaagagataggcatttcatccaaagtggggcaattcttttttaatttcattttttaaatttgagatgggttctcgctatgttgcctaggctggactcaagactcaagtgattctcctgcatcagcctcttgggtagctgggactaaaggcacataccatggtgcttggggcggtgggggtaaatttcttgaaagaataatatcagtagccaaacagctcccatttattaaacacttcctatcctccaggtactaagtgttttaaaaagaaaagctcatacaattcttacaacaatctaaggagggaagtataattgactaagcctttgaaactaattttcaggtcctaaaatctgtgatttcaccattatactatacaaaaataactaggtatatatttaataagaggatcaaggacatttgatgttgagtaatgttaagtatgtgaagacatgggatatgagcagggttgatgcatatcaagcagggtccaactaagaaaacaaaacaaaaataaagaggaaatttaagccagagattatttaatatagggaattcattacttaggtggtggtggaactaaggaaacagcaggggtactgagataagcaacatcttaggtccggttccctagacacagagcctgagacatcatttcttgtacacccgatttagagggagtgctgtcaggagaaactagaagtgaaagaagtaagctagaatgggggaagaagctaggcaaagatattgtttcagaaatctagcctcagcttgatgcgataaggaactctaaagcatggattgaaccacagaagttgtctagtccaaaggcaagggagctgagctattacacccttgtatagtcattagccatccctggggagcaggagggggttggggcatgatctcataatctcccaaacatatttggttggggcaattactgtcagccaagggcaggcctctggagaagagtacaggtgtgagtcattagcagccaatacccacagcagctgggagatggatgcactggcccaggaaaggagatctgggtaggataccaacagcatctgctacaggctacatccagacactatccatatgcttgagaaccatccataagctggagggacaaaactggaggcagtgttactcggtggtaagtgtttaaaacaacaaaaatagtgtgcatgtgtatctgtacactagcttgttataaatttcactaacatgaaggatgtgcagtgcacagttttcattgtaagactcaatgcagcatgctttattgtaaattccacatagccaactaatgcccacagaatgctttcattgagtttctatccacagccaactaatggctgcaattgacaaactagtgtagttctgacatgaatggtggctgctcaaagtgttttacgtatattaaatcacttacccatgacagtctaatgactatcatgaggtaaatactgttatcaatctcattttatcaacaaggaaaccaaaacacaaaacgattatgtaacttgcccaaggttacacacctaataaatatatttaggtctaatgtgattgaaatagagatcatggactaaaaaggcaatgaggctaaataaagaactatattaccacataagctaggagaaaagaaatggaaccctattggaacaaaaggtaagttaatgcccacatacattaatggaaatatgtccaaaaacatttcccaactggttaattcaatggatagttattaagtacctattccatccatacaagtctctgagctaggacctaaagagatatttagaaagccattattcctcttaactgaaaccatcaaatcctgtaaagtaatacaaattacaatgaggcctgcaaatatagcaggcagagcaaatacatccacacattagatggtgtccagtgagtcaggtataaagagaatttggttgcatgttttactagagcttgtcccttggaaacacacaggacacctggaaattcaacttgtgcagtcaactctttcaatgagaaactatgttttcattggccacatttaggagtacatatggtacctgcaaatagtgagacacatacacacacacacacacacacacacacacacacacacaaacccaaagagaaataccataactttaaaaaatgtcccttatatgacataatgtatgaataatatattaatagtgaaaagatccttttctttaatctcctgctacagtttcacccaagaattcccttaatacggcagtaaaagttattattttattaacttagctcttaaacacacttttaaaatattctatgtgactaaatgggaagtaagcaaaatacatttttgctacataccaaagtagacagttgatttgacaataagcacttgtacaactgtttgagttgtaagctacttcacacaactccatttttacttgaaatttcaactgacaaactatgattattcagatttgactgtttgatagacattttctcaaaaatagatgtgcaagcttgtcatttcaaggaaaacaaatgatagtatttgttgtcaatggtaaaatttgttttcaagcaaaagctagaattttagaaaacttatttctgctaagttttaagtgagcctgacagcttttcagtgatgagattggtggtgatattaatagacagatattcataaagtaatctgtaaacatttggaagctctacactactcagtgaaccaatattttccaaatgacgaatgcatgatgttacaaaaccatgcatagataaaaaaatacattcaaagtacaagaaagaccaatgcaagttaattaactgagtacaaaaagttccctgataagttttccagattccacactacaactgattaagaaacaaccacctgttgaagaatttcagtatagtatcaaagaagacaatcaacagttacttaaaaaggttattaaatcatgcctccctttttgagttatctatgtgagactagactttcttcatatacttcaacccaaacaacatattaacaacagattaactgtagaagcagatatgagcatccggccctcttctattaaaccagattaaaaagatttgccaattttctcactatttttttgttttcaaaattgttgattttcattaaaaatgttatttatattaacatgttatgagcttattattcttttataaaaatttttaacatggctttaatttctgacatggcacatatggatactcattgtctttaatgtgagaaaaagacatttaagatctactgaaatttaggcataaatttagagctagtttctagcgggaataaaagtcttactttaaactatctttattctaaccttggctgactcaagtcccaagatagaagagctggagttgggagggcaatctcaaaactaagaggtctacccaggaagcatcctaatctccttggtaccattatatcggaattctaacccagtgatcagatacttgaaggcctagaaagattactgaattgtgtgttgcccaggaactttaaatggcatgcctcccaggagattccaaggtaggtggtcctcagcctacattttataaaacaaagttctacgtaccatacaaactgatatgccagttgccctctcctcaccttatcctccctcaacacttattctggatgtctatgtgactccaaacacaattttacatcattatcttagatgtcaattcctaacaattgcattgaggaccatgtctgcattctgacattggcccctcctttatgttctcactatggttcatgccttcatcaccttccagctggatcagtaggatgaccttccaacggctctttgcacagctccagttaaattactcatacttgtcactatgggttcaatgccccttcaaaaattaagaggtagaacctttaagaggtgattaagtcacaaggacttcactttcaaaaatggattaatgctgttcttttggaaatgggttcatttgaggagttttctccattttctcctctctcttgcatgttctctcaccatgtgataccttctgcacgttttgatgcagcaagaagacccttgccagatgagaccccttgaacttggatttcctagccgtaccgagccaaaaaaaactcctattgcttataaattacccagtctcaaatgaaccaagatacttacctagaaaactagcacaaactatcacaaatatactaatacttgtccagaaaactagctcaaattatatcactactctgctcaaaaacattaagtgcctataacttgaagttctcaaatgacttgatttagcatttatagttctccataatctggctccactttgccattcctaccatgttcctctgttgatctccttagatactccacaaatgagcaaaacgttttgctctcctggaccagacctaaggtttccacccttatgcatttggttttgttatctcctttgcctggagttactaccgtgtgagttgtccccttagttcttgtaaattcaaaccactacatgcgcttcaggggccagatcaaatgttgcctactccaccaagctttacctgatcttgcagctgggaataatttctaaaaatcttctggtctgtttctcttggttctccatgtaacactttctaccctgtagcatagtaatctaaatgcatagttcatcttcctgattacactggaagaaccatatgggagttttgtgcattttcgtgtctgattcatcaccatactctgaccacatctaacccataatggaaactcaatagtttttaaagaattaatcttttatagaatacttattctgatttctcaaaagtagaatgtagaatttaccaagcaaatcattctttgctatacaaataatctatctttttggttgatggtggtggcttgagtaaagttattagcaactaatttttatgtttctggtacatacccagttctgcaaggaatctctcattcagcatctgatattaagaattccttaaacatatttacaatgaaacttcactctactcataggcctttctcagagtcctgtcgtagtatttgaaaacatgcagccataatacagcacgtgctaagcactgtactaaaaccacaaagtacattaacctatgttccttgggatactttttgattctatcctatttatgaacctttatactgttctgatgtccaacagaatcagtacccaagagaaactgaaagcatagaaagaaaaagctgtgggaacagttctggagaaatgttcccttccgtactcctgcaaaagccaacagctgactccttagaagaaccacagatgccaaggggatcacaacttgcatagttccaaatgttttttaagcagctaattcttgagccattggcatgacacaaaaaacaaaacacttttgtggtattctagaaaatctggtggcaagactagaaaagctagtgggaacagctttgctgcaattgacgttgaccaaagcaataaattgggaagagccaaaatggagacttcctggctgacagaaagatatttgttgcatacccaggatgaaataagatcttttaataatgcggaaatgctactgctttctagcacaacttgccaatttccccaaccagtattttttcttttttatcagaaactttaacgtaccaatcctgtgacaaaactgataaagatgcaagaggttctagattaagacaaactcacggaaaaagttaaaaaccatctaatgtctcatcctatatagcataaagtataattagagtcacatactataagccttgatgttcaaaagtggaatagtaaatttgtccctcactttgagtgttttttcgtctgtgactaatcagacctcaaaacaagttattaccatatttactcacataacaaaattgtaagagaattatgcttgctctgcaatatatgactgcactcacatttgctctttcatcttttaactgtctctatgacattctttttggaaatgcttatcagagctcttaaaatgagagttccatttctccacctggcccattccctttgatctagttgttgtccccctattgatgacagaaggccacccagcatcatgttcaggctcaagcataaaatagtgaatggcaaagaaaaagtctagatttcagggaggtgacatcaatgtttaattttataatgtgcatatcgaattatgtaattagataagtcaatgcactttataactcataaataaatttgggcagctctaagtttagggatcaagtatgttctaaaactttccaaagcttctaatttttttgagaattcagtacacaattttccttgaaaacaaagcagtgaatctcaggagtgagattcagccctgaaggacagaatgatggtagagtgatgaacagcatggactcttactgagttcaaagcctggctctgccacatatcatctaagtaacatgaaaactccgcttaattgttccaagcctcagtttccctctcaataaaagagaggaaaataataatacttaattacctcataggattgtgaggattaaataacttttttcacacagtacgtagaatatgctaactgttcacaagtgttaactgtcattttgttgtggatgttactattatcatttgtccaccatttaagcctataactcacagaactactgaacgaagaactaactcaagttagctcagtacctggaagtaaaaggctaccagatgctgaacaaaagaggcaaagaatagattttctgtaattcctgagaaaaccaatgttataaaaaaataaaccaaagtttttacttgggacagaccctttctttttctgttcaactaactttctcctatgtcctgtatcaccttcagactcagtattttataatctccagtttcttcctccctcattgctgtctagatttcttcccttgactaacaccaaataagaaatttctccccttcagacaaaaacgcatgttctttcagtacaggtgtcttcaactagacatgaacacaaacagcatgattagtcgtgttaacattcaggtgacacccttatgaaaaccaaaactgatcactaatacaaactggttttgtccacatgtgcacgtgcatgcgtgcgcaatgtgcgtgtatacgcatacctttgagagatgatgttacctacaaggctgacatacagtatacatacacatacatataaagctattattacactttatgacatttctctttcttttgttataaagcatagataaccaaaaattggtactatttttttcagcggcttgcatggttgcacaaataagagctcaggcagcatgggttaaggcagggggtgccatttgtaggcaagtactcttctttttttctgtcaagtagatttttaaataaaatataattgaattgtgaatacaagaaaagcaaacacaaatctaagcacaaaatgggctttttcttaataattcttgtaactgtttataacccactttttcagccttttcacagcttttgcttaagcattctaatttcactggttacctgtctccatagctctactaaataatttttataaaataccccaagattctcatttgtgctgttcatcactgtgtctccagtatctatacagaatctggcacagagcaggccattgatatttattgattaagttaattaatgagtgaatggggagtgattatgtaaactatttacccatcgattcgaggacaagaagtctcatttttatatagtctaaaagaactcttactcacaccctctcttctttttatattccttttttttttttttgagacggagtttcgctctttttgcgcaggctggagtgcaatggtgccatctcggctcactgcaacctctgcctcccgggttcaagtgattctcctgcctcagcctcccaactagctgggattacaggcacctgccaccacactcagctaattttttgtatttttagtagagacagggtttcaccatgttggccaggatggtttcgatctcctgacctcgtgatctgcctgcctcggcctcccaaagtgctgggattacaggcgtgagccaacgcacccggctccttttatatttcttatctgaaatactgtttcttctctctgagcttctttctaaagcggtacagtccctttttttctattctcagaagcaagcttcccctttgtgttttgaaattgccatttttaaagaggatgctagtaacatgatcatcctatttcagacaattcgaaatgaatagtttctatgagtgaaggtggatgaatgaaccattaaaatcatgtcttaaagtgatcagacttccctctttacacaattactatatattaaaacaagactagcccactccatcacatataccatcaagcaggtttcttcatacttaatcatatcactaaatcagtcattgccaaccttctatcttatgctctggaatgcatcttactgtctcaagaggcaagtggaactctcaaaatgaaattaattttaattaactttaaaatataagtgttaatgtgtcatacagcacttggaaagagaaggttatacaaaagagagtgacacagcattaaaggagtagggatcaatgcactagccaaaaagaagacaaatgactttgaaacattgcctgaggttaagcacttcacttccaaatacagtttcccacgaagaacacactcaggagaaaagggagagagacagtgtaatttgaatgatgttacacctactgtctaaattttatttagattaggatagttaaagactatatttgcctgaggacagagaataggctacatgagaagagacatttattgggtatccagtaaggttccacagtgctgaattttcttacaattctgatattagattaggacttattttcatagttgactgataagaagatatcactcctttcatgctcttcttattctagacaggtcgaaacagttatagggcagcacatataaaagtatgttaatctgcttaagcttgtaattctgacataggatcaacgtccattttttaaaaatttgttttaaacacatttatcataggcttgctgctgttctgaatattttttcttatatacaaatgactgaccacagaaaaaaatagcaaagaaaaaaacacattatctaccacacctccactctttggtttgtattcttcaagattttgtctctttcttaattagaaaaatgaggattttactacaaacctcaaaaatcagatcattctattcaacaaatacacaaacacagtcttagcaaaaatcaatctaaggtcatgcaccattgttaataatagatatataaaaaactttagaatgacccatattttgtattttcataaagccagaaaccacatattttctttctttatacttgccataatggcatcataggtgctcaatgattttggatttaaagaaggttaggaagagcatagtcattccaagctaattactaaaaccccacagaaatgttacatggtgaaggctaccccttcatgtttgtggtaggtagactctaagatgacctccaatgatccccacttcttgatattgacccctggtgtaatctccccttgagtgtgagctggcctagtgccttgcttctagccaagagaatgtggcaaggtgatgggatgtcacttccttgaataggtatcttctgtcttgctatcagattctctctattgcctttctggtaagcaagttttttgttttgttttgttttgttttttttttttttgagacacagtctcactctgttgccaaggccggagtgcaattctcctgcctcagcctcctgagtagctgggattacaggtgtgcaccaccacacccagctaatttttgtatttttagtagagacggggtttcgccatgttggtcaggctggtctcgaactcctgacctcaggtgatctgcctgccttggcctcccaaagtgttgggattacaggcgtgagccaccgcgcccagccccagtacgcaagtttttatgaagcaaactgccacactagagagtcacacatggcaaggaattgagtgtattctctcacctaggaatggaggctgctaggaaccgagaccctcagtctaacgctgcccccacaaggaaatgaaatctgccaacaaaaacaggaattagaaagagatccttttatggatgaataatattccattgcatggatataccacactgtttatctgttcacctgctgatcagcatgtgcgttgcttccatcttttggttattgcgaatagagtggccatgaatattggtgcacaagtttttgtttgaacatctgttttcaattattttgtatgtattatctacaagtggaactgctgggtcaaatgttaattctatgtttaacttactgataaaacgtgtgctgtttaagtccccaaatttgtagtgaattgttacacagcaatagataattaatgcaaagtttaaaataaatttgcagctaggtagaaattcccaaatgtggattaatgaactacagggagaaaaaaataataatttaccattggtctgactggcgactcatgattcccccagtcaatagtatttactgcattctcaaaatacttcttaaaaagcaacattaaaaaaattgctatgagggtttgccgggtgccatgtgttgcgctgtgctgtactgcagagattttttttaaaaaagaaaaaggcacagtttccaccctcagagtgcacagatctccaattaagaattacctctgctgatattctccaaaattctgttcatcagcttatttcttctcttgttgtacatcctctttgggaaagtctttactcacattgtttcatctacctctaatatcacgaaaacactcagttcaaatgctctcatctaattttctcctgagcaccaatactcttacttcttctatcatatgttcccttctagatgttccccaggaattttaaactcaatttgtccccaaataaactaattcttgctatgcactcttttccagcccaacctcttgaattccctgtcagacttagcagccaagattgaaactatgaatcttaagtcattctttaccccttatcctttattcctaattctcaatcaactgcccaacttacctctcctctataacccagtgtaattgccaagctctttgaaacttttaaaacttctctgctatgatttgaatgtgtcccccaaaaagcatgtattgggaacttggtcctcaatccaacagtgttggggggtagggcctaatagaagttgcttaggtcatgagggattcaccagcacaaatggattaatgctgattataaaaaggcttcaggctgtcagttcaatctcttactcttctgccttctgccacaggataacacggcaagaaggcctttgccaagtgccaatgccatgccttcgaacttcccagcctccagatcttgagctaataaacttctttttttaaatttttgtatttttttaatttatttttattttattttattattattatactttaagttttagggtacatgtgcacaatgtgcaggttagttacatatgtatacatgtgccatgctggtgtgctacacccattaactcatcatttagcattaggtatatctcctaaagctatccctccccacttcccccaccccacaacagtccccagagtgtgatgttccccttcctgtgtccatgtgttctcattgttcaattcccacctatgagtgagaatatgcgggtttttgttcttgcgatagtttactgagaatgatgatttccaatttcatctatgtccctacaaaggacatgaactcatcattttttatggctgcatagtataccatggtgtatatgtgccacattttcttaatccagtctatcattgttggatatttggtttggttccaagtctttgctattcccaaaatctccttaagctgataagcaacttcagcaaagtctcaggatacaaaaccaatacgcaaaaatcacaagcattcttatacaccaataacagacaaacagagagccaaatcatcagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagagttggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagcaagctgaaactggatcccttccttacaccttatacaaaaattaattcaagatggagctaataaacttctgttcgttataaattattcagtctcaggtattttgttacaacagcacaaatggactaagatgttcctctggctgtttttcctctgctacacttatggcttacctagaaaattcttatgcagatttcaagcctgaacccaaacattatgaccttgtgaagccttccttaattttattttttataagactactttctctatccattgtgatcctgcagcaaactgattatctcttcaatttcaaaagctagacacacaacaaagcatcagtttttacatgcctagttctttatgactgttgtgggctgacagatttctgcacttatgttctgagaccaatttttctggatattttaggtagctaatataggaatcaacatataatcttcactcaattcatgtgtgctgaatttaaaatagccatctgatttatattatgattcacttaatcaactaacaagtatgtattgagtagcttctatgtatcagacgtaacactaggcataaggaatatggtggcaaaccaaatagacatgacccctgcctgactcatgagctcacagtctcacaggtcactgagttgataatacatttatgacactatgtcatttaggcttcaacctatctctgagcaacacaagtatttcctatatttattattttgattctttttttttttttttttgagatggagtctcgctctgtcgcccagactgtagtgcaatggcgcaatctcagcgcactacaacctccacctcccaggttcaagtgattctcctgcctcagcctcccgagtagctgggactacagatgagtgccaccacgcccggctaattttttgtatttttagtagagatggggttttaccatgttagccaggacggtctcgatttcccaacctcatgatccgcccacctcagcctctcaaagtgctggattacaggcatgggccacggcgcctggccttactattttgattcttaaataaaaactggaaaattaaatttcttttcagtgagttataagtaaattttattaccatcattagcactgcattaaaaacaacaaaaaaaccaatcccttcctgatacctttcaacatatatgactgtttgtatactatctaaatcgaaacatctaatatctaaatctgaacattgataggatgcctcaactatccagaagacagctaaaaattaagaaccatgggacagccaacagaaatgtctccaaattaataacctaaagctcccatgcttaacattctaaaaagtccctcaggtccacacagaaacctggcatagaaaaaaaagtgatcacaatttcttggctccctattcagagcatattagaagtagtaaatcattatgtgggtgatggaagagagagagaatctgccagaaacaggcacagagacagtagcaagaagagatagctacaacagagactaaatcaagaaattaaaaaattaaacgagaagagataataactatgaaagaaaataaggcacagaacagaaattaaaagcgtagcagttcagatttaatgtagcatgcaatagccacccactttcccaatagtactgtagggtttctgatgtccatcaaataaatgatgaattatattcctggcattttcatttattatcatttgaacatataaatgtaacaaggaaagtctgatgaacgccattaccaacaatcctgtctaatccagcctcacctcacttcctcctttctattattttaaagcaaaccgttaatattacatactttcatctgtaaatattttggtatatatctaaaagatgagaattctttttaaaacatagccaaagtaccatcaatatatgtaaaagaaattaaaatcaattgtaaagtttatagcccattttcagcattaaaatgtcttaaaatattggctggatgtggtggctcatgcctataatcccagcacttggggaggccaaggtgggaagattgcttgagcccaggagtccaagaccagcctgggcaacagagggagacctcgtctctacaaaaagtaaaaaatcagccagatatggtggcacatgcctgtagtcccagataattgggaggctgaagcaaaagaattgcttgagcctgggagatggaggatgcagcgagccatgactgcaccactgtactctagcctgtctcaaaacaaaacaaacaaacaaacaagcaaaaccataaaatgtttaaaaatattaaatcaaaatatatttttacattcttaattttattggttaactgtcaagagagatttaaaaaaagtgttctgggaagcactctctttcctaatgcaacacccagtgacgatgtggcatcattaaattatgatattttgctattgaaacttaattctttaatcaaggaaaatccttttacagaaaatcattaattttgtttagtctacaatagctctttcagatttaaaagttaacaatgtaatttattattatttgagggccacagactaattccctgaaagtgttatcagaaatgatatattattaacttattaggagatcataggctatcgtgagaaaacttcatgtcaaaattagttgtattagtactgagatgtaattattcttcaaaagtatcataaaatcaaaaacaagtagggaaaaacaaatacaatgatacatacctgggaaatatagaattgatttttggtagccaaaacttaggtagaaaattaaagaaccagggacacaggtacataatcatctcttctttcaattaaaagccatggtttgaaggaaacttaaatgaatggcactctaggtagttgatttggaaactaggaacctatttggcacatctaaggaaggatgcgtatgtatgtgtggaggggagaaaatgggcagaacacaaaacagctttaaattgaatttgagagaaatgtctagatgaaatctgaaactacaaatcttatcttcttcctaacttagatgtgccttggaaggattacagaagtgctgagatccctgtagcccttggggtgtccagtgggacctggggcatgctctccccatctcttgtcatcacctctagcagtaagcagtttctgtttatcctaatataccattaaaatattatcattttcaatgtttgataatgtgaaaaaccttgcaaagcattagtccaaagagcttattagcctgtcattcaaggctcttgatgatttgacccaaatgacctttctaaccttgaatcttttcacaccatttatgaaacgtttacactggtcaaaatgaactgctcgtgttttccccttacacccttcatgcttctcaactgctgttgcctctggtttgaatttctcctcctcctggggatctactttttccctatctttatattttcaagtataatcgattcctaagcctgcattaaatgccatctgtaccacaaaacccttccttttactgtatttgtatataatcttttttcccccactaaggagccagagtagtcagttatctacagtttttaatgtcatgcgtaactttctattttgtaccattgttacttatgtaaaatgtttttagtttaccaactagagtcaaagttctttgattgcttaattcaagtaaatttactccagcactttctgagaaacttttatgtgccaagtactatactaggtgcagaggataccacattagtgtggctacactatcaccagaattactgagtattgtttttaaaattctagcccagctactcgggaggctgaggcaggagaatggcgtgaacccaggaggcggagcttgcagtgagccgagatcgcgccactgcactccagcctgggccacagagcaagactccgtctcaaaaaaaaaaaaaaattctagccaatatgataaggcagaaattagtaagaggtactgcaactggcagggggaaaaagtatgattatttatagatacaaacccaaaataattaatgagaaaacttagaactaataataacatggttccataaggtgataagaaacaaaatttaaatgttttcaaatactttgataatacattaaaaaacatttaaaaatccagcaattttaacaaatattttaatatgccaatatgtacatggaaaaatatcccaatatgtatatggatgaacacacaaacacatacgcatgcaggcacagaaacaaaatatgtcttatactaccatatagtataagaaatattttaattctctccaaatttaatgaatatgtttattaaatatatttatgcatttaatataataaacattttaatctttccaaatttactattgagtttaagacactaccagtcaaaatctcaaggaaatctttaacccaaaatttcacctggaaatcattaacccaaaatctttcatgcaaaatttcactaaaaacagtcatatttttaagagcaaaataatcaatagacacaaattacaaaggagatacaaacataaagaattttaatttgttatttaaaaaatataaactaaaattatatggtacttttttttcttaagtgaaagtaagtttattaagaaagtagagggataaaagaatggctactccatagataggggctgctggttgccatttttatggttatttcttaatgatatgctaaacaaggggtggattattcatgcctcccctttttagaccatatagggtaacttcctgatgttgccatggcatttgtaaactgtcatggtgctggtgggagtgtagcagtgagaacgaccagaggtcactctcattgccatctttgttttgctgggttttagccggcttctttactgcaacctgttttattaccaaggtctttatgacctgtatcttgtggtatggtaccatttttcacttatccaactgcctaaaaaaatctaaacgataatctgcaacaatatgaaagatccaataacaaagacaatagaatgtatttctaataggaatgtaaatctatgtaaattttctaataagcggttttgtattatgtatcaagagccttacgatgttttaatcctgaattttctgtttttaatatctaatctaaggaaatatttagaaactcaattcaaacataaacttttaaaagaaaatcagataaatactaagtgccagatctataccaaattacacaggacaacacaggcatatagaagatctgggaagtgcctaccaaggacatagatactgaaggttaaattattttatcattaatcatcagaaattgtctaaaccatattaaagagtcgaagttccacacaagtcggattcagttaggaatactgacagaggtactgataaaaatgagttgataaggaggagggtagatcagcaatcaaaccccgaggagagagaaagtggcaagtgctggcagtaccccacacaagtattatccatggccaaatacgtgatttgtccagtcttggtagcaggcatatcgctattaacagacacactatcagagccagatgccattagacatgtggccgctataaggtcctcagttctgacaaatgtatacctgattcagctgacagtttcatagcaaagaaggataagaaaacaatgacaaatctaagtctccaaacttaattgtgaccatcaaagaagaaatggttactatgttattctagagactacactaccaaaaatgatcatttaccctagactgtagaaaggatttcaacctaacaattggaagaagatgagaaggcggagaccatgaatggtcatccaaaacaggaagacagttaaaggaggataaagctatcagaaagggaaagattagaggctaaaatgaagttatactcgcaaaaatgttaagatcagataagaaaaaaaactagagagggcataaaaagagtaactttgaaaacagttaagaggaaagtaaatttgcagataggagagagtatatcaaacttctttaagttaactcaagtctccagatccagacagattacatacaagatagcagaaaaactcagatgtaactgcaaaactgctctgagcaatgttatgtaaccctggagaatgggaaggttaccagatgattggtgataggcaaatattgccccagatttaaaaactgggatcattgtgaaccaccatgggttcactaagaataaatgtttctaaataattctcagctccttttggactgacttgctaggttggtacatttggggaataccatagtatgggatcatttcaggaaagtatttgacaagtctcttacagtatccttgggaaagaaagaaagaaatcagacggcagtagttcggtagctttgtagctgatttaactgacttacccccaaattcgtggatttgtgccaacatgaaaggggctaggtcttctatgatttgcaaccaatcttggttttcacagcacttcacacgtaactctactatagcaattatcacactccattacagttttataattacatgtctattattccctatagcctgtgagctccctgaaggaatgattagctttttttttttttttttttttttttttttttttctgagacagagtcttgctctctcgccaggctggagtgcagtggcacaatctcggctcactgcaacctctgcctcccgggttcaagcgattctcctgcctcagcctccagagtagctgggactacaggcacgcaccaccacacccagctaatttttgtgtttttagtagagatgaggtttcaccatgttggacaggatggtctcaatctcttgacatggtgatctgcccacctcggcctcccaaagtgctgggattacaggcgtgagccactgcgcccagctggaatgattacattttatccatcttgttatttctagcagggagcctgagattagcacagagtagacagtctgatacatgtttacatattttaattgaattaaaaagttgaagaaattattttaatatttacagatgtctcaaagctgaaaggaattgctaatatgttggatgataaaagaaaaaaagccaaaaagttcttgacaagctggaacaatgagccagcacttacacaatgaaatttaatagagatataagtaatgtctggtacttggaataaaaaaaaaatcagctgaagaacacaatgggaaagacatgactaaaaacagctggatgttttgacagcttatccaacatgggccagtagggtgctatgattcgtgttgttggcatgaaaagaaaaagcaaacctaaaaagagatgaatatcactggtcagaccacatctatagcatcatgcttctaggcacatattttacaagggaccccacaatttaatacttctccaggagacaaggaggatcgtgatagacctggagaccacatcataggaaaaatagttgaagaaatggaagataattagattgaaaagtgatccttcagaatacatgacacctaaattcatgtttcccaattactatctaggggagctgtactatttgttagtgtggctccacaaggcagagctaagattattttaacaaagaaacagagagttgcattttagtaaattataatgaatgataataatgaaaactcttcaaacatggcatatatacatactttctgagactgacttcctcaccatgcaagtactcagtttgggactgttcagttcagtcacatgccagagatttgaaaacagcaaattcctatttggtgtaacaggtttgagcaagaaatgtctgatttaacaaatatggtttcatattcttttatgagataaaaactgctggaaggtagaatgctattataagactcatttctgaaggagactgcatacccaactttcctgacactgcttctgagaaggacaggttagaccactgcccactgcagcaaatgcacccatagcccactctgagttccagagtgatggtagaaaatctggaaaacactgccttgtctcatgtggggcagagtttcaagacagcagaaggcaagggagatcagaaacatcaccttgttattcaggtaaactgtaaaagtatataaaaatatataagccatcaagaacaatgaatttataagctttattcccactctctttgtatactgactcccagattcattgactcatttagtacaattttatcagcaaaaaaaattttaaaaatgactacttaactaatggataatgtatatttaatatgcgattttctaatcatccttcaaataccttcaatagccagctacatcatgagagatatatctgcatgtttaagattaattcaaattataaggagaattcaaaagtgaattaaaatgtgacttacagccagtaaaatacaagcaagtcaatttttcaatgcatcttgactaaatgtaaaatatcatctgtttttgtgacaaacaagtctgtatcattaatcatatgcttccagctgcaacagctcgcattcaaattaaaaccatgaaatagcatcacagtgtcaagattcacgcaaactgatcttttaacagattgtgagggaaaaaaaaacatacattaaaagaagaatctggagaaaatgttacacaataaaaacatctgaaagagcttaagcacacaagatagaattctggtttttgaactgtattggaattaaatgttaaacaaaactcacagcctgctcttaaacaacgaacacatcataaaaaataattctttttatagccacagggctgagagttttgctgtttatatctatcccagcatacaaatccatagtactgccaggactgtcccctctgactttactgggaagctagacaggacagtctgcctgggttttttttttttttttagtttagttcagtttgtgtccaaaactggcccaagaatcatctcttcttcagtcactacactcttgcctgccagttgcacagctccaaacattctccttccagctacagatattaaaatgttttgttgttttaaaatttgatttagaactgcagtagataaccttttttttttttttgcttcaggctcccctaggtcagcaaggcatagtaatgttcaaacagtgcaacagcagccactcattgcacattaaaaacaaggatggtgccaggaaccagcaaagtgatatattctaggttagccatgtcaggcattttccagtcccaaagcaggtttcatatggtcagcacatgggccaaatgatgcacatggccgtcctgcacttgccccttgtgtcctcctctggtgacctgccccattgaactccctggacgagattcccagcgatgctatgcaaagaggacatgttcctctgagagtattttctgcattagggctcacattgtattgccatgggactttacacttttagggtataacctgacatgccacaaccttttcttccactcctcagttgacacctctttaaactggtggcccagccctagcctagtacacataaaaacgataatagccactctgccaatcaaggttaatatttcagcttctctaataaacctggggtagacaccatgatacaatatataaaaacaagaaaagtaaaaattcagaactttatctcaaaattgtgcaggctcttacctactagatttccttatcttgtaaccatcatttctttgttcttttgttccttgttcacagagatattgttccagatgataaatggaggagtatgtaagattttaatttcatcacagcctataaagaatattcccaatgaaatttaatgtgaattttaaattgtatattatagttgggcatggtggatttcagaagctttgaatcccgtaacatggattttaagagagaaagctttttttttttttaaaggaaagtaggatgaggaaataatatgaggagaacatgcagtgactaatcacttacaaaagagaattttagagtcaaagtatgccttagaaatggtctggaaaatacgcagccaaatcaaataacttaatatgtattgagacttcaatgtttacagaaaatttgaaaccttttataaaaccactaattcttttgtaatgctacaaattacttaataagagttactaatgtataaatctctattattatatttaggattttcttccagaagagtaccaccacacatcttaaaataggaggatctcgatccaggtacagtggctcatgcctgtcccaacatttcgggaggccaaggtgggagaatcacttgaggccaggagttcgaggccagcctaggcaacatagtgagaccccatctctaaaaaaataaaaataaaaattaccaatggaacaggatagagaatgcagaaataaagctaaacgcaaccaactgacctttggcaaagcacacaaaaatataaattgagaaaaggacatcttatttaataaacggtgctggaaaacaagatgaccagatgtagaagaacaaaactggatccctacctctccacttacacaaaaatcaacccaagatggatccagacataaatctaagaccagaatctgtaagaattctagaagaaaacctaggaaaaacacttctggacattggtctaggcaaaggatttatgactaagaccccaaaagcaaatgcaacaaaaacaaaaataaataaataaatgggacctaattaaactaaaaagcttctgcacagccgaagaaataatcatcagagtaaacagcccacagaatgggagaaaaaatctgcaaactatgcatccaacaaaggactaatatccagaatctacaaggaactcaaacaaatcagcaagaaaaaaacaatcctatcaaaaaataggcaaatgacatgaatagatattcctcaaaagaagatatacaaatggtcaacaaacatgtgaaaaaatgcccaatatcagtaatcatcagggaaatgcaaattaaactcataagatatcaccttaccccagcaagaatggccattattaaaaagtcaagaaaaatagatgttggtgtagatatggtgaaaaaggaatgcttatacaccgctggtgggaatgtaaattagtacaacctctatggaaaacagtatggtgatttctcaaagaactaaaggtatatctaccattcgatccagcagtcccactactaggtatctacctaaaagaaaagaagtcattgtatcaggaagacacctgtacacacatgtttatcacagcacaatccacaactgcaaagatatggaaccaacataagtgcccatcaatcaatgagtagataaagaaaatgtggtacatacatacatggaataccactcagccattaaaaaagaacagaataatgacttttgcagcaacttgcgtgaagctagaggtcattattctaagtgaagtaactcagaaaagacaaaccaaatactatatgttcttagttataagtgggaactaagctatgggtacgcaaaggcatacagagtggtacaatgaactttggagacttagaagtgggagcctgggaggtgggtaagggataaaaaacaacatattggttacaatgtacactacttgggtaatgggtgtactaaaatctcagacttcactagtaaacaattcatccatgtaaccaaaaaccacttgtacctcaaaagctactgaaataataaaaattaaaaattagctgagcatggtgatatccacttgtagtgtcagctacttggaaggctgaggtgggaggatcacttgagcccaggaggtggaggctgcagtgagctgagatcgtcccactgcactccagcctgggcaacagaatgagaccctgtctcaaaaaaaaggaataaaaaatgacttttaaaagtattttaagtatgttcagagatacacctaaagactttaagcatcttttctacatttctaaattgaaagcatactcattttggatcttaaccaatcaccatttaaacaagttttcatctgctccagtagagataatttcgccctacaacttgataaatgtttgcaaaatagacaactatatatgagtaacagcaaagaaagcccaaatttaaaatctatcaatgtatctatctgactactatccatcttaaagtccacagtagtctgacaactaagcgtccaagaagtctcctctgtgtttttaacttcctggattatagtaggtctctcttaacttactggaacaaaaagggtgattaattgatatctaaatacatttagaagattttgaaagaaaaaaaaaaaaaaacaaggcagcatgtgctctgtccctagttcctgaagtatgaattgtttattataatatggtaatcccactaccagctctggttgtaccaccaactatgattttgaaataaagggtttaaatatatatatatgcgtgtgtggatagacagatagatagatagatagatagatagatagatagatagatagatagatagagatagagatagagatatgcttacacagcccacatttaaaatctaccattatcttaaagaaaaagaacatgatagtggtggctcccactccatggagatcactgatggcaaagtacagagtgggaaaacatatttatgttttacccgcttggcatattataaatagaacaatctcaaccaggcattttgccaagatgtggaaaaatgaaatgaggcaaaatgcaaatggaaaataaaattactttttatgccaaaataaggtctggatggaaaactttaaccaaagatatggtctggatatggtaagacttatagaagatcagctgaagatgatttgaaactgcaaagattcttgaacaacaaaaaatggtatttcattacccatacacaaaacacaaactgtctagataggaattatgctaatatattttggaagcagatgctttctaatatattttttcaccttaatgtcattaccgttttttccccaacctgctcctttctataagatctgcactttgccaaatgcagaatcaccaacacgaataattattataaatataaccaaaatggttgggaagaaaatgttatatcactatggttttgagtatcactacggcatgaaccacaactgggttatactgagaaatctctcactctttatataatgaatctgtcatttttttttattaactgagtgctgctgtacacagacagatcaatctgtcttctcttattagcactgagattttaaaagtctacacattaagttaattgatttgataatttctttatcttagagtttgaagtgcttacacatttaatcttaacaattcagctatatacgattacctagaaactgacggttttctttccgagtcctttcccagtcactttcatcttttttcaagctttttttaccttaatctgtctagaataaattttcattggaaagcaatccaagaaaagggccaaagtctccacaaaacacaatttcaacgatttttaactggagataattaagagtatcttttaattttgcaagttatagaaatatttttaatagttttagtgtggtataactgacacacaataaactgcatatatttaacatgtacaatttgacaagttttgacatgtatacatggtgaaaccatcaccacaatcaagataataagtatatccagcacctcaaaagttttctcatgacccttttaatctctctctttcacttattgccatattttccttctcccactcccaggcaatcactggtctttctgtcactaaatatgagtttgcattttctaaaattttatataaatagaatacaaatttatctcagtaggagaacactattttattttgcttggcttctttcactcagcataattattttgagattcatccatgttgttgcatgtatcaatagttcattcactttgattactaaatagtattctattatacagatgtactacagtttgtttatccattcaccaattgatgacatttgagttgtttccagtattgtgttattacaaataaactgtgtacaagattttgcatcgatgtaagttttcacttctcctaagagtggaatggctggattatcaaattggtgtacatttacctttttcagagactgttaatctgttttcaaaagcagttgtgccattttacactttcaccagctctatagctacagtaagtggaggagttaaggtcttcaaaccctaactgattccagatcctatcttctgtaggctccatttttttctaaattagacatcagctttggccagaatttggatgacaggagatggaaatttaaagagtggcatgggggaatttggattataggagataggaatttagggagcaacatgggggagtttgtctaatgacaaaaataaaggatgctcacagcctggggaactaagtaattcctatctcattggtaccaggagctaacctagacgacagagacaaagtaaagatcagtcagaaagaacaactcagaacagaggaccaaactgagccacgagggttgatcagtgacagcccatgctctcctggactcaccttgctggcccattcatgcctgtggcctccctctccaatgacctcccatcacccctcataaggacaagatgctgtttactttccatccgaaatgactgtggttccgggagttgttaggaggccaacgtgttccatgctcttatgttaatagtgtggggataaaaactaaacaaaggaagcaagcatctgacaataaatgagtctactggaagtgaaaaaaaaatccaatttaccaattttccttttatggatcatgctttggtgtctaagaaatctttgcctaacccaaagtcacaaagattgtcttatatgttttctactagaagttttattgttttaggttttaaatttagaccttggatccattttgattcatgacacaagactggagtacttttaaattttgttggctgtgccattatttttgtctatttgctattaatttctaattttactggatattaaccagaaaacacataaaatatggtcacatgtgtaaacattatatggataattcaaagaacatatattttctatttgattataaaaatatacaattatcaattagatcaagtctgttaattggctatttaaatcctttatatatttttatttatttgatctgttatctgctcaaataaggagagctaaatttccctactaattgtggatcgatctgttgactttacatttctcttagttttagctttatatagttcaggattatgtagttaaatatttaaaggttcatgattacttagttatcttagtatatcaatatgaaatctttttctttagtctatttaatgatctttgcttgaattctatttcatctcatattactttaagtactttcttttttatggccttttttaagggtatcatttcctatatatatttttaccttaacctatctttttttgtagaagtgtcttttgtcaccatatatagctgaatatgtaatatttttatgctatccgtattagaaaagggaatttaatctacttacatttattgtggttattgatacagatatacgtgttttctatttatcacaacttttttgattgttttatttctttctttcttgaactttgctaaatgtatcaaatattctttgctttttgtccttacagtacatttcctttcttaaaaaatctttatgctttaaaaaaaaagttatggaaaaaaattcatgcactacagataaagcaaaatttgtatttgatcccggtgaactcttactccgttccctaagataatttattatatgagctgaataggtaaactttcaaaactttcttaaaaattcatttatgaatatatcatcctatttttattatcatgtttattcttaattgcctttaagacacataaacttcaatttttttcttctttaaatcataatctataccctaaataaaaaaagaacataatatacttttatgcttgtttctctttacctgaccctgccatcttccatgttaaaatcagaaataaagctattttatgtgtgcatgcatgtgtgtgtgtatgtgtgaaagagagagaaatcgtaattaatagtttatttttgtttataatatttctaagtatggttattttcttattaattatatttggaattgagagggctcattacatctaaatatttttttttcatattttatgctttttctcctactatttctttgataattttgtcctttccagtttctcttttctctaagagaattacagggatgctagaacttctgtaactattctctatgtctctcaaatttttccccacatttctgaagtattctttttgtatgtcattctgaaaaagattccctagttcaatctttcatttccctaatttatatgtgagttgtattaatgaccattttcattttaaattttaaagtcaaactttaaattcttaatttctgtgcttgagtctttttcatgaatacatctctctgaatgtcttcttctgatcactctattacctctaggtccttgaatattttttcttctcatttttcatttggcatctttctttcatggtactgatttacttcatattgcggtgtgtcataattatatgctcatcttttgtttgagaatctctgtgtgccagctcttttgtttaccattgtctgtttccagtgattaatagggacagacaagtggcttgtctcctgtgtgggtgggctttctaacccacctggcagtcagcacattactgaggcactgccctacctctctgggtctagcacccacactcaaggatttagtttgtgggtaaacacagctgctatccactacttaacacaaggagaaaagaaaaataaaggcacagctccaaatgtggagctccaattaataactctgatgagccctttgattaataatcctgacgaattcctcttttatttcgtgtttccattgtctgtacctttagctttgtcttgctttcttttctttgttgaggatttaaatctatttttgttatagatttaatttattgtttcttttcttaccatttttttcataaaatagaattttggctatggaagaaaaatataaagacatatataacaaaagacatttaaaaaaacaacttccaattttcaatcatgtacgttgcttaaatttaagggcttcacacacttgtaccaacagtgataattaactttacataaattcttcgcattattgctgctcacaatgatgccataaataccagggaatttcaagattaaaataatcaagcatcttcagtagaatctttcaacaatactttggaccgcaagaaattaaatgcaacaaatttttgattcctcaaaagaacactactcagatctattttaatcagctttgaacgtgtcagagaatcaatctagtctgttaagtgataaatagctataagcatattacctcttcaacagttgtcgagttgccattccatttatgggaatctagttttatgtttttctgagaacttccataatcattatggccaacatcactctcccaccgaagtatacaaagaaacagtctcagaggatggtgtgtgtgtgtgtgtgcgtgcgtgtgtgtgtgtgttcacccacacctgggcatggcagggattgcatcctcagggcctggcatggagttggtattcattaaatattcactgaagtgaattaaataacaataacaaaacaaccttttgcttgtgaagtgtctagcattactcttgcatcttgggtcataatttggcaaatttccctccagcttgaaactgctgagatattttatactatagtacagtgaacccttaagattatggtttgtttttcaatgattcataaatctccaatcttgtttcatctgtaaactaaacttagtgtatctccatgacttttgtctcatctgtcccttttcgtagactcttttcctctgtgaagtctcctttctccttcctatatgatcctaactgcatcttatactcagtcttgttacaggacttaccacaccagactgtaatgcttctcaaggaaaacatcagagtgataggaactttgtcaagttagtattagttattttttattttatgtatataccctgcctcacaccatacacacaaagagctttgagacttatccaaatgtttactgtacaaaaaaaaaacaaaaaacaataattgaagaacccaggatgaaagaaaaatagagtgaacaatgctacataatcctgtacagaggttagaggtaggatctacgatttgtaggggccaaagcaagatagatactatgactttcaagataaaaataaactagttacgttatacttaaacaagagaattgttatcagcatcttcgactgctggaaaaaaaaataagtagccttggaaaagttaagtgcgccctgcccaatatcccatggcttgttttgttagaggaaaatactggtctcttgacttccagtgctgttgctgcactaccacactgaaactaaatacacagtgaaaattagttgctattatggcaatccctgggagaaacaaatacttattcccttgtgagggataggaagttaaactaagaacccaacacaaatgttctgtgaggcagtttagtagagctggaagatacgaaatgacctgatggcccctgaagaggaaacagtggtgcagcagcaaccttcagaggcacatgagatcctcattgccaggggggtcaaaaggccagaaaaatcatttctagaacattctacatgtatatacagtcttagaaaaagtggacccttaagtgctatactagactatgactgggaagataaattttttaaaatttcctaaggcacttctccagaagaaaacaaaaattaaggtcaggtctacctcagccagtaacagacttctgggcccctagattcatttatttggctctgctgactgtttggctcagttttcccttagcaagtgtaaaaaacacttaaacaccaccaccctgggatcctattcaaccaattcagatagctgtggccttttaactcacatccaagtgacttggctttataccaatatcatttcccctagtataggctaagcctaagtgagaaagtacacagctcagggagccaggagttaactggctgttctcattccaaaaaggcctggttcttttccttgataaggaaacaatattatatcaagaagttgcggtcattcagtattacatatcacactagatccatgactataaaaagagaattagtggaaataccaccatctattcttaaagcatctctccaaggagctttagataattgaaaatgttctcttccagcccaatcccttgggaaataaatagaggtgatttattaaaacttacattttacgtataagaaaataacaacaagaaaatcaattgcagagagtggcagaggatcttgagggtatcctctacttgctgaaccacacttcttccttagaattatataataaatacagaatatgtacatttacttgtgtatagctgcctgtgatttacctatagtaaggtcaaaagcattctatggacatggtcttccttgagcccttcttctgtgctgtcattttcctttgccagggaaatggtttctcaccatccctcccatggacacctatgtctggaaatgtctaaaacacttttcgaatagcaagttgctttctcctataccagcaagaaatttttgcaactccacctgtccctcaaagcaatgtggccacaataacctctgcaagtctgtctgcctatgctgtttctttttctaatacccaactaatttattgatttatattgtctttacgtctcctctggctttgcagtgtggcatgagtctcagagccagtgattacattacattcataagtatttggctggagttttaaaaaatgagagatggtagtggggatctggagggggatgatgcataatatacatggaactgtgaaaatgcgtaagataaaaattaaagaagtcttctttcctctaaagtaagatttaataaaatgagactctgacgaaagaaagctttattttggtgaaagacatcaaatggcatgtgtacaaaagacagaaactaaaagaaataggcagcagtgccccctgggttgcctgtcaagaagtgtgtcctgtacagtttctggagaaattaagaaatgcaaataacctgggcagattaacagcacccgaagataactagcaggatacaaacaaacagcacctttcactatgaggaggcgtattcctccaggcaaacaaagaaacaggacagagtcaacatctgtttcatataacagcttggctgctgacagaagaaaccttaaaaaaatggcttagctgacaatccacaaaaatcattcaatcactattgcatgggccgaagcaaacgagtaaatgaacacaacctgcactttctatattaccctaaaaaagttgtcttttctttataggaagaaaaaaattaaaatgaaaatgcaaacaaaaatcttcatgaactttccccttttgattgacaacaggcagcaatgaatactgaatcataaaagacagccagctgcttttcagctggtctttgcctttctcaatgtcaattgcgaagacaccactttcaaagagaacattgggtaaggatggtggctgggatggggcatggggagacaattcagatgtaacacattagaatattaagaggaagaaaacaagtcatttgacacacccagtcctggttacagaattcagttagggagtattatgatgtctgggtccttatcaataaataataacacaccaaacatgttaagaactaaaaatttccatctctggattctatcaattcacacatacaatttcaaaatcaagaggaaaacattcatgactgcatagaaacctgtttgtaaatttaagtactggacatttctaaaatgcaacattatcagagctgtgacatcactgcagtgtggacaactgctttcaactcagctaaatgccgtgacatcactgcagtgtggacaactgctttcaactcagctaaatgccagatgcttcacttactttcataatgcggttaaagtacataaggcaaatgcaaaatgaaagcaattaagaggcaatgatagaagagatttttcaggtgaaatgtgaaaacagaaggaaaggtgatgaggtggagcaggacaagatcatttgatattaacgcacgcacagtgccaaaactatgctaggtagctaaacagagactccagtgagggccttttcgagttgcttctcagtttaaacaggtgtaatatcttgtttaagtggaagagaggtatgaccacaaagagaaaaaaaaaatcaatacatgatttgcattatttctgaccttggaaaaaaggctttattgaaaggtgtcctttattgcacagaattgagaggcggcaaagtgagagtatgatcattataaaagcaaatcttccataatgtgagctataggccaagcaaattctcagtggttgacctgcatttactaatttagccctcacaaggattatatgacataggaactattattatctcactttacagataagggaacagagatacaagaaggtggtagacttgcctagaatcatacagaatttctgagctttgaaacaagtcactagaaggaaggaaaattctttaaagagtaatccatcagtccattcagcatccttgttaggtatcttgtacaatatccagaaaaataaaataatctagagcaagacaagcacagtaactaattaaaactaaaagagaaggaattgagattagcttcaccaaaaacctcctggataaaagactatataggaaaacaaaaagttcacgaagtaatactataaaatgtcctgcgtaggaatcaggactaatatccaggcttgctaataccttggatggtattagaaaaccccttcaggtgtgaaagggcctaaatggatatctgttctaggcctataagaagtaatagttgactttaagaagtcaagtatggaagagtttcctctggcacctcttacttggtttatgcaggaacagtgcttgttttgacactataaccaccacaactttctagaactgagcctggcatgtaatacatgctcagtaaatatttgctgaatgaatgaattacaaagaataaacgaataaaacagtgaaatgtttgtggaaagttttagatagtttggaaagtagaagtaagactttgattcagaaggtagtcttgaagaaatcaaaggagggaagcaggattacagaaccagaagtcagaaccataactgagcaagagtttgacttgaaagatctctaaataagagagtgtgagagagaaaatgaatgataaaagcaacagaaataattagagattaagtcctataaatgtctttgagcagagagcaaggtattcatgttttgtcaatatggtattttagggatgggcgcagtggcttatgtctgtaatctcagcactttgggaggctgagggcagatcatttgaggtcaggagttcgagaccagcctggccaacatggcgaaaccttgtctctactaaacatacaaaaattagcgacgtgcggtggctcatgcctgtaaacccagctactcgggaggctgaggcaggagaattacttgaacccatgaggcagaggttgcagtgagccgagattgcaccactgcattccatcctgggcaacggagcaagactctgtctcaaaaataaataaataaaaaataaaaaatggtgttttaccaacacactgttaaccaaaaaaaaaaaaaaaccaaaccaacatgtgaagacttcaaatcatgcaaataataatgatacaaacagcagcaaataacaggtgggagcacttctcttgtgccaggccctgggtaaagtgctgtaggtgtagagtgcactggttaggcacaagagctcagactgataccaacctccggctccaaatgaccacagtcaaatcatcatgtctggtgttatcttatctgtgagataataatagcatctactctctaggcatgaagttgcaaagactgagactgtgtaggggagagaaaagggaataagggcaaaacagaagaagaaaatttagagctccaatttcacaaaaagataggcataatcactgcagcctggagggtgtgacaggtagttgagaacaaggcattcttaaaatagcaaaatagaaatggcccaccaaaccactgggctagactatcactgtgtcataatttaccttgtacttctgcacttaatttttttccctttcatttcattattttcaaaattttcactaatttcctatttctcttttcatgaatgtctccatcactgaatgaggagttccctgaagatgagggctgtgcttagatctttcattctctgcccataggaccatgctagacccataattaattgtggtaaaatgatcaagtgaacagtaagaaaacaccacatgaaaagaaattgatgtgaatgagaattttaagaatttttcaggaaaaagatataaaaacactttcacaaaacagaaaattggtaagaggaaataataatttttataagtaatatatattcaacacatatatattcacacacaaacatatgtttgtgtgtgcaaacatatagtttgtcattaagatccccaaaagtgactttcactgagtgtaactccattattcattgtttcctcaccccatatcatttcttctaaatagataatgagcacaggtttatgcgcttccctattttgaagaagtgagaattttaacttaagactgggaaagagtgaagaagagccttggaactatctgaaatgggtagaggaaggacattagcagggagaacaggggccatgctgttctcctgaattaaccccaggataaggagaactacctgggcattcctcactaagaattcatcactgtcctggctcttaatctctatatttaccacctattttcttgaggtcctcccctgaattcagaatttttctctgattgacaatgtgattgaactctgattaacctgtcttctgagcaaccctccactggtgaataaaagcttcatatcttcacacattgatcataaaacatataactctctcctcccagaaattctcagtcaagcaactccctctcagacaacttgatttcagccagtcataattccccctaagtgcacatacaccttattttgggatgatccccttcatatctagcatacacgttaactcctaggaaagctacactttatacaggttagcctagcttttcatgtgttcctggttgagacataacctagtacctagcctcaaaaaatatttgaggaaatgacttagtgaatgagctgtcaagaagtcaactcccttaagtgcttgcccccgagcatgtgacacaggatacacaattggattctactcagaaagtcccctcttccttcagacactgtgtcaactggaaacagagctattaaagttgagaaagtaaaagaatctatgcataggctagaaatttgctcttcaatactaacacatgccaaaaacttatgtatcactagcctggaacgaatgtatctgctctgatccctgaggctctgccttttacctgcatctcttaacctcattacgaaataggtaccaactaaaacataaccaccaaatcctatggtatcctctccattgtaatttccatttcagcaactgtcagggaacagctctttcggcaaaattaaaccgtgcttgagaacagacctattcccaccttatgtacctctagtcccctaacttgatctttcattgtactgaattttgatggcacagagccaaccttacgaattccttggtgttcactttttttaaaactgtccacatacagttactgtttgtttcatccaagtaaacatcatatgtaataaatgtcttattaaccaaccaatagtttcttatacctggaaggtgttcaataaaagctttgtgtccaacctaaaaataaaatacttagtaacagccatatttaaaacccatataactctcaaaccatgcatttacaatgtgttctttgatttttaaatatccataagtaatattattgtcaccaaggaataatcagcagaagccacaaagcaaaaaagcatttttttataaaccatgcatctggaaattttaaataggagaaagattattttgtttcatttgaatgttctgccagctgcttgtatttcttttttgaattaaattaaattaaactaatttctagacgttaatttatcaatagtttctgagcaaccattgtatttaaggttttaagcatatggcatggttaatatgccatacatttatttttcttaaaagtacaattataatttaaaataccctaatagaacacagtcttttaaaaactttgcatagaaaaattattataagaacattcatgttttataatttttggagtcaaaatgacaaaaccaaatgtcttaaagaaaaatcggaatttattgatcatggttgttttatatattaatgctataaagctaaaagtgaatatgaaattgactggcagaagcgaacctgtcctacacatagcgaactgaaaacagacacctgaaaagatcagccagttttttattagataaaaataagaaggtaccaaacgctattaaaatggcgtaaagttggtgttacaatctcatcgagctaaaaataggtcacagttagaatgaccttaagggaaaataaacaaaacaaaacaaaacaaggtaaggccaatatcacaaagtgattaaagagatggaagataactctctcctaagtcattaaactcaccgatatcatactgaactccagagcacttagtattttcatgcgccattagagaatttagtgggttcactgaattgactgatttctttgttaatctatttacatgggttaagaccctgactaacataaaacacaaccaaaaaatgccagacagagagtgtaatgaaagactgagtgatgtatggtttggggtacagcctatccgataaatgtgcttggccagcaaagaacccattggcaaagatttattatcggaacaaatacattctaaaaagatctaatacaataaaacctgcagtataaacacaaactactctaaaatacaaatcttttccccgaatagttgatctttcaatgatattaaaattctcttcatatgttttattcaagaattttttgaacaagtaaaaccaatgagctgtataaattgccaataatagtgtaattctttgattcattcaaaaaacccccaaagtttatgttacttagaactcttcaacaatttttaaaacatacgaagagaaggaaatatttctaggaaatatattatcaagataaaaatgaaccacctactaaaataagttatcattatgtttgaattacatataatacattattaccaaattcataaaagttaagggcagacatagaaatgatttgaaatgttatacctccaagttcttttacattcaagatggcattctggaatggcactgctttaatactaaaacctaaaattagaaaacaaaaacataaaaaaagaattagcaacttttaaattaaaacacttaggatgctcaaattgtctctttttaggctggttaagatttatttactttttgtagctgatatttatactagaaacacataatttccaaggtaaactgataactgaatattatcttctgccattatcaaaacatagttgttgtggctgggcacagtggctcacacctgtaatcccaacactttgggaagccaaggcgggcagatcacgaggtcaagagatcaagaccatcctgggcaacatggtgaaaccccgtttctactaaaaatacaaaaattagctgggtgtggtggcacacgcctgtaatcccagctactcgggaggctgaggcaggagaatcacttgaacctgggaggcagaggttgcagtaagctgagatcgggccactgcactccagcctggtgacacgccgagactccatttcaaaaacaaacaaacaaacaagcaaaaaacatagttgtgtattacggcaatatataacactatcccctttacttcaaaatattgccttattctttaatttaatatgtaatgtcactctgcaacttttatcagatataagaaagacatttgaaagtatagagaaatttcaaagaaaatattaaatctatgaggacctctgcatctaactttaattcttaaagttaatgtcttataattctttctcacatataactcagcaaccctagaaattaaggtacttaaattataaccatttcatattagaattacatagtatttatgttagtgtcttctttaaaggacatggttaatatgtcatgtatctatttttcttaaaagtacaatcataattatccacttatgcataggcaatcattttataatacatgtaatacaagttttatattataagaaaatattcagagtatacagttctatgattaactatatatttatgacttaactattaccattcaagacaataaattcaactgtgacatatgcaagtgtgtatatacccattcacacacacacacacacacacacgcacacacacacatgcaaatatacacacagattctttctgaaaggatccacaagaaaccagagctaatgactctcaggaaaactgggaatctggaaattttaaataggaggaagattcttttgtttcatttgaatgttttgccatgtacttatatttcttttttgaattaaaagccctatgaatttctaggagttaatgtatcaatagtttctgagcaaccattctacttaaggtttttaagcattatttaatatgtataattttaagattaaaaaagtttctttttcaagaatttatcaacaaagaagacaaattatgagtctttgaggtaagttatgaaaaaatatataaagtattacatggataaaaacaattctttcaaatgggtttgttttgctttataaagaaggaaatcattacacaccttcttagtctagcctatcttttgcacttctttgctgcatgttatcccagtactttaataagctgtacattaccttccacctaaagcagtacatagtatataatgtttgaagaactgactttggagtcagacagaactaggttgaaattctagctctgtcccttattagctctgtgaatgtgggcaacctactagccttgctcgactttctcatctgtaaaacagggatgataatatctacttcatagggttgttataaggataagataatgtatgtgttatgtttatcacagtgcctggtacaccataagcatataatatacgattgctggcattatgtttccattgatgctttttcgttgatgattcaatcattaggtatacatattttctgcctgcctgaatataattacaaacttgattctgggtgctcacttattaatctaagtatgtagttggagatgtaaaagttaccattgaatgaaaagtacttttgttggagtgacgaagatgtcaacagctgaagtctgctgcacagaaaggatggaaaatgttcattgggccctctaacaatcttctaaaacataccccttcctttgtgggcttaatgcagattgacacagtcagcacagcattatggttaatggtgcatgaagtcactgaatcctagtaaatgagcaggaggaaagaggaggcagtcccatgtggctgaaacactggcatgtacctgagcctgcaggaaagcctctccaggtgtctggcctctgggaaattaaggaaagtcagtgccaatcataatattcctgctggcacagaaattcacctgcaggagacttggatgcctgaatgtatctacctacctcacacgggtgttatatggattaaaaagcaatgatggtgaaatcctgaaaatgaaaagctctctgcaaatattaagcagtctattagtggttatgctcaggacaactcaagtgtagattttctagagaagtaagacaggcacaggcctcaactttgaaaaggaaatggttatggagcacatcaccaatgtttaatctgctttgattcttaaaagctgacaatacgcaggctctcaaagggaagtaatatccttccagaaattgctgcacctatgtgcaaaatacaacttttgaaatttattaacccaacaggcagattatgtcactgttattgtctttaaattcttgcaaagtcttcataagttgactactaaaacgtcttcaaaagttcacactaagcaaagtatcctagcaatgttattttattattttattttttttgagatggagtctcgctctgtcacccaggctggggtacagtggcgtggtctcggctcactgcaacctccatctcccgggttcacgccattctcctgcctcagcctcctgagtagccgggactacaggcacccaccaccacgcccagctaatgttttgtatttttagtagagatggggtttcaccatgttagccagcatggtctcgatctcctgacctcgtgatctacccgcctcggcctcccaaagtgctgggattacaggcacgagcctccgcacccagccccctaacaatattatttataggcatataaatgtcccgacaaaatagtcgtaaatgttttctccaaatagaacttgtgtggttagatttatactgcaaaggtatacacagtcatccatgttgctgtctccatattatttttacggtttagcttcagtaattaatgttcaaaagacaaagtctagatagactgattagtccagaaaataagaaaatgtactatttacagaagagaaacaatgttttttctattttagtcattctaaacatttgaaaggattaaatggaactaaaaatctaaagtcatactttcagttcaccagaaggacaaccaagaagggaaattattagacttttttttccctttacatcaggttggatgaggccaagggggagaattaatataatatttaggagggataccaaaggtcaaaccatcaaaatacctttctcaaagggttgctttgaggaataaaagctaccagacagcatttgctctagagaaagaaagtctaggttcaaactcttcctattccatttattaactgtttgactttgagcaagctaactttgttagggaagcattctctggtgtcctcgaactagactgatttttctgagtccatgtttttccagtattcagtacccctcctaggtgattttcacaattgtaactacatatcggttgatttgttttatatttgttctctggctagactgcaaggatccataatgaagaaacaagctacactgtattctgtaggtcagtgcttggcatacaataggatctcaatatgctaagtattaatatctatttcctaatttagctgctataacaatcctaaagttggtatcagtactactgtcccaagaagaaagtgaagtgccaggcacggtggctcacgcctgtaatcccagcactttgggaggccgaggcgggtggatcacgaggtcaggagtttgagaccagcctggccaagatggtgaaaccccgtctctactaaaaatacaaaaattagctgggcgtggtggcagatgcctgtaatcccagctacttgggaggctgaggcaggagaatcgcttgaacccgggaggcagaggttacagtgagccgagatcaggccactgcactttagcttaggtgacagagcaagactctgtctcaaaaaaagtactaagtgctatattcgaaacttaaaaccaggtctcatcaccagagccctacactacactgtagtgtctcctccatataccaacaaactgagggattcacagcattttgtccaattttgagcctaaatactggtaaagtcaactgaccaaaatacacacgtgcctaataaatgcactaatttactgtcctccctgtttataaataacccaacacctaataaacccactaattcattgtcctcctgtttataaataacccaacacaagaaacccaaataagggttttcaggtctatatgccattgctttcttattaatgaaataaaaataatagcatgagtttagaaggtacattttgtagaaataattaataaaatcaggaacttaggaggggagggaaaaagtgttcaactgactcatccatgacagtgtaactactctcttgcttcttcaaacaggaagtgtcctctgatgccatcttcagggtgtcagtgtgctaacgtgacaagggactatcctaggagtccgaagcacagctcttagactcaccagccacatttttgtcttgccttggccttgaattcctcatgtgcaaaatgaggactaaattagctctttgagatgtcctctaaaattagcattccattatttatattaaacaaggagaaggaaataaaagtaaccactgagtcaatcatcaatggcctgtagtatttggctgaaggcttcacggttaagtctccccaggctccattcaaacaatttgatggctgaagcctaagttacgcagtcattttttcctggcctatctaagctacattagtaagactgaaacctcccctaagatttaaccccacaaatttttaataaatatatgacttagtaactctttggggaaataattgtttgcatagcctttcagtctttgttttgcagtccttaaatccaacaaaacctgtgagacaagaaagatgaatttgaagtttttcatgcactgaaagcattcctggaattgtaacaaaattagttttgggaggaaggttagtctatttttattcattgtgtggaacacacaagtatttcacttggacctacagactaaaccctcctccccttccctcaagtctgagtgcacgcacacagatacttgtgtgcttctgaaattcctgggtcactctaagaattgctgaagggaaagacattctacagatctggtggctttgacctgcaccaagggcatgatttatgccacagcagttttgtgatgtttggacaacagactaacgaaattcttctaactatgatttcaacatcataaaaggaaatttaatgtactggcatttataaaacacaatcctttaaaagatatcaaaatctgactttctaacttgtttctcttgttggcttaacacatttgaagctaatactgaagttatttaaatgtcttcttcaaattttcatgaacattttcaatctttttcaaatatggtatatatccctagaagatgttttcaacctttttcaattcaaagtgttcagttttctctaggttattctccatgtaccatcaatatattctcctaagcctttagattccattcctctgcttcaaaaaaaaaagtgaacatttatgtaatctacagtttaacaacccctcttatcaacaaattcctcatacatatacagtaaaggaattcagtctggatagagttcacttttatttctagactaaggtgcaaattactcaaattttctctcctcaccaacaggtcctgctctctggaggatttcttggctctttgagttttgacaatttaagtatcttttaaaaattatgtcagaggtgaaaaattgctgaagttaataaaccaataaagtttgaattctctttctgaagaaaaggcagacattctcgccttgctgaaattaaacgaacacatccttctcatatgttttcattttaagaaaccaactctgaaggtagattctcttttcgaatgttcaaaactcttcaataaatattgcatttttaattggctttatattttcaagacattatagagaaataatttaaaagaataaaggttttacccataattcaatcacatcaataaagtacactgttattcttatagtttttctctagttttttaattcaaatgcatagttttccatggtttaaattcaaaaaataaatgtaaatctaatttttaatttttaaatagaagactgtatatattcttctaatctataatcattttgatcaagttaccataatgtaattaacaaactcccttgttgtatggcatttaaactaccttaaagttttagttgcaatacaaaatgttgcaagaaattgctttatgcatatagtttcccttaagttacttacttaaaataaattgccagtggcataattactaggtctgtgaacattttcataacttttgatttatatgaacaactgctttctaagaaaaatgctttccaaaaaaaagggatatcataacagtcataatgtaacaatcataatgtcacctgtaatacatgtgcataccaatgccactacaatcttaccagcactgactcgtctcataaagaaacagattttggtaaatttaagtataaaactaacgtttacttatctattctctagtaaagttaaacttctggtaaagttgaaacttttccattaatttgtttgccatttattctttttatgaattatctctttatagacttggcacagtttatctgttagattctagatgttatttgtaagtgtggttgaattctctaagagggacagccatatgcttatctgtaatatctgatgcaaatacttccaacagtatttttttatatttatcttaattttagatttccaatggttttaaatttttatatagttaagttccttgatccttcccttgtgaatgattcactggaggcctagtccagctattctgccatcttccacactgaagtctacatacacatgtggatttctgacttcctcaattcttttccaagttacctttattactattggagtttgctgtttatttcagtaccctccttccaccccctttgttcttctttacttacacacacacatacacacacacacacacacacacacacagagagagatacacacctgctatgaacaaccaaaagaattctggacctgggcagtaagtttgaagatgtcagcaatgcctacctcaaactccagcactgaacagttgtggatccccgataactaaagtcagcctgtgggacctcctctgctgcctattcgccaacccttctctaccatcagtaacttgtttctacaacatcttgccctcctttcactataatgaacacacaggtccaaacaccaagcatctaccccttttctcctacatcattacttcctgcctcccatggccaactcagcctcacctttatcattacagagccttctcagtgaatcatattgaaccttatctttcttaagaagtcttctccatgctccagcatttccctgcacattttttcttcctccatacactagcaaacagagcttttccttctcttatcagcgcctctcagcacaaactttgcttccttctacgcttttagaacacttcatcatagccacttgttaataacatcctacctgagttatgacgtttacttatatatggacctctgcattcccacctaccaattttcagggattttgttcatctatctgaatgaactcaatatttggctaacagttgtccaccacaccctatctgcttctattcttatgggcaacattcttaaaactaatagccagagctatcctctaagtttctgatagtttttcagatctctaaaactatcagctctaattcatatcaaccatctccagtttatagcaaagagttgtcgattcaattaaattttctactttaacaatcatgccatcagcaagtacgtttttatttattctttcacaaaatgaaagcattttatttatttttcttgcctgatttactggctagaatctctaccacaatgttgaatagatgtggtgagaacagacatccatgtcttattcctgatctgatcaggaaacaattcagtctttctccattaactctgacaacagctgtagggttttcacagatgccctttaacagttgaggtaattcctttctagtcctactttgttaatagcttttgtcaaaaattgatgctgagttttttttgtttttgttttttgcatatcttcacaggatcatagtttcatcttttggtttattgatattgtgaataaactgattgatttttgaatgtgcaaccaactctgcattcctagaataaatgtcacatgttcatgacatattatcctattaaaatattattgttgaatttaatttggtatatttttgcttataatttttgtatctgtgtccatgagggctattggtatgaagcttttttttttttttttttttttttttttttttttttttgtaatgtctctgtgtggttttggtatcagcttcatgctggtcttaggagttggggcatttttccctcctcttcaattttctggaagagactaaagaattggcagtatttcttccttaaaatgtttggtaggattcactagtgaaaccaactagacttaaaaaaagaaagaaaaggtatcaatttcttaaacagatataggtctatccaggttttctatttcttcttgagtgagatttgatggtttgtccttcaaggaaattgtccattttctctaagttgtcagatttactggcataaggttgttcatgatattcccttattaacctcttactatttatagaatctatattgatgtcacctttcttattcctgatattggttatttgtgtcttttttattttttctgatcagtttggctagagttttaccagttttactgactttctcaaagaactagcttttggttttactaattttctctatggctcttctatttcattgatttctactttgatctttattttcttctgcttatttgggtttaatccatttttcttccagttccctaaggtggaagctgaggtcattgatttgaggcccttcttttctgaatagacatttagtggtataaacttttcttaaagtcccgttttataggcaccacaaattctaatatgttgcattgtcattcagtgcaaaatcctttataatttctcttttgctaccttctttgattcgtgggtcatttagaagtaagtgagtttgtaaatacttgagattttttttttcttcttgttattgatttttaatgcaattctatcacggtctaagaacatattggatataacttgaagccacttaaacttatttagatttgctttcataaaccaggttatggcctaatttggcaaatattctatgtgtacttgaaaagaatgtcttctgttgttgggtggagtattttataaaatgttaatcaggtcaagttagctgttagtgttgttgaagtctgctacgtactggctgattttcttcccacatgatctataaagtattgagagaaactgacgtcgctgattgtaattgtgggtttgtacatttctttttgcagttctgtcatttttttgtttcatatatttttaagttctgttaggtacataaatgtgtagaattattacagtctcctgaataaatgatcccttcatcattatgaacttctttatccccagccttattcattgctctgaaatctacattgtctaatattaacatagctaccccaactttcttttgactagtgttagcatgatgtatctttttccacctttgtatatttaatctatttgtgtctttatacttaaagtttgattcttaaagtcagtatttggttgggtcttggtttttaaaaaaatctattatatcaacctctgtctcttaattaaggagtctagatcatttatatttaatattattattgatgtttaggtttgactgtatcacctttctacttgtttcctatttgtttcatctattcttgttccccttttcttctttttctgccttcttttggattatttttgataattctattttcatctcatttgttgctttatgggctctcatcctttgttttgttattttattggttactttagggtttacagtaaatctttaatcagtctaccttcaagtgttattatacgacttcacatatagtacaagaatcttccaatagtgtacttccctttttccccatgacctttgtgctattgttctcaggcattttacttttacatatgttgttaaccccataatatgtgcttattattgttgtttaaagacatacctcttaaagatatttaaataataagaagtaaatattatataattatccacataatttgcatttctggcagtctccattttatatagatccagatttccatctggtatcattttttttctgactcaaggacttcttttaacatttcttataatgcttatctgctagcaataaattccttcagattttgtatgtctgaaaaagtctagtctttatttttactttctttttaaaagagacttttgctggatattagttgacagttttttccctttcagatgctgctccaatgtcttcttacttgcatttttccagtgaaaaaatgtgatgccatccttatttttattcttactcatgtaacatcttttatctgcttttaaggtattttctttgtactactttgttctcaagagaaaaaaaaaaccaaaaggatgtgtgtttatatgcatatttatatgtatgtataggtgcatgtatggatataaatatatacctttgtttatatatatatatataaatagagacagagaaatactttaagaaattggctcacacaattacagttgctataaacccaaaatctacagtttgggctggcaggctggagacccaggaaagaatcaatacgcagttcaagtccaaaggccatttactgaagaattccctcttgttccagggaggcaagtcttttattctattcaggccttcaactggctggatgaggccaaaccacattatggaggacaatctgtcaaaatccgcagatttaagtattaagttcatcccaaactacccttatagaaatatccagactaatgtctgactacatatttgggcactgggacccagccagttacacacaaaattaaacatcatattctttatcaccggttttgaacaattttattatgatgtgccttggtatagttatattcacgtttctttctctctctctctttttttcccccacaagagatggggtctctctctctgtcacccaggttggagtaaagcagtgtgatcacagctcattgcagcctcaaactcctgggatcaagcaatcctcctacttctgcctcacaagtagctgggactacaggcaagcaccaacacatgcagctaatttatttatttatttatttgtagagatgggggtcttactatgttgcccaagctggtgtcaaattcctggcctcaagtgatacttccgcctcagcttctcaaagtattgggattacaagtgtgagccactgtgcccagccttgctcatgttccttttgtttggggttcagtgagcttcttggatctgtaggtgtagagttttcttcatgttcaacaatgtttcagccattatttcttcaaatatttttctgtccctttccactcaccttcatggactcaaattaccctagcttaggtttaaagttgtcccatagctcgctggatgctctttgcatttttttctctctcagattgtctctatgaacagatacaatacagtgataataacagttttaatgtccccctttgctacttctaatatttacatcagttctgggtcagttccaattcgatgattattctcattatgaatcatgatttctggcctcttcccatccctgataatctttgactgactggcagacattgtgaattttaccttgttgagtgatgaatattttttctttaaatcctatacagctttgtgctgagatgcattacattaccagacaaccatctgaggttttgggacttgctaatattatctgtcatgtgagtccagagtggtactccacttacggctgaccttgccaagtactctacccagttccttgtgagttataagtttttcagtccatctggtgattacaggcatagttttcaaccctgtatgaacaccaaccactgttccctctagtcctttaagatggttcttgccctggccttgggaagtttcctcacatgcatgcattgaatattttgctggatactcaagggagactctgaaaatctttagtgttctctctctgtacaactcttttctctggtattctattctatgaacattagccatcttggtctccccttgctctcggcttcatctcctcaatgcagggagttcactgagctccacctcagctccctctggaactgtgccacagcctggaaactctcaaggcattaagctgggacaatcacagagcacatctcatttgtttctcatttctcagggataactgcgtttcctggcttgaaaattgttgctttgtatatttcatgagctggttgctgttgttgttcttcttcttttagatgggagagtaaactagttccagttattccatcttaccagaacaagaagtcctcactcatccttgtgctcactgccctctcttgagcatattcagtcttgccttttcccctgatgaccaccctaaacctctgactactagcatgctcaagagaccttttcttatagaaacaaattctcttagcactattttctctttttctgtccaccttcttgaaagaactgtctatattccaaagagttaaggagtgaaaacgatggtctacccctcaattcctttgcttgctcttcatcccctcaattctcaggttggtttccacctcaatactctactgaaactgtttctaccattagttattaattaccacgttgtcaccacatccaatggcctttctcagactttagacttacgtttaccttatttgactggttcttttgatttcttgcccatatttgacttaaaggatattatatagaactgtctgacctatattccttatcaaaagcagatgctgtaatgtaagctccaaagagcagggttgtttgtatattttgttaactgatatatcctcagtccttaaatcagtggcagtcacataacagacattcaatgaatgtggaatgaattaacaaaatataattggtgcttagcacctttcttcccgctttctacccattacccctggacaagctcatccaaatctatgactgagttgtctctcaaatctctctagtctgcttggcttttagcatttggatcactgttggatgtcttgtcaaacctcaaaatcagcatgccccaaactaaactcattatttttatcttaaaactctgtcacattctccctactttttttttttttaacaattcaccaaaacataaagctataaacttgactcatatttgattgttttatcttcctttcctcttgaatacccagcataactgtcacttttacagtagcagtaacatccccacaagtattgtccctgctggatcacctctacatctaacaggtctcccccaacagcttctctaagtctctagccttagatcccaacatcccctaaatctctgcatgctgtgccttaacccagtaagaccactaatctttctctgaatatacctatgctttctatccctaactctcctcaccccattcctctctgcttagaccttacccatcatatgagaccctactcaaatgtaaccttaactatgagctttctttgaccctccagattagaaatgatcactctcctcttttaactttcatatttacaccattaatataacacatatcacattctgtcttagcacagagcctggagtatattaaataagcaatatatgtgaactgtttttatcaatacacaacttatcttcctaacctgggtgtaaacttcttgatggcagcttcctccaaagaggcctccaaaaagacattatgccaggttcagaacaatgacaactcaaagaagcttgatatccaaaaaattagccaacctaacaactaattcatcagaaaatagactagtgcacaattctggtaaaacgtattattaaaaaatttcataaaaacaaacacaaaacataacttacaagtaagaaaattatatacagataatcttttacactataattcaaaactgctcctctagcaatagtgctagaagataactctgataagtgaagaaaagcatactttgtgttactcttacacatattttagaagctattttgattgaaaagacttaagctaataaagtttatataacttcattgcacattactcaaaagatattcacagttttataaacaaccaataaagtacctacttccaccagaaatcctaaaccttggataccactaaacttcacttgaacacctgaactggcatcctatctctagctatgtaacaatagccatgtcaccatacctttgatcttcaggtaatttagaaacagaatatggaaaaagattcctacctgtcatataagggctgttataaggctaacagaagactatatagattcaatttactttcatttgcttattaacagacatctgtatccatgcctaaaccttgtgacagactctgggtatacaataccacatatgatgctctagctgcccttaagagattctaacccaagatggggagatgggcacatacataaagcagtgctacaggcactaactgggagaaatacggacaacgcccagtggggagaggagggagtactcagttctgtccaaggagaaaagaaggtagtcagaaacagcttcctgcaaagaggctacacatgagctctgctaatcttctctggggtctctactcattacaatccccttatcctttccctcatcctaaaatcaagcaatgtctctaaccctttaacagctccacagtttcttatctcaattctaaaatctgaaaagctctcaaaacctgcacttttttaaaacttacttgccggcaaaagctgacgtgaactgaagtaaggttcttgatcaacaatatcctttctactttttgtaggaaatcctagttaataattccatcatccaaccatcacgtaagccaggaattgagacagccatggctttctcactctcaccctccaaacccaactacactaggctttgtcaattctagctctcaaatatatatcctacctattccttcctcttcttccccctgtaactgcctcagccaaggccttcatcatctcagttgcaccatcacagtaatcttctgcctccgcctccaactgcgctactcacaatttagcctccacatcatggccagcttgattcttctcaaatggacatctgatcatgtagtttccttgcttaaaatactctgatgtctctgcactatctacacgaaaagcccaaactcctgagcacagtatgaaaggtctgctaagattcagccaccactgaatacaatttgtctcctggcactctattaaacatacactgcagccacacacaaatgcagtttctaggagttgccaatctgtttgacactccttaccttcacactgcccctctgctcctaagtcctctttcttttccaccccctcaccttatttcttgtaccagacctacttatcaacctcaaatctaatgtagcaaaccaaatcatgcatccttcccttccccaggtccaggcaacactgtcatgccccttccttccatgccccatctatttctggatatgaacttaatgtttatgcagccagtatactgagactcctggaatgctgaaatcatcgcttatctcatgtctaacactggacctagcacatagtaggtgctcaaaataagctggctgatgaacaatcttttcaactttccagaaaacatctcacccttctccttccttctcagctctctctgcacagcagctctgttctctatctcttacagctgttcttccattatttcctcttatactcttctttccttcttcattgtcagaagagaaagaggacacatttgggaagtgaagaaaaaccctagccaggatttctcactaataacttgacactgaaaacattttgggcctgataactctttgctgtgggggctgccctgtacattgaaggatgtttagtagcaccactggcctctatccaccagaagccagtaatacccctccccacaaatgactccaaaatgtcccactcagaggcataatctcccctgattgagaaccactgccctagactgactttgcttggctccatcaggaagcaataggggaaggctgatgcatgatctcttgcactgactttcctccaggtgaaaaatgacaaggaaagaagattcagactacatcagtttactattcagggagtgtgtggccaagaaacataggctggagtgacacttcaaggaaggaaagtactctatgggcccaagatgaatccattttgtcatatatcagagttccagatttcaggattcatttgtattaatattttcccaagcttcatttattcagtgccactgaaatgacctgctagagggatataggatacagcaatttaatgctattaaattcatttcaaatcttttttgaaaaagagatagtgtttaaaattaaaataaactgattaaagcattaaactataagtagaagggaggggataaattgcacaggaaactaggacatcttgggatgagaaagaagaagggacagaaccccagcacagtacccacctgtggtcgacacgacgttatcggggctttcactgcagagtttggacaacagactggttttgccagaacctgtgaggcctatgcaaaccaggtcatattctggtcgtgcaggtggtggtcccttgcagcaaagtgctctaaaacactgccaaaagaaggggaaaaaaatgttcctttaaatgacagtatggaaataaaccatagtcacatttaaaatgactgagtaagtattaagaggtaattgaataaagtattacctataaggaagaaaacggtaactttagaacagtgaaacctggagacaccactctagccaagtgatcaaagttaacattcttagttatgaaatgtttttctacttcatgcctcccttcctgctatggcaggtgcactgcaaaaagcatgacatcatcccacagcttgcctgccaaaaccacacaatctgaatctaagcatgaggaaaccagataaagccaatctaaggagtattccataaggcaactggcctgttctcctccaaaatatcaatgtcttaaaagtcaaagaaagactgaggaactgttccatgttaaagaagactaaaaagacataataataaaatgcaatatatcttggactggatcctagatcaaaaggggaaaaaaaaagccataaatgacattattgagacaataagtgaacactgaatatagactgcatattagataagagtactgtataaggttaaatttcctgaatttaatcaatgtactgtggttatgtaagaaaaatcattgttctgagaaaatattctaattatttataatacctctaagtatttagaggtgaagggtcttgatgtccacaattaactggctcagaaaaatctaaatctccagctccatctttatctggtgaggagagtgacaaagccaacatggcaaaatgttaatgactagtgatgctgagtaaagagaatagaggaaaactccttgttctggtcttaccactgatattatttcaaaatacaaaaatttttaaaatcattaaatagagtctctatacataccactgcctttctggcctttgctaaattctttttcaggtcaatcaaccagggtactatgaactgtagtatagtttgctctgcaagagttaaagacaaggggatctgggccaggcacagtggctcaggcctgtaatcccagcactttgggaccagtctggccaatgtggtgaaacccagtctgtactaaaaatacaaaaagaaattagccaggcatggtggcaggcacctgtaattccagctactcaggggactgaggcaggagaatcacttgaatctgggtggcagaggttgcagtgagccaaggtcacactattgcactccagcctgggcaaaaagagcgagactccatctcagaaaaaaaaaaaaaagaaaagaaaagaaagaaagaaagaaaaacaagaggatttgggagacagggtatcatttgtgcagcttttgatctttctacttatcccatatccataggggccaactatgtgccagcttatagagcctgaaacatttagaccctgaatgattcatgagagaaagagggaaagggggagacagggaggaaagaaggcagatccactcacttttgggtcatctggagattacgagagaagagacctataaaaaagcctgtgttgattcatctcactcagataaaatctgagtactaattggctgtcatactctcgtaaatcaaacttgattatttctctccctcatttctcacatctaatcaacaaatctagttcatatgacctctgaagtagctctaggatctgtccacttctgtccagcccaggccatcatcacctgaacaacatcaatatcctcccactagttccagtatatttgctcttgtgccccctattctccacattgcagtgactggattgcttataaagagaaaatctgaccatacgtgcttaagccaccccagtgactttgcccagctctcgagcccaaacccttaccatggtctaccccacactccatgatctgctccagccaagctcaccagcctcattgccctcactcccctacatcctccagccatgccctctcttacctcaactgaggcatctaatatgctgttccttcttcccccaattctggacttagccaacacctcatcatttttaggtctcaacttaatcatcccatcctcagggcagtctgctccaatcctaagattgtgttagcaattcacgtccagctctactgggcttttataaattcattacacagacaattgcagtttcttattcatcaccagcctgtgagaaccatgtctgtcccccttcatctcagtactcccagtgtctagcagagaacatggcatagaatctaccctcagcagataattgttgaatgaagaatgaacgacacttaaattttacctaagcaaagaaaaaagaaaacatagagactaacaggatgcttgatctatgttctctgagccctccacgcttcaagaaaatactgtcaaaataagaaaccgctgactttttcacttcgcttcaatgccattagttagcctagttcccaaaagagtggttttggtgtacaggatcaactttcttggtaaattagagcttctttttgtcctaaattcacttttcctctgttctcaagaggttctgcctgcttctggtaaacaattctatgacccatattcttcatgggtttattcatgctaattgtatttcctctcagtcttttcaagcctgaggagtcctacttatttcagtctgtcttcatcctatgagatgttcttctctgatcttcctttagttccagcacaccctctcccacaagattaatgaccataactactaacagcattctaaacgccaacacatcacttcatggattcatatgaaggctggctgatactgtctgactttaacaagcttttttataaagtctgtctcccagactcagaatgagagtttttctcagagataggtttatttgtgtatgtgtctgttccctcaaagatggccatggctagcagctgttcagacttagaagtggtcttccacattcaattaggacagacaacaaaactagtcacacagtttcttttactgggctgcgttggtcttgtttggggttcaaggaggagagatcccattcctgccctagaggccttcattctcactcagctccttgccagaattcctctggactatctcctggaggagggctggcctgactaccctggcccaaactatcataaaccttaaatatcaaatgaaactgtatgtgaatgattgctagagcatccggtttaaattattcatgtcgttatcactcatatttttgccaaacactccagaatttcatcttcatgttctttttaaaatccagagtagaaaaactttgtagccaactccattaatatctattttacctgtttattctaggtcacctaagccacttctgacataaaagatgattttgcaatgatagcagtgatattctactccactgtcttttctcttctttctttctttcttttttttttttcagacagagtttcactcttgttgcccgggctggagtgcaatggcacaatctcggctcacagcaacctccacctcccgggttcaagtgattctcgtgcctcggcttcctgagtagctgggattacaggtatgcgccaccacacccagctaatttttgtatttttagtagagacggggtttcaccatgttggccaggctggtcttgaactctcgacttcaggtgatccactcacctcagcctcccaaagtgctgggattacaggtgtgagccaccatgcccagccttctcttctctttctttttctctcttttttttttttttaagacagtctgtctctgtcactcaggctggagtgcagtggtgcaatctccactcactgcaacctccaaatcccaggctcaagcaatcctcccacctcagcctcccgagtagctgggattacaagtgtgcaccaccacacccagctaatttttgtatctttgtagagatggggtttcaccatgttgctcaggctggtctccatctcctgagctcaggtgatccactcaccccggctgcccaaagtgctgagattacacacgtgagccactgagcctggtctctcttccctttttatattctcaccagtgatatcatctccagtcccatggtttcaatcatataaccgaatgtcataaggacatccaacatgacatctccccctccgtctccccaagctctttctctaagtccaggctctatagttccagctgttctataagaacccaaaccaaaactgaataaaacaaaagcctccccacaaaaccacaggctgtggaaataaggttctttggaacttaatggctagattgatagttattacaaggcaaaatctttgacataaatcacagactcttagaaatcaacatgtatttgaactgactgaataaatcatcctatgggtaacaggaatagtgtcagattttgagtcaacaagataaaactttcaacagtatgctacttccaatggggaaggaatggtcatgttttctgagtcagttcctaaaaactgtaaagagttttcatttgttttttgttttaaaacttaatgaagctttggatcctatagtcaatttacttaaaattactcattttggcctctagactatactgtaccaaagttcattgtgtgtgtctcctacagcagctcttgcattgttaagagtaagcccctttcactgttgtacaatgcgaaacacaatgctgtcggcagtcctgacagcaagcggcaaactcaggcctcattcccaggccaaacactaaggcattgtgtaactctgttcaagcctcataaacctatccatgcttcagtttccccacgattaaccagtaacattttaacactctctgccgcttcctttcttcaggaggatgttatgaggcctgggtgcaatacatcatgctactaagaaaggcgccatacaggtaaataactgctcattgcgattttcatttttccaaggtatcttaagtgacagttagcttccttagacaagggcctggccacccaatatacagcccagactgtagtacttccaacagcccacagcagcctccacatgctccattctatcccagttcagcccaagacactaaacacacacaacctgtccccactcccctggtagcagcaaatagagaacagagccagtctgaatataagtataccctcttggggggccaaccaaggtcatggtctccactgcctagactgcttcagctcacaggccttttcacacgggacaagttatgacttggtcttttttaaaagaacccagtgtatctactatattatgtcaggacacaggatgtttccccattctgtgtacccacaaacttctagtgctgtatttgaggaaatggtgtgcctaggtcttgagagagggcaaagaccagaatcaccagtaataactgactatatcgtagactttggacaaatcatgtaatcatataatcaacagctgaaataatggattagcttgaaagcagaagcaaaccccttagaaatatgtgcttaaaaaggaaggtgactacaaatattggaaagaaaagaaagcaaaagataaaattactagagtaaaataaggacttgcatttcagtctgatgacctagcaccaaggcagcaagattatcttaaaatgttcccatttctgtttggaacagaaataaggtatttatttccccaacagtgccagacattttgtaggtctagcagagcactgtacacaatcagtacttgatgaataacccctcatgtcaacattgcaaagcactaatcaagcatttaattgtacatttcattttcctctatatttctaccttaatgactccggccaccctccaaatcaccactattccttcacatggtctgagcacttaacgtttctatgccaccctgttcctgtgcacacagaataaaagttcctccccactttcctacttggcaaactcctgctcaaagttctgtttaaagggcacctcctctgagaagtgttcaattccctcagagagaaataatcctttcttccacttcttggtcctgtacagactagcactacagttaatactatgacacatgtattcttttctaagattcactggctgatagaaatatgcacacagacacaaagacatatccattcttggtcctattataggttcaaaaagcttaatcttacagctaccaaggggtggccaggcaccaaaacagaacagcaaagttgtcctacaaatatgtgttactagacgagaatctagctcaaaatcctcccactttggcactggcccctgcattgccagtgtttcctaccatcctgtttcgctaaattcccagccctttgggacatggcatttgtttcaattgatgctctgtttttcatcatgaatacatgattttattctgagcatgatttcaatttgattgaagctctgtatagttgctggaaacttttcttcagtcggctttgggacttctccacagccagactacccaagccccacactgttcccttctcatttcaatactggtctcgccagacagaaacacaaggtctcctatgacagctcaccaggtctttttctatgtggcccaagggtgaggccaaggaccacactcgataaatactttttagattaacgaaacatccatgagttagtacctaaagggaagagaaaagtcacccataactttaagtggatatatttcttacatagttggcttccaaaccaaaaagaggcagctattcattctgacccttctccaactctcataatgaagaaaaaaagaagcttctaaaaagaagtcaatttctagaagtgttttctaacactaagcgttgctcaatgagtaaaacattaagaagtgcttaaatatgtaaaatgacttgatttagaacaaaatattttccaggtctgtaacagtcagttatggctctgtcttttgaaaatgtaaacccagtacaaaatacaacacattacaaaatgtgttacgggatttgtcagagctgcttgagctctgtaggagacattgggaggggcgggtgtcctagtaaattaaaaataaaactgtattgaacagcagatataagtgacttatgggtattaattcatctattccctagaaaagtaccatatgatttcaatttaaagaggaggaaactgaggctcaaagaagttaagtaacttgcctacgtggaacaggattcaaaccctggcagtctggctcctgagctgttttccaaacttctgcaatgataagcctctaatttctgagggcgtgtcattcaaaggaaactttagatccattctgtgttgatagagggcaacaaagagataagaaaatgtacccgagagctattaagtggcagagctggggttcgagccagggttattccactccagagccctagttcatgccctcaagtcagggatcagagcatcagaagtggggtgttctgttcttttgaggaggtgaaagagtgctttaagtaagtttgcctttgtaactgaagagaaaaacaccgggcaaaggaaggcgaagatacaagtctttgtattgcttctttacttgtaccagcaggtttatggccaaagtatctctcattccaggcaaaagggacctgcagctctcttggagttagagaagttgggtgagaaatagcatccttaagattcttgccctgctgaattagagagcaggggaggaggaggagaggagattgactgggatggaagaaaaggggataccaaagtgctgctggcttctctctttcacactgtttgcttctttcatttaacccttttttgtcctctggaaaggataaaacttatgtattaagagaagccagccaggtgcagtgactcacacctgtaatccctgcactttgggaggccgaggtagggggatcatttgaggtcaggagttcgagaccagcctggccaacgtggtgagaccccgtctctactaaaaatacaaaaattagccaggtgtagtggtgtgtgcccgtagtcccagctactcaggaggccgaggcaggagaatcgcttaaacctgggggactgaggttgcagtgagctgagatcgcgccactgctctccagcctgggtgacacagcgagactgtctcgagaaaaaaaaaaaaaaaaaaagagaagcccatgtgagctgcagagatttccaaccctaagcacagcagtaaggaaaaaaatctcttttgaaacagcctcaaattatatgtatatataaattataccttaaaatatatgtgtatgtaaattatatctcaataaagtaaaataaataagcaaatactaaataaaatatgttggaggagagtataggaggaaatatatgaataaactgggttgtgcagaaaggcatgtgaaggagaaggtctataatgagcatgcgatctcttagctaatcctatctttctagttgtaagaagagaaacaaaaatcaaatatgcttcgatgtcttagggtgactagtggttcttgcaaacaagttcaaaatggcatctatagcaagaaaaataacaaacagggcaaaggagtgctgtgaagaggcccctggctgccagacacagcccagctgaagacttctccacgttccaagagcaacctatgttttgaggtggaaatcctgtcatcctttaagaccctagtgggaaaaaaacaacaaattgtttttatagaaggtgggtcaaacctttcagccatgtgggctgctgggagcacacagatgaaggctttggactggaattgtcccagggctgaggcttctggccaatacatcacactgcctcaggacactaaatctgtctttgccttaccctttgtatttctcaatccacattcctttttggggtgaaatactccattatttctgctttgttctgggctgtctcctgtctctgtccctattaactcgtggcaacaaaagaaacaaacagaagcaggggatttcatgcttagcagctatagacattggcctcacggctttgcagaggggcagacatctgagactttgaatggaagagagtgctgctgcgctgaaccagacccggggcccacgtggctcccagtctgcatcagtcatccccgatcagtggctttcaagagtctcggtatgtggaattcaagatgaaccaaaagtgagattttaaaagttagggcatgtatctgatgattagatttaaagaaatgaattcaagattctcatataattcccagctatgcataatttcacatcttctcacattggaaatagatcagaggaataggatttttttcttttactaggaaagaaaactaagtaaaaaaataaatgtttcttttaaaaaaatctaattcttacattgtaatggcttgaagggaaaaaatcaatttttataaaaacagaattatgcaataaaaccagcaataaaatacccaggcataaatgtctgtaacgagacctaacctttatatgccatattcataaacatctccaaatcagggcctcatctaggtcagtttcagaccatgtactatttttttcctaaagagcaaagtaatacaatttaaaggaaagtgaatgagaaactaatgcattttacagcaaatctctttttttgctgattacctgaacagaacatttctaaacaggaagtaggccataaaaatacacaaacacttttaacattccttaccaagggcattttctatattttaaagacttaagaagggtcaggacatgaaaacatttaaaaggagctaggtggtcgggcacagtcgctcatgctggtaatcccagcactttaggaggtcaacggaggaggatcacttgaggctaggagtttgaaaccatcctgatgaacatagcgagaccccatctcttcaaaagaaaaatttatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcctgtttttctcaggtttgtcaaagatcagatagttgtaggtatgcggcgttatttctgagggctttgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtctttggtagcttgatggggatggcattgaatctataaattaccttgggcagtatggctattttcatgatattgattcttcctacccatgagcatggaatgttcttccatttgtttgtatcttcttttatttccttgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttggtgaagttgcttatcagcttaaggagattttgggctgagacgatggggttttctagataaacaatcctgtcgtctgcaaacagggacaatttgacttcctcttttcctaattgaatacccgttatttccttctcctgccttattgccccagccagaacttccaacactatgttgaataggagcggtgagagagggtatccctgtcttgtgccagttttcaaagggaatgcttccagtttttgcccattcagtatgatattggctgtgggtttgtcatagatagctcttattattttgaaatacgtcccatcaatacctaatttattgagagtctttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcgtttttgtggagaaataggaacactcttacactgttggtgggactgtaaactagttcaaccattgtggaagtcagtgtggcgatacctcagggatctagaactagaaataccatttgacccagccatcccattactgggtatatacccaaatgactataaatcatgctgctataaaaacacatgcacacgtatgtttattgcggcattattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattaacaatgagatcacatggacacaggaaggggaatatcacactctggggactgtggtggggtggggggaggggggagggatagcattgggagatatacctaatgctaaatgacgaattaatgggtgcagcacaccagcatggcacatgtatacatatgtaactaacctgcacaatgtgcacatgtaccctaaaacttaaagtataataaaaaaaaaatcaaaaaaaaaaaaaaaaaagaaaaatttaaaaattagccaggtgtgatggtgtgcgcctgtagtcccaggtcctggggagggtgaggcaggaggattgcttgagcccaggagttcaaggctgcagtgagctatgactgtgccactgcactccagcctaggcaacagtaacactgtctttaaaaaaaaaaaaaaaaaaaaaaaaaaaaaaagagagagagagagactaggttccacaagtagaccttcaaatggatttaaatatcaccacaaaaatccctaggaggaaagatctcaataaagtagattctttccattcactgtgcttttggaactgaagctagaaaggcttataacaaaaaaaaaaaaaaaaaaaggaaaacaaaccaaaattgtttttcttgtagtccctaaaagtggaaatcctattctattcttcacttaacaatcttttaggctccataaagatggagctcagtcccatatattctactagtcaccaattcctatgaatctgtccaactttgcctctactatttccctgttcctcctggatcccagtgcctttctttgttcaggacatcaccacagtcctttggataaccacactatcttttctcctaactggtgtcattagttcaggtcttatcctactccaattcagtctccagaataccatgtttttcccgtgatttaaaatctttctatagctacccacagctgtcaggataaagtacagactccttatctgggcagacaaggagctttatgatctgacctttgccttcatttctggcatccaatagttgttatggggaccacaggaaataacgtctataacagctaaaacatggtttgacacacaaaacttaattgataataatattaattattatttttcccaccaaatacatggccctcaaggcaatcctatgcacctccatgcagtttctgatccattctctttccggctccatgtcagtaaaggggctgaccctctgcctacacatccttcctcactattttcctctggctggctcttagttacccttcaaaattcagctcaatgatcatttctttcaagacaacttctgtgaccctcactctgatttagatgaccttctccaaactccctgagtatcttttctatttcactgtcataacactcatcattctgtcaagtacagttgatttgccatccatcttcccccactggacttagagcacttgaatgcaggcactacttttaattcaactttggaacatgagtgtctgaccaagccacatggccagatgtgctccccagtgatgtgcgtggctatgattaaaagcatggttagacaagcctgaaatcaaaccctatggcaatcaggacaagttacttcactgatagctaatctagaaaatagggatcatctcacaggattgctgggagtagcaaataaggtactatatacaaaatgctcagcacagtactcaataatcaataggtgttattatcatcatgagtgctaatattagatttttcagttacaatagtgttttcccaaagaaaacttatttttatgaccacacatcaggattcttctcatagtagataattaaagataattcagggtttaggcttattttaacaccaatttggtcaaagatctgatatgatatgccaaatcccaatggtggctaatgacacagaggcagtccatttggtttgcaataataacaacaattaaaagctcgtagtatgacatatagtgggacaatcgttggattattttcttcccctaaaggtgaagaaaacccctaaaaacacactttcaagaattactggtctattctaacagttaaatcgactctttttgaatataaatttctatgtagacctagacaaaagcataacagagcagaagtgtccgtaatccctgtacatcctcaaatcacactgctttaactgctgacaaagacaaatgtttactatggtctagcgcggagaagccaatacggtgagcaaaatgctatctcgcctcacacatcaacacacgtgccagacagattctgactgcaaagtctgttattggtgatgagagaggcagagagggcacagctggatatttcagatccacagctgagctggcagcagtgggagttcaagccatcttctcactttaaaagctggaatgaatctgtgagagttatttaaaggtgtgctttattaaagaggcactttctgactactgtcaaacttcacgagcaaaagctgaacacacagataaaggcagatctatgtggggtcacctatcagatgtcagctgatctctttcagcacccacaaatcacttattgaaaattaaataccaaaaaaaattttccttcaagattaaatgtagcatgtggacttaatttatattactaatccttttagtatttgctttatattattccctgaaattagtacaggcacaaatgccttaaattatgtttcttgaatttatagcccaaattacatagattatacaagtaccatatacagattcatgaagatattagagaggctccatgggccttatacatttaactagagctttactagaataaagtctcagtagcatcgactttttttttttttttttgtcaaacaaagcactcactctatcaaaggagttcttaaactaccaggaaaataagattcttgaacatcccaagtgtttcttaaaaagggatgtcctcattttccttttgtacaaaacagggttcagattgcaaataacagaaaagcaattcattggaaggatactgataattcacagaattgatgagaaggctaaagaacagcaagaactaaggcagcccaaggtaacactattataagtttaggagttgccacttatgctaactgcttgccaccctgcaccaaactccactgcagccacgagaatgacatcagaaggctccaaccccgggcattgtgccactgagctggagaatctaaccagccaaaccttgctggctctcatgctggggccctggctaccaggttgttgaggaaaaaattgctgccccctaccatcagcaatggaaggagggaaccctgtctccaagttcttgtgggattttctcctaagcagggcagccaaaaccagtatcaactatacatttggtccactggcccaacagacagcagaacttatctagtactacaattgaaggacataaaacagaacatatttattcatcttccaattccacagactgattctgactgaatgtgccagagtcttgggaatggctaagagtcagtctgaaccaaggcaggtgacaggatgagggctggtagaaaccctggagtgaattttcctgagcaaacatgttttgccctcttagtgtcccacttgttatttaatactcagctctcctattctacatgtattcccttctccctttctattttcctactgatacattattacatgtaagaagatgaggctggctgtgaatgtagaggaagcaaatgcctggcagttcttatgttcatacttgcatatttttgctttcctttcaccttcaatgtcttatggggagaaaatgggacaggacatacttgaagccatgtgtagcacctagcttttgttaaacacaaaaactccatgggacagtctgggctattgtttgtcactagcagtgtagatagacagaaactccttaaggatgtgtgactagccattcttttctttctttcttttttaaataaaaacattctggtttttgacatgtttgtctaagtaaggtacaatccctcaagtctcccttttccaatttgcatatcacaccataattgtgaagcaactgttacaacaagaataaaaaaaactactcatctggaacatgcaacaaaaaatggagcaatcatatttatggttagcaataaataaataaaggtccttggctaacaaactcagctttcccaaaaggaaaaaaacctgaaggctcacagtaaactatcatgttaagaaaaagcagtgggggaatgggagtgggagggaaaggattaggtaaaggcatgtattttatagaaaaggacattaggcctcatttgcttggtgaatctgtggaaataatttatgatattctatacaaggaattatgactccatcctgaacagactgcttatctccccatggctcttcacaagcaagaaagggcatgctcatgactctttgactttagtgttaacattgattttataattacaataatattggataccaaggtcctcaagggaattagacatggacagtatttgccagagataaaatattcatcaccaacagagtatataaaatgtatctgagaggatcagggctcacttgggacccacacaagaggaataagacatcaccagaaaaatgcaagaattctctgatatgtaaaaatctgaaacaaagaatgtcagtcttaacaaattctgcacatattaaaataagacctcattgtcacataatctgggggcattccagtagggcagagaataaaaaattgacctgaaattttcttagagggcttccaaagcaaatacataacaaggcccacagctctctttttaatcctattaattttaaatttcttacaaatcacaaacttctctttgcctaaggtttacgtctcaagctaaccattttttttgtgcaatctttagggttttctacatacaggttcatgtcactggcaaagtcaatgtgcaaaaatcagttgcatgtctgtacactaataattaacaacctgaaaaggaaattatgaaaataattccatttataatagcacgtaaaagaataagacacttaagaactaacttaaccaaggaggtgaaaagcttgtacaataaaagccacaaaacattgctgaaagaaattaaagaagatacaaataaatggaaacacatcccatgttcatggacaaaagacaataatgttaatctgtcaacactacccaaatggattcaatgcaatcctatcaaaatctaaataatttttttatggaaataaaaaagcccatcctaaaattcatatagaatcacaaatgacaaaacaatcttgaaaacaaagaacaaagctggagctccagacttacacatacagatttcaaaacaaacgtccggtaatcaaaagaacatgttattagcataaacacagacatatagaccaatgaaatagaatagagatccccaaaataaacctttgcatatgtggtcaaatgattttgggcaagggtgaaaagatcattcagtgggaaagaacagtcttttcaacagatggtgctaggaaaactggatatgcacacacaaaagaataaagttgtacccttacctaatgccatatacaaaagttaactccaaatgaataaaagctttaaatgtaagacctaaaagtataaaaaacatagaaacatagaaagttttttcttagaaaaaaacacagggcaaatgcttcatgacattgaatttggcaataatttgttggacatgataccacagacacagatgaaaaaagaaacaataggcaaattgaactttatcaaaactaaaacatttggtacaacaaaagaaaatgtcaatagtgtaaaaagttagtccatagaatgggaaaaaatatttttaaatcatatctctaataagagatcaatgtctggaatatgtagacaactcctaaaactgaacaataaaaaaactgttcaaaaatggacaaagaatttgaaaagacattcctccaaagaagatatacaaaaggctaattaagtacatgaaaagatgctcaatatcactaatcatcaggaaaatacaaatcaaaactacagtgagggctaggtgtggtggctcacgcctgtaattccagcactttgggagtcaaggcaggtggatcacttgaggtcaggagttcgagaccagcctggccaacacggtgaaaccccgtttctactaaagatacaaaaaaattagccaggtgtggtggtatacacctgtaatctcagctactcaggaggctgaggcagaagaattgcttgaacccaggaggtggaggttgcagtgagccaagatcaccccactgcactccagcctaggtgatagaatgagacgttgtctcaaaaaaaaaaaaaaaattacagtgagatatcattaggatggccactgtcttagactgttcctgttgctccaacaaaatacgtaatttacaaagaacagaagttcattttctcacagttctggaggctggaaagtccaggatcaaagcactggcattttgtgtctggtgagggccttctgctacatcttcacatggcagaagacagaaggatgaaaagggcctagctagtttcctggaagcattggataaaggtattaatcccattcataaggccatagcccccagacttaataacctcctgaaggcctcaccttttaataccatcacattgggtcttaggttccatcatatgaattttggggaggacatgcacattcaaaccataacagctactatcagaataatggaaaataacaagtgttggcaaggatatggagaaattagaacccttgtacactgttgggaagaatgtaaaatgatatagccactgtgaaaaacaatatggcagtacctcaaaaaattaaaaatagaattatcatctgatccaataatgccatgtctggatatatactcaaaagaactgaaagcaggatctggaagagttgtttgtacactcatgttcatagcaacatcactcataacagctaaagcatagaagtaccccatatgtccatcaacaaatgaatggataagcaaaatgtgatatatacatataatcgattactatttagctataaaaaggaaggaagttgtgacatatgttacagcatgtttcaaccctgaggacataagactaagttaaataagccagccagccgtaaaaaagacaaacacagtttgactctacttatataagatagaattagtcaaagtcataaagaccaaatgtagaatggtagttaccaggaaataaggagggggatacaggcagttattgttcaatgggtatagaatttcagtgttacaagatgaataagagttatgaagatgtatgctggtgatggtggggatataacattataaatgcatttaataccactgagctgcatacttaaaaatagttaagatggtgaattttatatgtattttacaaaaataaaaaaaaattttgaaaaaaaatcccacaatttataactcatcccaaacctattcctcctgaaactttcctccttagttaacaacagctccattttttcagttgctcaggccaaaaactctagaataatccttggcacccctttttctctcaaaccacacatccaatcaatcagaaaattctgtcagcaatagcttcaatatatatacagactccaactacttctcaccacctctacccttaccaccccaatctcttgctttgattattccaaaagcctcacactggctccctgctttcactcaaacctccgtatagtctatttacagcacagtagccagagtgatcctgttaacatatgtcagatcaagtctcttttccactcaaaatactccaaaggctcccatctcactcaggctaaaaattaaagcccttatagcagactaaaaggtcctataaaatctgcctccttcctccttcctcccccactcctaattatttctatgacaacatctactactatttcttcactcagtcagttactccaagcaacctggccttcttgcagttcctggcccacgcttggtaacatccaacttcaggacctttgcacttgccattccctctgcttagaaatctcttgccctagatatacatatggttcatagtcactcctttatgttgtttgggtctttgctcacatatcacctttcagtaagacctgccctgattactcttaaaaactgcacatgtaccctaaaacttaaagtataagtaaaaaaaaaaaagccaaaaaaattgcaacctttcccaccacaacatgttctaactaccttacatgttttcccacagaacttactgtcttcttacttactcagtaatttactatttatttgtttattgccagtctcccctcactagaacataagtcccatgacggcaagattttttacaattgttttattgaattatttcctaaccttttatcattggacagaggttgatggaattctatattctagccgcatttttcttgaatggaaggaacatgcatccttttaaatcacatcctattaaatttggcaaatcttatacttttatgtgactcctcctgtgttttgtcttcctctagaattataacactaaggtcatgctaatgacaaagagttggggtggggggcgggtctagacagagttttaaagttttctaatctttacaagaagacacaagaggagaaaccagtcagtctgttgagagaaaaaacagaaaacgtaagtgtcatgaaagtaagaaaacttaagtgtttcaagagggaggaggtaagcaactaagatgaatgcttctgagtagttagatcagaacacacagataaccattgtatctggaaatatggaggatattggtgatcttcacaagcaccatcttactggggtggtgaagacagaaatcaagagtatgtatgtaggtccagtgacacttttcatttgacatgtttcacgtaggacattccttccattcccatggcttctactattttgatggcttctgaatcccatatctgcttcaacgtcctgctctggagagccaaactagagtttttaaacttcctgttaaacatctctatctagatctcccttaagtactctcaaactaataaaaatccaatttcagtatcaatcctaccacccacaaaagaaacttgttccttctttctatatttcctatttcagtaaattgcagcatcatccaatccatcatccaaagcttatcctcaatcctgtgtctctcacaatgtccaaaattgatacaagtctcttacttgtattgatttcacctcttaaatatttctgtaatactctaatccaggggtcctcaacccccaggcagtgaaccggtactggtccatggcctgttcggaaccaggcctcacagcaggaggtaagcagcaggtgagcaagggagcattgtggcttgagctctgcttcctatcagatcagctacagcattagattctcatagaagcgggaaccctactgtgaactgcacatgtgaaggatctaggttgcttatgagaatctaatgcctgatgatgtgaggtggaacagcatcaccctgaatccatcccctccaccccagtcgatagaaaaactgtcttccacaaaactggtccctggcatcaaaaagcttggggacctgtgctctaatctattcctattgttttacaataaagccttcatttttttttttttttccagaactgtaactacttcgacttatgtactctgcctagcacatcataggtgctcaataaatatttgttgatttcctgaaatagctcacatggctctgttataaattgctcagatctaggtttataaaattaatgctttcccttaaaaagcttggttgaatttttttaaaaaactgaataattgggggctaggatgatattaaataattgggggcatggatgatattaaatacagttatttaataactgtaaataaaaacatacaagttctgttggatgtgggtgtcccctgggagactatggtagtgaacactaaaatcctaatcgccatgcattggaattattccgactattactttctttagttccttcttatccacccagtcttctttgaaaacatgtttccccttcataatttagctctatattgtctaaaagctataacttcaatcaaagaacttaagcatttttaaagccaacaaaatacatgacatcaattattatcagaggcatggacccactgcgatgttcattttgaacaagacgagataagtcattcctggaagaacataggcaaggataaaagatgattcaagcctaatatgcaaggctcctcacctctccatcatttttatgagacccacaacatagtcttaaccccaataacctccatacggcctcaccaagaaaggatagaaaagacctcagaagtattttggccctaaaacatttttgaatcaagctagagaaagttatgaaactcagttgtcacacttgacttgcatccagaaacacaattcaaatgaagcatgtagtctaaatggctgatagttttcagctggctgtactttccagccacctaatatgaaaaatctaatctcaccctaataaaaatcttagacctggcaaaaaaagaaacatatagctttgtggtaacgtgaggagaggagggaggtaacagaaatggtagaatgacctcacagggttttgacttttaaacactaatatttatagattaaaaactgtctgaaaggttaagcttggaaagaatctacttcagatacctgatacagcacaggcacaaaatgaaccatgtttgatctaacttgtaccaagggagaattttacctttagctttaccaacttcccaagaggacttctagtcatgctccttcaaatcccaaaggcctgcgtagtgaggtatgccacaaagagtagggtgtctcagtcctcctctactagtagatggaagtcacaaggagatatctcgagacattcaggatgtttatttactcagaaagtaaatctacattccttttgtccaacaggcaatatcattcttatttctcaaggcccaaggtccataactacttctccccacttaaggcttacactacattctgtactctcaaaatacttagttaatgttgctaatgtactatgtacttcactatgtacaagccaaattaagccacctgtggtcaatatatacctgggcagcaaggctcaagatagatcctatattcagacatcatcaatgaaaatacagaaaaaaatcaacccagactttactgtatttatcctttattcattaagaaacatgcaaaaagctcaggagaattttaaaaggttacaaaacatggtgatggtttaaatagctactacaacaactgaaggccccacagtcatttcacaaactagagaaggaaataatttgctccttccactaatctgacagttggcccaacctctgatttcaggagaccttttttcttttatctctagtccacttataagcacatatgaggacacacacttaatttttctctattttttctcatgtctaaagtaatacctgtaatgaataagttgatcaatcagaaatgtgtaaaggaaaaaagaaatgtcccttcatattcaaccctcctagagatgatcagtgctcaatccttcaacttttctatgcatatactaatatatatatacatctttctcttttcttttagtacaaaaatggaatcatagtatgcatacagttatacaactagctcattattttcctgacaactatgtattagtcccattttaggatgagaaaacagacccaaagaataggtgatttggcaaaggtgactcagctaataagtgatggagtgggaatcaagcccagaaatctggctgcagagtttcagtgctccccttccaaatagcagaaaagctgtagcccatcttctcctgtgtgctaccaagcaaacctgtgaatatgctaggacatattcatcaaagcagaaaaggattctacctgactctttttaatgtcagcatagaattctattgtatggctaccccaaaatttatcagtctccatttggtggctaaatacatggttaattttaaactatatagaatttagatttttagagctagaaaataccttaaagagtatgttttatgacatcaaaagttctcaacatagatgaacttactaaagccccaaatcttgaagcacattcatcaaaaagatcacaggattgcttggtagcagacaggagaaggtaggctgcagctttttccactatttagaagttgaacactcaaatttgagagccagatttctgagtttgattcccactccaacacttactcagccacatttgccaaatcacctaaaaaactgggccacctttgccaaatgacctaagttacatatatggtcctgttttctcatcccaataatgggactaatatacagttgtggtcaggactaaattagttataatgtaaaatacttagagtattgacttacaaataaagcagtaagtggtaataacaataattattatttatgccatactagttcaagcttaccttaaaaaattattaaaatttctgttctcggtgtgggtagaacagaaaacacaaacttttggttgttatttgagattttggcatttacacattcagtgctctttcttcattattctttaattattaaaatataaaactgtgattaaacagctgcagtgggatatattgaattataaagtatttgagtatattaaactgaaatagaattctaaatagaaatgtgaacatacagttatgccagaattgtttgttacctatagaagcctccttcaaatgagaaatggaagaaaacaagaaaataaaaatcatcagtgccactgcattttcattcatatgagtttcacaataaaggatgaaaactttaaactctgaagaatatactagtcaatatatattgattcttcaatagtaaaaacacctgggatatttttgggaaacagataagttcatttcagttcttcacaacacatagatttgtacttcctttcatattggtggtatttgttttcagtttgttttttttttatttttttacttgaacagactagactgaagtgtagtagcagagtccaaattgtttgaacatctttcagcagcaagaacacaatgttatctggcaattcattgtaaaaaagcagcatgaacttgtctgggtgctctccaggtaatgagaaatatctcatgaatgccagggaaagaactttaaatgactgctcttttaacacacctttcaggcaaatgtcttaaggccactgtcacagaaaagcacctgattgggagggggatgcccctacttcatgatcacactagcttggaagataattaaaactaatccttttacctgcctacatttcttacaagcactctgttcagcacagtacataaaaaagatctccatgttttgcaccaagattcaatcagtacttccacattttggggggaaatgcaagtccaaacaacagctcattcacttatttaaaacattcagctattttaaaaggcttagaaaacagagcataaggagctgaaattgtggcaataatcaatagcttaccaaccaaaaagagtccaggaccagatggattcacagctgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaatttataccaatatccttgatgaacattgatgcaaaaatcctcaataaaatactggcaaaccgaatccagcagcatatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgttaaaaactctcaataaattaggtattgatgggacttatctcaaaataatatcagctatctatgacaaacccacagccaatatcatactgaatgggcaaaaactggaagcattccctttgaaaactggcacaagacagggatgccctctctcaccgctcctattcaacatagtgttggaagttctggccggggcaatcaggcaggagaaggaaataaagggtattcaattaggaaaagaggaagtcaaattgtccctgtttgcagacgacacaattggatatctagaaaaccccattgtctcagcccaaaatctccttaagctgataagcaacttcaccaaagtctcaggatacaaaatcaatgtacaaaaatcacaagcattcttatacaccaataacagacaaacagagagccaaatcatcagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatagccatactgcccaaggtaatttatagattcaatgccatccccatcaagctaccaaagactttcttcacagaattggaaaaaactactttaaagttcatatggaaccaaaaaagagcccgcatcgccaagtcaatcctaagccaaaagaacaaagctggaggcatcacgctatctgacttcaaactatactacaaggctacagtaaccaaaacagcatggtattggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacatcttatacaaaaatcaattccagatggattaaagacttaaactttagacctaaaaccataaaaaccctagaagaaaacctaggcaatactattcaggacataggcatgggcaaggacttcatgtctagaacaccaaaagcaatggcaacaaaagccagaattgacaaatgggatataattaaactaaagagcttctgcacagcaaaagaaactaccatcagagtgaacaggcaacccacaaaatgggagaaaattttcgcaacctactcatctgacaaagggctaatatccagaatctacaatgaactctaacaaatttacaagaaaaaaacaaccctatcaaaaagtgggtgaaggacatgaacagacacttctcaaaagaagatatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaacaggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacaatgatagactggattaagaaaatgtggcacatatacaccatggaatactatgcagccataaaaaatgatgagttcatgtcctttgtaggaacgtggatgaaattggaaatcatcactctcagtaaactattccaagaacaaaaaaccaaacaccgcatgttctcactcataggtgggaattgaacaatgagaacacatggacacaggaaggggaacatcacactctggggactgttgtggggtggggggagggggcagggatagcaccaggagatatacataatgctagatgacgagttagtgggtgcagcgcaccagcatggcacatgtatacatatgtaagtaacctgcacgttgtgcacatgtaccctaaaacttaaagtataataataattaaaaaaagagaaaaaaaagaaaaaaataaataaaaaaaatttaaaaataaataaataaataaaaagaaaatagagcataattgtgtatcaaaatgacaagtcctcatcggaggcactgcatccaaatttgcttacctcaaactttgagaagcagccaagatatgaaaactctagagaaggaaaaacttatgccatgactggcaataagaaacaggctatagaaacaacaagtgtttacaaaccaattgagggtacttaagttacaccaggaaggataataaaaaaaaaccatctcaaaaattagttgatataatcataaaccaacaccctaaaagggttacctgtactagggttaggcagaggtcagtgttgctctgtcctcacattcatggtatgactgagagaaaatacagggaatatcttaacttaggtgccacagaaaatacatttcaccctggcaataagcacttcagctgttgatggcaaactttttattcatctttccatactctatcacagataggcgaaaacaacaactcaataaactgaaccataattatacttcttctgcagtgcttcttctcacactttattgaaacatcacttgttatagtaacaaaaagcctaccttctcaactaatcggatttactttcaccacttttttgcagctcagttggatgatcacgatacatacaacacctacgccctttgtctccaattaaatccctcaaattcagtgggttaggaaaaaaaaaaagagttgagtgattctcatttatctcaatagctttccttggttttaccctcagttcaaatctatggcttaccagagagaagaccagagcgcaatatctccgtggccttagtcctgactctataatgaatcacttttagtttcttttcccaggtgcacctctttccatctttctcaattccttcaccctatacttcaccaactaccccacacgctcctcaccctacaccttaccaactaccccatacccaccacatcaccatgaaaggaataagcttttgtgttttcagagtctgagatatgaataagattctttccttggtcaaacttcagttaggcttccgaaccttctcctaaacccatctgtgcacttctttgtgaaatcccattttagcaaagagcctggctaagtcagttcagcaagaacccccatatctaatttgatcatccttctcctccaccatcccccaggtgatgtctgatcaccccagccagtcttccgcaagaatcctgttaggttggtttagccagagtcccccttaccccttatgcttcttcttagtaattttccatctactgatccccaccctgctctttggctatgaattcctacctccccatgctgtacttgaaattgaactcaatctttcctcttgcactgcaagaacccaatgcagtggtccctatacctatggtgatggtcctgaatagtcttcctggcctttactgagcatcattgaataatttttctttaacatgtaaccctaagtcacaatggaccatctccttgacctcctaactttagtaactagggcctcttagaaaacctcaagtcagaaatttaaaattatatagggataaaaatcaagagagcaagctatgtaactggcaggaaattcaaagcaagaaggaattccctcacagcacaaaaacatgggtaccaactagagtatatggcacaaataaattcgaaatttgacattttaaaagtcatatgaatgagctctctctttagctcaataatgactcctgtccctttaagaagtttattatttaacttatttcttaggcaagtataattaagaaacaaccactcatattgtagaataatcaaggcagaaaaattatatgtatttgtgtgatacagtattatggtaggcagaataatggctcctccaaaagatatccatatcctaacccctggaacctgtgactgttacgttacatggccagggggcatcaaggttactaatcagccgaccttacaaatattattctgaattaatccaggtaggctcaatgtaatcacaattgtccttaagcagaaaggaggaagtcagaagagtcagaatcagggagatggcattgtaagaaagactgactaatcactgctggctttgaaaatgaaaaggggccaatagccaaggaattcaggcgacccctagaagctggaaaaggcaagaaaagggaatctcctctaaaggaatgcagcctggctgacatcttagtttcatcctggtgagacccattttgaacttctgaccaccagaactgcaaagtaataaaatggtgttgttttaagctacttagtttgtggtaatatactagcaatagaaaactaatacaagtgggatgccaaaaaatgaataataaagacctagctcttttcagttatataaaaggtcatttcatatgcaattatccttaaagtatttggaggggagggtgttgtacttttgttttctttgtacctatttacaaggtttcctaaagtcaaattattatctgaaatatcacctttcatgaataaaatcaatagaaaaaagtcttcatagatttctgatgtgccagaatatatccaatacataagcaatatataccagaagtcctagggaagcaccatttttccattataaggatagaaaaagttaatgtaattattccccattctatgccatgatttcagggggttccctattttccatgtacttatataaagctcccaaattatctttaaaataatcctagcttgttttctcctcacaacttggcctcatttactctcctgaatcaacagtaagtcccatcccactccacccttactatactcagctccccactcccccctcactgttaaatacacatttcttggtgtaaacctcagaggacacaaatcggctttaataccaacagaaaatataattatccctaatcagatacaaagagttttaatatatttcaaaaccaaactgaataacatttaacttctcttggtcacttaccattaacattaactatatagcatatcgccaagaatatcgacttttttaaaaacaaaatacttcgcagcatcacaactcccctttctcatctattggaatagattctggataatcaactattttatatttaacactatttgatgtctttttataagcacaaattaaacaaaaataataatctcttgtttttctttccttatataaagtctttgaaagtatgagaaaatatccaatgactaaagtcaattttataaaattatattttgggagatctccatgtcacatacacaagcttctacctcccctcagtaacactggttttaagattcttgaagataattttaatcatgacaacatttttatgtatgtgtagaaccatcagctagtactattccatacaaggaatcactcactgttggtcaataatgttttcagtaatccaaagtgaactgaggaaaaccaagaacaaaaagggttggttggttggtttcccataaaactaccttttttcaatttaaaaggacttatttattcaaagattataatgttcctacaggcaggggcaggagggtattaaggtcatgaaatgaactcagtaatagtccctgagggttgtttttctaatgtccttattggcaaactaagtcccacctttgcccaccccgccaaggtttttttgtttgtttttaatattatggttctataaaatccaaaaatctggaagctgctacctaaacaactttgaaaatttgagtggtaaaggacatagtgttaagttatatacaattttcttttcgagagaggaaatcaatgtctgtgtttgtaaaatgttaaccaaaccacaaaatatctttttgtgataattatattaataacagtgagggtgaagacaagactgaacttttccatccatgaagacacatgatgaaaaacaaatcacatataactattatctacgccagactccattctatttgctgtaattcccacaggagacatgcaggaattctgcactgcccatgttttcagaaattaggactttgacttttccttccctctgcacgtttctgctgagaagccagtcttaaactgtcataaataaggtaagacttttggcagatgcacactgcttcgaattgctcatctgtacctatattgcctaaatatgaatctccattatccccttggcaattacattaactccagactgtggccttcttaaaatccagacaaattacccaatgcccatacttctttctagaaactaaacataatgtacacactctaaagtttccagtcaagtcttgcactttttttctcaacctctttacatttcagtgcagatgaataagattttaaaacgtaaaggagttgatgcttaaaagcacaccgtaggtattgtggatcaaaggccataattaaaggatcagttctgaacattgtgctgattttggagcaaacaaagctcatttagtagttatcgctcagaatccaatccaggtatttgtgtagcttgtgcactgtttttcatggaagtacctggaggaatgtatagtcatttacgaagaatcatctttgctatcaattcccttgccttttttttttttttccttgagatggagtctgactctttttgtccaggctgaagtgcagtggcacaatcttggctcactgcaacctccacctcctgggttcaagcgattctcctgcctcagcctcccaagtagctgggatttacgggtgtgagccaccacgcctggcctcccttgaacttttccaactccttggttgcacactcctcaaaaatcccaacaactgcaatggcatgaagagcgctcactttggatgaagtactttccaagcactttgggaggattattgtttttaatcctcataactcccctgggaggtatacactttacatcaggcccccatgacggtaaaggcatctgctcagagatcgcttgcccaagatgacactgctaacaagatctgggatttgaacacgagtctaatctgctttcaaaacaatataaaccactgcattgcactgcctgttagggaaaacccatcagggaataaaaaggtattccagctagtttgttccaaacagaacaaaagtttagggaccacccttggcaaaataacaacgtcccagaatcattgcctctccttactggctggcccatctgacacttaccgaagagcagttctttgcctttagagtataaccttacagaagctgagggctttgttagttaaactattatgctagaatcccaaccagaaactgaaacctgatatcgtgttcatgattaatcattcaacaaatcttatttgagcaccaccataattaactgttaagtaacttaaattctgctgtggaggactaaatatgtgaaagccatgttcctgtcctctaggaactcctggtcaaaggcacagtaagaacaaagactgctccagaaacagtaactaaagttacctgatgaccgaccaactctctaacttccttgtccttttcctcaaattcataattttctggtgaatggagaagaaagacatgaacactgtttaatacttaaaaagtatctagtggaacagactaaattgtcctccttcccccttattcttcttctggtttggccctttctcctccacccccagaatctgtattttttctttggctaatctagattaatgataccagattaagagaactggacaggaaaaacaaaacaaaccaaacagtggcagtaataaatagattatattgatctggcccaaagtctatgtctgtttaatgctagtagttacatagtttatgtagagttgcaagggggtaaaaaactaatcccagcacctcaaataccataattaggacttctcgaagcttgaaaagggtgccagtaggatcaaccttctgagtttgtactcttcattcattcaacccatattgactgagtgcccaccagtgccaagaggtagatatttatagtgaacaaggaagatatgcccacagccctcattgaagttatagtctagaaggaaagtcaatagtaaacagagtcagaaatgcatgtttaaatactgtcaatgagaagcactatgaagggaaagaacagggtgcctcttaaaagtttaccagattgtataccgttatacttcaaaaagctgagagggaaagaaatctaagaggtaagtgatcttatttagatgaagagttaggaaaaccctctgtgggggataagaaaacaaaaaatatcttagctgaaataattaggagttagccagacaaaaaaaatgaggagaacaacgtttcataaagaaggaactatatttgtgtaagcccagaggggaaaaagaacttgatttgtcatagaaattgaaaaagctagcatggtcaagaagtagccgtcagggaaagaggagaatagaaacacaagaaaatgtaagggcagccaaccttatcaacacacctaaaccagaagtcttcaaatgacttctaataatgtctctgatacaaaatcataatgaatatacaaagcccagatgtaaaaaagtaagcaattaaaatacaatgcattttcaaaattctcaagtgaccaagatttgtaactggaaaggctcgtctagtccaatgaaccctacatctttcaaatgagaaggggaaccccacgcccatgcgtgagatgctgtcatcctctctgaatctcctttctcaaagcacccacgttcctctagcagagaggagtcttgcttttcctgaagggttcttctacaccacatgatgacaatatcctatacaaaagggacacagaagccactggacagtaggtgcacaagatgtggcacgatactaactcccatggcccctttcaatatacaaatgtatgtgggtatctgtctgcacagggagactaagagaattttaaaaagaggccaaactgcacttaaaactcctccagaagagatattttacttcacccccaatgttacctcttcttaaaaacatgacagttacaagcatctaaacacagacagagcatgcttctatttagtcttattcctgctctacagaattgttcacactgcacctacactttctgaccaaaccgcctattgagaagacaatctgcagttacacaaatgagaaaagacctctttaaagtggcaggttgaatacagtcatttagttccactttctcctaaaactgcactaaaatgattttaaaagacatttttttaaaaaagataaacacacttggacataaaaaataactacattttggaaactagaaagcagaagaacaagtggtaactggtccagcagacaagaagctgactctaaacaggcagtgaaagaaaggtgggccacaagacagtttgttccctgggattcccaagaagctcaggaatggctggaatccaagatcccttataaatgggcatgaaggagggactaaaaacaagaggattggttcagatctctttaaagaaggacttaagagttctagatcctctctccgatttcacaagctgggcaactggctctgccaccctggtagaaggctacaccttttattttctgtactgaagatcactaggcacatattaaagcaggagtattgtacagaaaaggagaattaagtaaaactttagcatagtgaatattgagagcccaaggccccttttcccccttgcttcccccaccactgaggcccaggcttacattctccaggtgggagcctgaaagattcttctttggaatatctaactaccccaagagagaaaacctaaagatatgttattgggagctctctgataaaacagccaaatacccacgggagaaacacacagtagataaatctcactcttgcacacagaactctgaattagcttcaaatgccccacttttaaatataaatagacaagaactgccaggcgtctaagaagtcattaatatgaaagacagaaacctaacacaggaaaaaattttttaaacttggggtatgcagaactatacaatgagatgaaaatctaatacatatatacatgcacatgcgcacacacacacgcacacacacacatattcacacaccaaagcacaccatgaaatttcagaagactggaattgccaaacaggattaaaaacaaaatcatcaccaccaccagaaaaagtacttcagatacaaaatgttcaggatcaaaacaatgatgctgctctggatagcaacagctagaagcttagaaataaatggcatcatgacttcaaaactatgatggacaattatttccaagctagagttctataccaactaaaccatcagtcatgagtccaataagcaaaatctcaaaaaaaccgacttcccatgaactttggagtaagctaaagaacacaaagacctggaagccagcaagcatcttacagaagaaagggtcccctcaacatgataattcagggggccccccagtgacgacagccatgcagcagggctggtcaacaaccagtccagattggcgtagatcagaagctctgagagaatgtcaccaagaagatgaactagatacaattttatagcacacctatttgaaattatgaagaggagatttatacaactcaagagagacagaatattgactgaatgatgaggacgtagcaaactaagtaaatgacaaaataggacaatgactaactcaagagaaagtagagtttaataaagaagaaatcataatatgacagcaatgaatggcatttataaaggcataataatgtaaacacatggatttacccaaaatgagaacattaactatatgggcagaatgaaggagtagggggaggtaaagatgtgtgttggggtgaatggagagagaaaagagcgaaatcctcaatttccaaagcagaagccaatagacaatgcctaaacctgaaaaatcaagaagtagctatataagtacattaactagaatgatggtggtaaatataaaaagagaaagagagagagagagagagagaggctaaatacagtagttgaaatggagaaagctagagaaagagaagttagagagggcatttgaagggagggaaggaagaagaagttcaccattgaccactggttttcacataataagttctataagattatttgatcttttagaaaatgttcatatacaaccctgataaaaataaaaactaaataataaaaagccaagaaatatggactagaattgaatatccatttctgtctcccttatactattagaaaatgtatacctgtattttacagcacaagtagtaccattctttttaaaggactattttgaggtcgtctttagcttaaagcacatataatgaaaaaaaaaatcattcacctcaggtcatttcttttacctagacattggccagacatgctgtataaagagactaatttttgaacagttacttgcaaagtcaacattcttccagagtgtttgaaactgacagcctttcttattttttatcttttatttattcatagcctatcttctccctcaaagaagtaagaaagctatctttttcttacatggcaactttctcttcaaaatataaagatacacagtgacttagaggattatagaatgctaataaaacagaagagctaaggagttctttgaaaaaggaagaaaaggtgaataaatggtagaaataacattaatttcttctttgtgtcctaatatttggcttgaatacaatgccaacttttttttccttaatgtcttccatgaaagctgaaaaggcaaagaggcataacaagtaaaattaacaaaaatatgctttttctttgttattaagtattcttctaaaaagcaagacatttttaaacgtacccacttcaaaatatattgtaagattctgtgacacaggcatcattaccataaaatcctcccaatcaaattataattttctttttcatgaactatatttcttaagcaaggcaagaacattttattaaaaataatgcctattatctattttattttactataatccactcactttccagccaatttgctccgaatattctcttggaaacttgtacttcaagacaatggcttcactcattacgttatttcaacaaaatgataaatgtattgtgaaatatattatatttgattatcaagctaaagcattgcaaatggccatcacagaacccaaattcacccataacattctatcccccagaatagtcctctgacaacaaatgataactgtacatgacaaatcctttgaggcatctgggccttaaaaattaaagggccattctgactaaagtatgttgattttccaaaggaagttttgttgcagttgttgctgctgttgctattatttgaattgactaatcctcaagtaggttctagccaccctgaagaatatttacaaatacaaatatattagaattgaaagagaccttatatgccacatagttcaatctcttttccttgagatgcaaaactgtggcacagagaagttaattcagttgacaaacaactcatggttaattcagtctcatagaacccaatctagtgctttttctgcaataacacattacagagtctgcaaaaccagcacaattactacctgacactgtcagcaaacaaaatgaaaatacacatattttaataagtagtttttgcttatttttgcagtcacacataagatgttatatctttacacaaaacgaaactaggattatttttattgttcaaaagacagactgtccaattatagctattactgaactagaaatgtattttcagtttatcttcccaaatcaagttagtggtttgtttggtatgcacaaagtattccaaaatgtcacagagtgggggctattgcagggttttctcctgcttccaccagaccacaaagggcaacaagtttggaggggacaggaaggttgggagcagaatacaaggagctgtagagctgttctatcggttcaggttttaagatccatgaatagaccctactcaccgagtgaaagccctgacaattttatctgagcattagaaaataattccttgggcagttaaaagattggaatatcaaagagctgacattagttttaggcagcgcttaaatgaaacacttttttttttttttttttttgagacagagtttcacttttgtcacccaggctggagtgcagtggtgcaatctcagctcacggcaacctctgcctcccaggttcaagcgattctcctgcctcagcctcgcgagtagctgggaatacaggtgcccgccaccatacctggctaattttttgtatttttagtagagacagggttttgccatgttgggcaggctggtcttgaactcctgacctcaggtgatccgaccgcctcagtctcccaaagtgctgggattacaggcacgagccaccgtgaccggccaaatgaaatacttttatactcttatcttacttttaaaaagaatatgataatcagagagttcaggaaggaaataaagaggagtagataaagtccaaaatgaggaatatgcttatctggagcacacctacttaaccagaaaagagtaatttgagtaggaagaaatgccaagtcactaatttgtttaaggatcttggttattggttgattccattaggaatgtgtctggctacaagtaacagaaaattcatgttaggtgctttaaacggcatcaccaaacctaaagggccagagagtaaatatttaagacctgcaggccatatagtctccgtcacaattactcaactctgtcatagcatgaaggcagccacagtcaatacgtggctgtgtttcagtaacactttacttacaaaaataggcaatcagccaatgggtcataatttgccaaccaatggtttaaccaaaatgtcaatccctggtttaaacaaatgagacttaattaaaaagaagctggccttttttgtaaggtagtaagaagggcacatcagctccagatgtcacatttctgtttaagaagaggaaaagggaaaaggaaggtagaaaagggaaaaggccacatctgtcccttttcacaggaaagcaaaaactttccccacagaacctcaagcagaccccctcccccataagatcactagtcagaaccgagcaacacagccacatctagttgtaagagaagctgagaaaacagggaacacaggagtctaagtggcttagaccaatcatggttcattcattgcctggggctagacacattgctgcctcagaccagggtattttagcaagaaggataaatggctattgggtgtacaatgaacagtgtttgtcctgttggactattttttctgttttctctattggcataatctgctcaaagaaaatatgctttcttagctgtgaactaattagtcaaatggagattgagaaagattaagcatgtttggtggtaggggtggggaacaaataagagtgaatctactgttagctacctaaaagtagtgatttaatgggggggagatgcagagtgagaaatctgaatagcagtcctgccagcccagttttatgaccttagccaaaacacttaacctacccatgcctctgtttctccaactggaaaaataaagttgttaaattagatgtctctaaggtcccttgacacactaacatcctgtatctcctttaaatatgttgtctgatcaagcaaacatagcataatgtatccagttaaaatttcctcctaaaaatagtaatgcccaaatcacaaatgtggaggattcccaggcagaataaagttttaaaccaaagaagaaaaaggattttattgaaataacttttcacacattgctaaaacactggcattccattcaacccttccaatttctaagaaaacacacgtgtaagaagggtagttaacttttttaaaacactataaatgtgtcttgtaaaaattatactgtttcttacaacaaacttaaaatagttctcaagtccaaaatggtaactgttctagctagacgactaactgaggatgctcgagtcaccccctccactgccacaaccccaaataagcattgcaaaagataaggtggcaggaagtagatttacttttgagatgctctctcaaataaccgcccttttaacaatgcactggaaattaatcaaaacacagtcaggaccattgaggttccttaagaaacagacttttcaaaaggaatccaaatgaataactcttttagcagtttgaggaaaacaggaataaagaaggaagacaagaagagaggcaggaagggagagggagagaacgttctggaggaaaattttgtttagcaaaaatgttcccatatttttttgagaagtcttccagttttatatccatatagcagagataataaaaatcttcaataaatgggtcataatttatccaaaaaaataccacaaactaagtgaaagctctaacactccaagaaattagtgcagaaaattattttaacttagtaccattaacccaatattcaaagatttgaagatggacaaaactgaaaaaatccatcagtttattgtttggaaaaaatgtaatcttttgagatttaatttagttgagcaacaattgtttttgctacaacttatcagatatacttacgactaaatttgaacacatatatgagagagaagtcttttaaaacaggccaaaatagcagtcccaaacagagtaatcaaatgattactgtatggcaagagcaaaaaagaaaggaaggaaaggaggaagagatggaaggggggaaaaaaggagagaaggaaggaagggggcttgatagaaggaccactacccagagatgcaggggctgctgcaggttaataagaagccttcagctccagcacatttaatagagaatactttattcactaactgatataactttgctacagccactggagtagataagagatatctttccagtaaaaattctgcaaagattctgccctgtactagaacaggcagcagttctcaatcctgacataccaaaggggttagcaggagtttccccaaatgcccattctcagacagatgaaagaacttcctttgaaaaatgctggagcttttcacctccgcaaagcttttttccctacatattgtcctctgtggccatctcagcattttcatcagctcccagcctcttcaccatttgtcatttgcaccaacatacaataggaaaacacattttccgacatgcctcagcgtgtccaggatgagatgcaccctcactactaagccgcattacacgaaaatgtgtgaaatgcattgcttgacccacttacacaaaaagacgcacaccatgtttaacacgaaacgtcctgaacacttcctgtggccatttccattcttctgacttcatttcaatgattgagaacttaagaaggtttgggtcatatttatttatttattttaaaccctcatgtctctcactttccttgcaggaacctgtgactcttgcatagcatagtagctgtgaccccacattggaaggaggtatgatcaaaggcagcctggccagacttgggaaaacatttccactgagaatggacatactgcctgtcaaaaggttattcccaccgcgttggggcagcagatcacgttactccagagtaacaacatgaaagggcaaaatctggccatagtcacccacatacgtgtttttctttccaacaagggcaaatgggagacaccagccagagcagaacatccttcttatcacttgagggggcttgggggtggggaggaggcctttccctaatcaatactgctcctaagccgcagccactgtttaatgccttttatatttttcttttcattcagaaacagctcacattcaacaagacttttctgtcttaaagttttttttttttaaatccaagcaatcacaagctatattctgtggaagacaaaataactttggaggcgtaaatcttaatgtcaatgacaggaaggctttggtgaaccattaccataaatctgacaaacgctaatttgatgggtggctgtatctgtctgctgcacggccagtctagacagtctattgagaaatcctaaaacacaactgtttgttccctgtaacaccatctggatatggcaataagcgccgacccagcgccattcacacatggatcaaagcacatgctaatgctatcatgaagtcatacacataaaaaattcaatctgagaactcgaagcaattttcctaagtcttcagcgaagaaaccccagacttagtgcgactcaagctaagtgcgcgaaggggggagggggggaaaaaggaactgaatatttaatgagcttgggcttccagaggaatgttaggccacccattgtattggaaaaggctcatgtcacacttcagtcatggtacccgtcagggtgcccctttacaaaaattgatctgaagacctttgtaattacctgtttcagtcaggggtggggggctgggggagtggattcatgacaagaaataaaagaatggatccaaggtgtaaatctaacattacattatattggtctgagctggcacaaattttcaatattgcatacaatattaaaaacctttctcattaaactgcactgtggcattagatcaaagaatcaagggcctcctattgaactcctttaaatattacaaacataagagcaagtctggctgtgcataaaatagaaacaaagccaattttttttgtccaccctcatcctatagctggctggagagaaacattgcttgagaaatctattgtaagtcaaacacgaagaaactttacttctcgcaaatatttaacaggcataaatgaatactagtctctagaatttcactttgacagaaatttttcagtaaatatgttactccttcaaaactttaagctactctttcaaaaagtatcactcaacagcatcacttcaattgcaaatcatagaggcagtggtttcatcctcaccaccctgtgatccaaacttctcaaggaaacaaagttcttactacacgggggtgttattccactgtgtacttctaaagtaactttgactcatgtgcttcttggctggcttatattgtctatcagtatctgatggaagaacataactaacaaatatcttataaatttgttattactatacttatctctgtttgctgggagacactgcatatgttatatcccaaatttccacatactcagcataagctatgcgcaaattcccaccagcacattttattttatagcagttataatagttgtctctatattatgggtatatgtatatgtatgtgtacacacacacacacacacacctaattaaatccccaaaatgtactaatcattccatggagggtgagtaaaaaaatataacagaaaaatctgttgggaattacatgctgtaactaagtgcttcagctagcacaggttgtggcttatgctgcaaatttctagtttatacagtagttaagagaatgtatataccttagacccgtacaagttaagcataaaatgataactgaaacagaacccatctacttagactacccagatgttttatctctttctattctacctgctaatgcctttaaagacaatagagaacaaaaaacattaacattacattttagttttttaaatagtttaaggtaaaaacaaaagccagattaagtctctaatcaatcattttacaattctagatagaaattaggtaaagaaataggaaaacgagataaacagttaagccacagttttcttaaaattcagttcgatttaaaaggaagatttatcctcccaaagtattttgtaaaacaaaatatatttatcttttccaatggaattttagtaagacaatgcttttctttttttttttttttaaaaagggagaaaacactaccaatttcacctcccatcctatatgaaatcttccctaaaaatatcttaaaataagagaagttcaggaaatataccaattgcaaatttactgtgaaagattccattttaaatgatgatcacagatcgttagttatatttagcctagagagttaattattataatctgaatcacaaagacaaacagaagagcagcctatttttctgtaatgcatgttcctaagggacctgcaaaaaactaatataagaaggtaaaccacccttccctaaggatagcgttattccctgactttccaaataaaaactgtagagatattagctttcttcatctacaagttagttgtatatgccaagatatcttagcagagttcaaaagtattccatttgcaaggcatacatgtagacctgtaggggtaaaaagaaataaacatgttcatagaaatgtacatctcagatgattcaccgtaacgatcagatgttaccctcggtagaattagaggaaaaaacactgatgcaaagtttaagtgagaaattataatcattattgttaaccattttatatatttatatagccattttacaaatataattaaaaatcggtatgtcattctctatgttggactaaattacgactaagaatttgttgtctaccagtaatggctttctttcaggctgtggctataattctgttaagtttaaaagggggaaaaaaaatcacccaaacattgcttaatgtaactaatcaagcattttcaaaattaagactgggaatgaaatgttaggcagtatttgcagggattaaaaaatgttgtagtagaacagtactgccatctaccgacaacttttaccagtgcctagggagtgtttccaagagcaacctcccatttatttgtgtctgacccaaggaagacttcagagagacactgttcaagtaaccagaaagaagtaacattcagattggccacggttttacctctgacttttaaagacttaatattttctctctttctattcaaaaagagcatggtttttttaaaaaattttgagttgttaaaatatagtgacccacacaatgaatacttcctagtaactaacatccagccgagaagacggctatgcctattgctacagaatgctcatgctcctacagacaaatctccttcaatgcagtaatacactgtatcccgtatccccgatgcagaattagattcactatatcctctaatgacaaaagcagatcacaaaatttcataagcaagattggatgtatttatgtgtatgtcaatcataaagcatccatattaccacccaggaatcactttatttggggtcactgtgggtccaagtctggcactggattcccgcggtagcataaaaaccccttagggtttagttggtggggaagtcgtggggcacactgacatcccagatttgacagaactcagtaaaattctatacataccaaagacggcaatggcatcaccagcaggaagagccattgcacaccttctataatgctcaagataccaagtagatgctttacacaagttctatcagttttgtaacttaaaagtagatgttgagtggggaaatatgcaatataaagactctttaacctatgtgatggagcagctgaagagcacagctagtcttctaattttgtacatggatgctgcatcccattaataatgtaaaatatatatataattttggtctatggattttaacgttttacggaaaaactgctactgctgttttttttttttttaagacagtaatctgaaaacaggttacagacagaaaacatgtaaatgacagattttaaaaaggatttagtcggcactaacatagcccttttaggccacataattgaagaactccaaggaaccacaaaataaactgaaaaccccagacataaagagatccacttattaattaaaagcagctctctttcgctattaaaataaggttggccatgcatactttattgctgtcacagtctcacatgaggcagtattcaaaacacataaaagtaaagttgaatagttctctatgtagggaatggagttaagtcatgtctgcttgcacaaaactgttttgcaaagcagccatatatagaagatcagggtggaagaaaaaaaagactaaaatgcatcaaatctcaaattcaatgcctttctttggtagggacagtgaggtgtgctatggacaacatgagttgaatcaagaaaggcctaaaactttccttgttttaaaactagaactagaaatcaagacaatcactgcaaagaaagagacagggaactaattaaataaattacatactaattaaatacaagttatttgggaactttttttgtaagtctaggttttgtttttaaacacaaaaagtctgtatcatactggtttatctgtgagaagaggcactggtcacaaaaaagagagacggagaaagaaagggggaaaaagaaaagaaacagaatgacaacagtaactaccaatatttcaaaatgtggtttttaagaatttccaaaaatcacacttccaaaaatcacagaaatgttgtggctaaaaagttcattcctgatactaactgttctttaaaagccatgggcaaccatatggcaaaatctagaactaaaatgaaaaggacaaaatgtgtccttccatatttaatattcatttcttgaaatggataatctagtggtatcttgaaggaataaacatatttctttgcaatgacttgctgaatgtcagagcataacaagattatttacagtctttaagaaaagtatggaaacaagaaattcctataacagattatttaaaaaaaacactaccaccttattttatgggttactaataatcatgtaactctttcaactgtagggtaactgccatacaattacaatgcctagttatttatgtctcacagattatatagtactaaagaaagttacctgttaccatatgtagacacttgtggttggcagatgtggaaaatactttaccataaagatcaaaattggcttaaaaattgacctagcatatgaacgtgatttatttatctccactcccctcccccacctctgttttgtttgcttttcctgtggatgaaagaaggaaaaatagaaacttctaaagagatatacagctttccagagtcaatggtttaatctaagtggagtcagctactgaactttattcagctggtttctccccagagcacgtcttcaccgaagtttctgtttgacctgtttcatttccttggaaaattctggcattaaatgcagctattactggtcttaagttagaaacattcttcttgcttgattttttaaatatgataatcaccttaattttttaatataataagcaccttcacactcatcctatgtttcatggtactaagagaccttcggacgccgcatgctagttccactttcctacaagtttgtttactagtgaaattaaacagtcaatcccatttatctctgaaatcagcagtgtcccctagcaagagataagagacaatgtgtgttgtataatttactgggaactaattcatggtgaccaataaattgtgcagtcctcctaaagcaccccctttgccgtggtgagatccgcagtgccgactctcgtcctggcactaagatagataagtcctaagagtgaaatcagtagacatgtgtcttttttttttccctttaattctgaataaaattccagaatttagggagtgaaaaacacttccccaacccccgccaaaaaaatctgacattttctttctgccgaaagtctaatttctctttccccaaattgcttcaccatatggaaggaaagaatctccaccttttatcttcaatctgtatcacagtttgggcatatacgagaattttgtgttcacttttaattttcttgctagttaagaacaactaacaactttcttgtatgttaggactcaaaatacgtacctcaagagttgtggtacatttcacacaggtcagaagacaagcattatggaaatgaaatgattttatgatgactttgctttaataggggttttacacaggggctttcctgggaagatgtccaggcaaattgtgtccaaagcccagaatgaagggaaaattcaccttgatgtaacatagttgaagagggatttgctgatttgtcattttaaatgaaacacaaactccaattccagcccagttatgagagcattcctttgtcctcttacttaagggatttttctttttcctttctttcctttatttctttcaaatcctacaatttgagaaaccactcaagaagatggggtgtgtatacacacacacacacttcatacatacatctgtacatgtacacacacatccattttcaaacaagcgctaataagagtccagttggctctgagataatatatccaaaacgaatcccactcttcttaagcataaacttcacacaaataactagatataaacaagccacatttaataaggataaataaaatctctgtcaagcttacaacaggaccaaaaaaaagtcatgggggccagagaagtaatttttaggttatttggcaagaaacatgcacacacacacacacacacacacacacacacacacacacacacacaaaaccctcatgcacatgtgtgcatgcacagtgtgtgcgcacacatacacagtttttcgtttggaacatttttgaacaatgaaaaggcaagagaaatttaagcgtcttgggaaatactcttcctgtgccaaataagcataaacaaaataaattctaaaagcaaattttaaatactagaggatggaaagtaaaaatgagccaagctggagtggaaatatcaatcctgaaagaatcagaaagcaagtttctcttgaaccccaatgaatcttgcatttctaagaagcacaattcagttacttgagctgtcctttgaacaaaaatttaaacttaaagaatatatttaagaatataattaagtcagctacctgggattttattcaaaaagtgatactgattattttccccaaaacatctaggaatagtgtggcaataaagtggcactgtgtttcaaaaggagccccccaaaaccttcaaagctaagattctatttagtcaatgatttggctaggactcaccacataaaaaacacaacacaacaaaaaacaaacaagcaaacacacttgagcagcctgtttggatattgtagtacttgttccacagaagtcatcagagtgttctaggagcttctcgtctaggttaacactgacactgctggtcagcaataaatcaaagctatgctcgtcatacaagcacgtaaaatcatcaccttaaatggtatgaaagtatttgtgctgttagaaggtagggaatggggtgaggggaggagcaaggataaggattccttctttcccattccactctcgggttctcttgatcttcccagggtggaggagcagtaggaaactgttcacccacccagttactgtgggaaaaaactggagggctctagtgaaaaatgggaaaactcttccccacacctttatctcaagccttggcttaaggtataatactttttattttttattttttttgagacggagtctcactctgtcgcccaagagtgcagtggcacaatctcggctgactgcaacctccgcctcccgggttctagtgattcttctgcctcagcctcccgagcagccaggactacaggcacgcgtcactatgcctggattttttttttttttttttttttaagagacagggtttcaccatattggccaggctagtctagaactcctgacctcatgatccgccagcctcggcaaggagacaagttacttgatagtcaaactgggccttaaaattatcacgcatcatgttattaaaaggcagtgaccatggaagggtaaatgtcctccctcctcctttcatgagaacactaaaccatcctcccaccatgtaaaaaaaaaactacttatattttttattaaaatttacatcatgtaaaaaaattatgtccaaaacggcttggttaaaaaagaccacctaggatatgtttgtgttcagatttgttaaaatgcagagatttaaagaactaaaattctttattaaagaatattttcaataatttaatggtagctttcttgtggcgttttagagttcgcacacagtaggctgtggtttaggagctaaagttgaatgcgatcccagagtttctttaaataggtcattttagagatagaaaagggtctacaggttgattgacaattgacaaactatttggcccactaggcataaacttctattagatagattattggggctttcacagataaccttggtaacagcattatctaaatatgaaaataacaataaaataacaatcaattttatgattctcaaatcagagctttaagaaaatagatccaaatagcatatgactaagaacttactatgtatcaatcaaatggcataaaaatacttgcaacatggtcatcttgaaaaatttacaatctacctccacggtctgtctgaacaacaaacttaacacaaggcagaatggactgaatactgagaataaatggcaattatgagagcgccggggttgggaagagcttccttgacttgagtactggaggcatgtcaggagcaggttataagaatgctgtggcacttgagcagcaccttgaatgttggctgcattcagagcaaaaagtacgcatcagtacaagcaggagaataaaaattcagggcatcatccacaaacagacatgccagagcttacatcatattaggatgttgtgtgcttgtggccatacaacgcagggacacaatgaaagttaggttttagaaagttaagactcagcagagtggagtgaggaggagcgaaggcaatcacaaggaggccggggtaaccgtccaagccagaggatatgtgggctgaactccaaaggcggcagtgggaacgcattgtggtgaccctgcacgcaactgaaaggagataccatctgactgcatggcaatgtgaagaagggggatgagacaaggatgacaaggcagatggcatcacaactgagataaggcacaggaaatgaggaaatggaactgatggagggaagaaggagaaggatttaatcttgaagaatccaagtatacgaggccagcaggacagacacgtgcaataggcggaattagagattaatcagttgactgattaattgatttcacatccactatccaacagactttcaatgactcaactatgggagtccagaaaattatacggaaaaatataaataactataaatcagcatctgggctcaacattcagatactggattgtgaaactcaagagggatctagggactgaaactgaaaacctggacatcatcagtgtaaaaatgatagttgtcaccaccccttgagagtgggagtggtgggaagggaagggagagaatattcatttttttactttataacaaacttttattgtttgaatttttatcaacagcacatactactttttgtggtcttttaaaagccaatgttttaaaaaaaataaagcaaaaagactgaagccataggaacaggcagtatcacaaattgacttctcaaatatgtgcagttaatgtacacaagcactcaggtgggaactgagaaacacaaaggtgatttcaacccaagtcctgtgtgaatctaatgggaaaataaaggcactggagtcaaacaggattcaaactcctctcccactaatagttacataggtgaattcttaaattccctcaagttcaactatttttctctaaaaatgaggcaaacaatacctcatagggttgctgtaaagatgagacaagttaacgtaattaaagcccctaaagggtagcatttggcacacagtaggtactcaattaagattccctgatttttcatccttctgccaagatggggaaactcaaaatttcagtcaggtttaaaaagagactgaaaagaagtgatcagagggaccgcagcagaaaaaaagatggcaccatgtcatggggactagcggagagaagcaaagcgcctttatccatccactcaacataaatgtactaagcattaacacctgctggagtggataactatgtcaaaggtggtggagatggtgagaagtagattatttgacaactaggaaagaggtccttgccgacttgcaagaagagtcccagcagaacagcaggagaagatactacttggccagagggctaaggaatgactgggtggtgaagagtgacagtaggaagaagtgacagttctttgagaaatttgtaactaagggaatgagaggctcttgtgaagcgaaggtttcaggaaagttaagtagctcataggataaaaggaggaaagtctgtggaaagggagaaagtgatggcagggaggaggtggcagagttcattcacagtgtaaggccctgaagctgacaagagggtgcccaaagtgaggaggctgaccttgggaaggagtaaggacacaccatcgcatcgggaagcaagtgtgagaagtaggctggaaatacagacaaaggttcaggtgtaaaggagagctgaagaaattcaattggattaccatctaccttctcattgaaaaaggaagcaagattactagcaaaataaggaaagctgatggaaatgggaccccagggtgaagaaggatcgaaaactaaaaagactttcccaggagcagtgaggttccagcagagggaggtggcacacatcaatactaagcatttagcccaatgtgattgggctaatgtgatttcctccagtgattttcagtggcctgggatatagacacggggggagtgggaaggcagtcataatagtgggcaaagcagaagttaaaagggcaagggattctaaggatgccagtgagccaacagctgacacggtggactggggaggtcaaggcctgaaggttgagcagggaaggaaggatgagactgagtgacaagaaaagcggcaggtggaaaatggccgttaattggatttaagatgaggaacaagcacgtttagaggaaatgaaggaatgagtaagtgaaagaacagaaggctgtgactggaagacagctccaagcttgaatccttagaaatgaggcaattccaggccatggaaagggttgaagctggctgattaaagggaatgcagaaattcctggaatcgagaggccaggcctccagccattcatgacactggaagccgtggttagctatgataatatcagaagaccaagctaggcaaagaggaagagatccaaaggagaagaaaatggaggaaacagaaaaaatataactttctgaatagactaatttcaaagactgttaaaaataatctttctttagaaataatgccttgcttttagtctaagttattaaaaaaaatgagtaaaacctttaaaatccacagcagaaaaagccatttcaccatttatatgtcttcaactgaagcaaaaatcaaggacctgactctttgttcttcaactcaacacatctgatacggtgtggctatgtctccagccaaatctcatcttgaataattgtagctcccataattcccaagtgttgtgggaggggcccagtgggagataactgaatcatgggggtggttctcccattctgttctcatggtagtgaataagtctcatgagatctgatggtcttataagggatttcccctttcacttgtctctcaattctctcttgcctgccgctatgtaagacatcccttgcttttcccccatgattgtgtggcctccctagccatgtggaactgtgagtcaattaaaactttttcctttataaatcacccagcctcaggtatatctttattagtagcatgagaacagactaatacactatttcaaacaagatggcaaagtaactggtaacaactgaaggaaataacgctgcttctgtaagcactgaggccaagttgtctgagctcaccttctcccttcacacactggggaaggaggaggcctgatgacaggatccctacacagcttgctcaagcacaggtgagccacagcacatcctcctgcagcaagcaaggtggcatgactaacacaagacctaacctcattgcctttacacagctctttcatatccattacctctcttaatcctcacaggctctctgggaggcaggtattactatgagcggctttttatcagtgaaaaaatagagacttgtgggccagaagacttgctcaaacgctgagtctggcagaaaccaaggccctcccactccagaatttagccctttccactaaatcccaccaactgaatgactgcaagggccagatgcacaggagacagcgcagttcagaaaggcctgaatacttctgggtcattctcaaagtcacacagggcagctaaaacataaagcaagataagcagcatcagcaggtattccttagggatacttcacttacaactgaaagaaaagataacttttccacatttgagcacattgaacaattgtcagtgtgctcacaattcatgagaagacaagaaaacccagagtctacagaaatcaaaagtgacagaatcatcatttcagagctgtaggtacaaaacagtaagtggtctctgggtgtgcagaaggagttaacattttctacagagtaacaccttttctgagaagagactggactggcagaagcaggagataagaggatgggttggaaaaaaccacaacatcttctcaaaccaagagaaagacaagatagaagtagagaaggaaacttgggacttgtatgtctgtaacgccagaggaccctgggcaccttacatgaaaattatcagaaatgcaaattatcagatggctaatttctaaggtcacctggtgccaaacacattacaatttcagtctctgcctcacacatctcacatccctaaaaatagaggcaaaggggacaaaaattatcttcagaaagcctggtgtccactaagcctggcaatatattctatgacaagccacattttatcacagaatactacaatctgaaaaggttccctgagatacatactgctaatctaaagaagtgttgaaccaaaattgtaactaaatcaccaaattctgcataaacccagggggtagaataggttcaatattcaggactagctcaaacaggtgaatttactcagataactgatgaaatctcatcttctaaagtccttattaccacgaggactgacccccccacccccacccacccagacaacaaaagagaaagtcaattaataattatgatataaggttattctcacctcccccattactgtttcttggagtttttatgaggttttgcaataaaaatttatagctatctgaaatagttctaacctcttccacaagtagtttgcttatttgttcatccttttcctctagcccatgtaaataaaacacaaccttcactttcatggtaagaaaaatattccctttaatgaatttcaggaatcaggaagaaaactgcgctagtctcatggatctcatgttaaggattctaagaattctttacttaagagatctgttttccttattcctcaatctcctttaaagaagctgagcatttttaaaaggatatcatagtattactttaaaagcaccaaacatagcatccctgaaaataacatgtttcctgtcgggagaagcatgttaaggtgtctgtgagagatttctggggtttattctaatccatgtttctggggggcatctgggacactctaggaacacaagggcccctctttccactttggttgtcactagtcacacagattttcttactactcactgcttgactgagtcgtctcaattcattaaacattctctgagctattggcaagacttcaaccatggtgacatttcctttacactagatcatccaactatagccttcctagaaaacaatgcttggacagtagcaaaagcctgttgggtcagctaacgacatcaagttataataagatctcaaagtttgtctttctttttaatttttgttttcttctctagcagttacaacatgcaccttgagatggtaatagtcaaagtattgactgaatgtgcctgccccctggtggctggtggggtgaaggacacactgtagaaatccttcgggtacctgcatcagaatcagacacgagagatatgaaagcaagcacacaaatcagaatttgctgtagtggagtattacgaagatctggtataaaatgaaataaaatagagtttaaaaaaggaaaacattactaacaaacagttttagagacaagtcaccaagatcttagcttgagatacactaacccaggctcctcctgccaaattatgagcaattattgtgctaagtatctatgtgcacctgttgttgtcctagcttcttccaattaaattataatcttaagattattgttattcggaagaaggagtctaggttagcatatctcaagctaagagcttggaaactgaaacacattttaattgtggtcattgctccacaccataggggctccctctgggacatggtctcaactggctctggccgattctgatccccaccggcaatctcacttcccgttctcccctttgaggccaaattgtccatggtgactttaaacctggattcatagatgccttcaggacagggaaaaatctaagcctgtgaggcagcaatacggggagtaaaggagactgaggagagacctgtggtgactaggaacatggcttcctacaggcattcaaactccattgtttaaaattaactctacattgcccaaaaaacatttttagagcagtgctctgctcacccctgtaatcccagcacttcgggaggctgaggcaggtggatcacaaggtcaggagttcaagaccagcctggccaatatgaaatcccgtctctaccaaaaatacaaaaattagctgggcatggtggcaggtgcctgtagtcccagctacttgggaggctgaggcaggagaatcgcttgaaccggcaggcggaggttgcagtgagcccagatcgcgccactgcactccagcctggagacagagtgagattccatctcagaaaaaaaaaaaaaaaagaaaagaaaagaaaaagaaaaagaaagaatgaaaagaaaagaaaaggtgaaccaaaaaagcacaaagaaggaagaagagaatgtcctgaatggcctttcccaaccaccaaagacatgcacccagatgcctcaatacggtctcctcaaatgccatgggactacgtcaaaaatatatatatatctttccaatgaaccagctcctgctcttgattttcctatttctctcaaagaaatgatcactttcccagccagctggacttggaaaaggtgtcatctggaccctctcctcctctgtgaggtatgagcaagtcttccctgtaatcctgtcctctccctctgtgcgccctcatccaggttctcactccctagggcctttttcttgttcctatgcatccagcattttcccttagagatcccagtataataaattactcaaatatgtgcagtcctttgtagttacaatgtgcttttgccatattttctattttagttttatttttgagtatataacagcttggtaggtaagcaaaaaaaatactatttctattttacaggagatgaaagaaatattgagaggaattaagtgatttggccattgccactacagaatctcactaatagcatttttacctagatcagtagcccatttctctctcctgctctctgttcctctttctctctctccctctttcccctgctctttctggtctccagcactgtataagccagttgcttggggaatgtttccacgtggatatcccacaaacacattaaactcatcatgatgaaaaccaaatgcacccttggctcctctcaacttgctgctctgctgttctctagttcagtgaacaaggatcacccacctagaaacctggaagtcctgactcctcattctccttcactgacccatccagtcaccaattttcaagtctacaaaactattaaactgtttctcgaaaccaagtttctctcaatccccactgcccacttctgccaccctcatccagcctataacatccacttctctgtctctctcataacactcttatctgcacagccccagtcaatccatccctcacacttcaccttgaataatctttcactctgcttcttacaacattttgatgtctcaccaaaaccctcaaaataaaaaccaagctccttaacaaggctggcagagctcatcagcttctctgggtggtaactccttatcttagcttaggctaccatgacaaaataccaagaccctgggtggcttaaacaacagaaatgtattttctcacagttctgcaggtcggaaagtccaagatcaaagtttgagagggttcagtttctgatgagggctctatttctggctagcaaaccattactttgtcctcacatggcctttccttggtgcatgagtgtggagagtgagggagctttctggtgtttttaaaataaggacactagtagtatcagattagggccccacttttaagacctcatttaaccctaattccctccatatagaccctatctccaaacgtagtcactgggggacagagcctcaacatatgaacttggggagacacaattcagtccatactccctctccaatctcaagtgaaggcctgaccacttagcagtctacgctgcggccacactgactgctcatgtgctgtctctaaatccaaatccttgtggagccctctccagaaccctctccttttccttaggctccctataccttttgcttaactaacccctcactctttaagtctcagcctccatagtcttagttcttccaaaaagtcctgcaatctgacctgcaagccctttcccctctgggattagaggccctcaccaaatgttcccatgatcctgaccacatttgcctgtatcctttactagattcttggctctttgacagcaggtactgaggctgtctgttcacggctgcaaccctaacataacccaagagcactattaatacatagtgctctttcaataaatatcattgtcaaatgccattctcaaaaaggtaggcagaaaaacaggaagggaaggagagaccagagtaagcaatggctccttactatctatggaaaaaagtttccagttgttctgacattcgaagctcccttccactgggcctcaagaccctaagttcatatttgaaaggctgcacaggagaaagcagagccttatgctgcatttgggggtaaaaatagaaccaacaggtagaaatatgggagaaacagggcagagtgggaagggcaggggtgcttaattaaagacgcatgcccacctaccaggaaagccacaaaattgcttctcagaacttgtgttcagggacctctccggtctgctctgccttcaagacacattcttttctcctctgatttcctctattcccacaagagccatcaattggagtctaccctcagccccttgttcggctgacactcatgttcacccctgccctcatacaccatccttgtttgcaatggcttcacaacacccagttctatgcttctcctagtccagccgttttcaatgtgtgcatggactcctgagggtccccaagaccctttcagaggatctgcaggatcaaaactaatgtcatcatactaagacattatttacctcttgcattgtgtttgcattaacattgatggagagagtgagtgagtgaaactgctggccctttagcacaaatcatgctggtggcaccaaactctaccagctgccattgtgttttacataaaaatggccttgatgaagcagtaaactatcaattttattaaatcttgacacgttactattctgtgtgatgaaatacatacaaaacatttctgctctatgtaaaagtctaagggttgtctcaaggaaaagtactcgtgaacctaactaacttctcttttcatggaacaccatttttacttgaaaaaatgacttacaggcaaactataattattcgaacttgggtatttcacagatattttcttaaaaataaatgaagtgggcatgtcaattcaaggaaaacaactgttagtatttgttgccagtgataaaattcaagctttcaaatgaaaattaaattcttagaaaacttgtatctgccatcatgaacttgacatatttacaagactgatattgtgttaacatttggaagatttacataactagatgaaccaatattttccaagaccaatgtgtaatattacaaagtcatgcctgagcaaaagagtctttcaaggtccaagagagactactggcttttaacataactaactagaataagttcactgatatggtttcaggttccacatggcaactagcccctaaggaactaccatttgattgtttagatatagaatcacagaagactactcacaattatcagaaaaggctattaaaatattcttttccaacttcatagctgcgtggggttgaattttcttcacatactttaaccaaaacacacaacagattaaatgcagaggcaaatatgagactctagctgccctctattaacccagacattaaaaagatctgcaaagaggtaaaacaatgccattttctcactaatttttgttttggaaaatatagttctttttcatttaaatgttattcatattaacatgtaatgggtttatttttatttattttttgagacagtctcgctctgttgccaggctggtacaacggcaagatctcagctcactgcaacctctgcttccctgattcaagcaattgtcctgcctcagcttcccaagtagctgggattataggcgcgtgccaccaagcccggctaatttttttatttttgtagagatggggtttctccatgttggccaggtctcgaactcctggcatcaggtgatccgcccgtttcagcctcccaaagtgctgggattacaggcttgagccaccaggcctggcccgttactattgttatttttaaatgcattagtaaaaaaaaaaaaaattttaattgctagaacattaaatatcaatacccacattaataaaagctatttgggagccttaataattatcaatggtgtaaaggggtcctgagaccaaaaagtttgacttcaccaggtgtttgaacactacagatcccatcttgcccatgaagcttccctagacatccccaccccaccgtgctcccttctgcatcctacaatagcatccactggtaaggccactattttaataatgatatggttgctttatactaatgaattatgtttttgtacaacagtctcctagtgtccatgtttaagaatttaagggactttgctttccaaagctgttaacccaactagctctgtgaaagtgaaacaaaattatggacttaaatttctgtctgtgtcaaaaaagagtaaaatgcaccctctagtggacttgtaagctcacagaacacaaaataaatttattggattgtcagaagaattacaactccgtcccagaaaattcagattataaaataataatatatgagcatagggaaattaattttaattttttgataatatgtttttaaaagagctaagaaaatgtgaaaccaaatctagtttgaatgtagttcataactaaatgcaaaagtaaacctgaggtcacacacaaaaaacttctttcttaaattcctatgaattgattatacatcggctatccaaaataatctgttcaaattatgtcttattaactacttataactttaaatacatagaagcattaacatggataaagttgggattattattagttcaatttccaaatattaaaactacactcaacttacaacctgggcattccaatggccttcacaaaatctgaaaaaggacctttgaaggataagaaccaatgcttggggtatacttttaactctgtatgttaatgttaaaaggatttaattctatgcatctttctctaggatgacataagaaaaacagtgtaaaaatacactcaaccttatcagataaaataatgtaatgacatggaaagaagtctgaaatatatggttaaactaaaaaatgtagtcacagaataacgggtggcatgatctaatttatgttttaaaaaatgtacgcacgtgtacccatgtttatgagcacatatgcacgttaattctatagttaaaccttttttttttttttgagacaaggtctcgctctgtcacccaagctgtagtacagtggctcgctcatgcctcactgcagccttgctcctgggctcagcctcccaagtagctgggaatataggcatgtgccaccacacccagctaatttttataatttttgtagagacagggcttcaacatgttgcccaggctggtctcgaactcctgggttcaaatgatctgcctgtcttggcttcccaaagtgctgggattacaggtgtgagccaccaccccgggctatagtaaagtattaacatttgttatttctggcaaggaatatgcattagtagcaaaaataatggaagggcatttgactatacttctatactgttaagatgctgtgagcatttttaattcaaaataatcaaatatggaatttttaaggaaattacagttataattaattcaaagaactgtatgaaatgggaattgttatttcatcaactaggacattaaaaggtttgagtaacaataagaaatttgatatagctatttggtttttaaatcattagactggaaaagaaaattttttaaatggctttatcaccagaacacaatgtctgattcctctgatgataatgcaagctgaagtggtatataaaatcctctctgccacttttaaactctggcagagatagctactccttccaactgatagtgtctgatcggataactatgttcctttttaaactctcaaattctataatttctgaagtgctgagatactgtcatagttatggaagcattttctagctttgagtttttatagatctagcctcagccatacagcctggtgggtacaggtactttaagtgaataactggctttattaatctcaactggaagtggccgagttgaactgaaactaaacacagacacacacacacacacacacacacacacacacacacacaaatcagtagtattaccaaactacaaccactaaggagcatactcatccaattttaatttgagcatcagacgcaaaaagacagaaacaatatgtatgcttcgtctgtcattctaatctgaacacacaatgtcttcaagtcaacaacttaggtagatggagcagactggccaaaaataaatttctattggcaacacttctgtgaaattctactggtcctttataatgtgccagtgtttcactctctaatcatatattgcccagtgcatacattcatttaaacaaaatccttcttttcttcaagtaattaaaactctttaatcttttatctattttaagcctacttccattaatatttgtatttagacatttgtctaaagtgaaaagtgtcccaccagagcatgctgaaccttggtatcttccttgtgaataaaatttagctggacacatagccactcaactacagaatgcagtttccagactcctttgcagccaggtatggccgtacgacatcattggaacatgagtgaaaatgatgtgtacaaaggaattgtttgttctccttttccactcttttcacttctgatatggtttggctgtgtccccacccaaatctcatcttgaattgtagctcccataatccccacgtgttgtgggagggacctggtgggaggtaattgaatcatgggagtgggttttcccccagctgttctcgtgatagtgaataagtgtcaagagatttggtgggtttataaaggggagttcccctgcaaatgctctcttgcctgccaccatgcaaggcatgcctttgctaccccttcccattctgccatgattgtaagtttcctgaggcctcacctgccatgtggaactgtgagtccactaaacctctttttctttataaattacccagtctctagtatgtctttattagcagcatgagaatggactaatacaacttccctattggtagagaagtaccctgaagtattagaacattatacaattatcttaatagaaacagcatgctgacaatgcatgatcagacaggtagatcaatatagacaccaaaaagggggaatacatctaagtacatacagggaataacaaaaagcagtagcattttatgtaaattagtattgtctatttaaaaggaaagaagactattaataaagtcagtaaaaacgcatcaagaataacacaatctgaaacctggcacagagaatgcaaactgtgtttttaagactgttaccacctgagggcactacttcagctgactagaagaaatgcgggtgatcctttgtagaatttgtcttgaatttgccaaaccttcaaaaataattttttagccaaaaatgatcactgtcgtatctacggttaatgtagcatgtcaaaaagcgggaaacagatggatgactcaccaaatggggctgggcaaccaactaaccatatgagggggaaaagcaaagttgcatccctacttcactacttactctaaaataattccactgggatttgaattttaaatagaaaaaacaaatccacaagagtaccagaggacgtttactataataataatttttaaatctttatatttttaggggcagggaagagcattcaaaggatgaaggaaagcatctgaccattctttccatatcactaactccccaacatccttcctggcattatggttaccccacccctgagtttaacaaagttaaaaaacaaaatgggaatggaaaacgagggagcaacccagtcacttaatttttcatgccaaagtcactcaattttttataagcccagattcaggggttgaccctttgtgccctggaaacactgcacgtgaccccagcactgctagctccagcttctgagcctgaaatactctttagcctaaacctggccctaatacacacaacaatcacaaaaaacaataagaataataaagaacccagcaaccgttggaaccctgaggaagccgacggtgagtgaaaccttcccgacttctaaaaccagctccaagtcaagtctgtgaatttgagtctcgcaggatgcccctttcttcctgtatcactccgccagagaatattttttaggaacatagagcactagaatgagtggctatctctaaagccatcttaagtttatattcttcagcagctgactcaataacctgactttgacattaagccgacttcacagaccaactgtcacttcaaagaacaagaaaaaccttgagtaaaagttaaatgaaaagtgttttccaaatcactcgcaaaggaaacagatcaggttgttgtaataaagaatgtaatcaactcatttcatgagctaaaaaggtatcctcagaaacaggaacgcttgactcagggtagactgactctgtcaaaggtttggggcctgatgttgacgactggcaaagaccgagatgaaatgaactcattttgacattcaagttagagttttctaatctaatccatagcaatcatcctgaggtaaaataccaaggtgccacttttatagtcattgatggggaactaagccattaatgactcttctaagtaatacagcagttagtgagtgacagaatcaagactcagatgaggtcctctgactctacaatcaaaggtgtttgactccatccctctagcaccctccatggtggaaacgacatttaggtcaatttataacatccgaaaaagacagactagctgtacaactattaatagataggaaattgacttatctttgggcaatggcaagggaaaaggcttttatgaatgccattttttttttttttggaaaagtaactaaccctattatcctaggcattggattttaaaaatgccatctgaaatatacagttcaggtatctcttctgaagtaaaatattggtatgtatcagttggaaaagactcttttccaccccccaattgttagtgtagctaagatgatacacttaagacttacacgagtaaagaatcacctcaaagaaatgctcagtaagtctttggtttctctggattggcataagggagtctgtgtccctgtagaagaggctgccaggggttccccaatatatattctcctctcttttgtagtgagagaactgagtacataggcttatgtgttttccagcctcacttgtagttaagtgtgaccatatgtctatgttctgaaatatgaggacaaaaagaagttaaattctagaatgtttccttaaaaaatgggggcatattttttgctcttcttcctttctactgtctgaaacgtgggagtgatggctttagctcaaataaccattttggacaatgatgtttaagccaccattgcagatggtgaagcaacgagatgggaggctgggtcctggaaggttaggaatccccatactagccctagactatttacctgcaagtctgtttccctgggacagaaataactttctaacttgtttgaactgttgttcactggagagtagaacttaattctaacacatcatcggccgggcgcggtggctcaggcctgtaatcccagcactttgggaggccgaggcaggcggatcacgaggtcaggagatcgagaccatcctggctaacacggtgaaaccccatctctactaaaaatacaaaaaattagccgggtgtggtggcgggcacctgtagtcccagctactcgggaggctgaggcaggagaatggcatgaacccgggaggcggagcttgcagtgagccgagatcgcgccactgcactctagcctgggcgacagagcgagactccatctcaaaaataaaaaaaaaaaaaacacatcgccaataatttttttttttttgctttgtaatattcaagtcatcagttggctcaaaaggtgtcattaaatcatcaaaattttaatttacttcaaattaaaaaatattttccacaagcacatgtctgagtatacatgcaggtagagtggggacacttgcagaattaaaaaggatcaaaagtcccactgtaaggtacatcaagtatcgttgatccacgcttgcacagaaacctacttatgtccttttcacaacacctaaaagattgtgttgcctaacatactgtattgcaagtgttcgtttaggagtttaccaacaccattcccactccctgccatctagactaggaagtttctggttcaccatcaaatcctcaatgcctagcattgtgccaggcactcaaaaaactgggtgaacatgtgaaagactggccttcgcaataaggacccttctcatgatttgaaatcctctcaaaatacaagttgaggatccctaatccgaaatccacaaagctccgaaatccacaaagctccgaaatctgaaatgctccaaaatccaaaattttgtgagcgtcaacatgacactcaaagaaagtgttcattgaaggttttgggatttcagatttttgaattggggatgctcaaacggttaaagtatctgcaaaaatccaaaagccaaaacacttctgatcccacgcatttcagataaaaagtactcaattggtactagttagatatggtactaaatgagttctgaaattactcacatcccatcagtaatctgacaataaataaacagtcattttaacaaagtctccaaacttctgaattattaatgatgcttaatactatataatgatacttaatcaaagtcccaattcttaactattttactaaaaataagcctgcctatgtttataccgttctgtccataaagaaagaaagaaaaaataagccagcagaacaaccagtaccagaattatatttagattaccctggtaacctagattacctaaaaaaacctaacatctaaaaaatccctaatccagattaccagagtaatctaaatataattcacccaatggttgtggtagtaaaaatatcaccctgtatgtcattattattcagaatcataaggaaataaaccactctacataagaatattctttctaaaatgtaatatactcagcctttttgtcttttatttctttacctatagagataattatagttactcataggttcttttttccaagaccacatgatttttaatgtgcttctcaaataatactctctcaatgaaaggtaaaataatagtgtttattatataatttgctaccttcttaagtagaatacattcaacataattcaactttttgttatgactcatgagagtaggtcatcttaaaaataactaattatataattccgtgttgaatccgattccttatataataggcatgtgtagacaagatatgtagcaagcacctaaggtttaaaaaacatgagcacatcttgaaatggacaaaaagtcatattaaatgttctcctttttcaagatttcaggatgttgcagaaagaatgccataacttctgggggctctgtcatccactgagtttgaggaccaactagagcaataattttgaatctgtatttcttttaaggctaatcttaatatctaagtcataaaggacttgacagaagtataaaggaatagcctcacgtatagcctgagacacatacaaaggcagaaatcgggctgaatgacctagtcaaacactgcacacagcctgggtaaacacccaattcacggtgtccttacctgcctcgattagcaagatggcccagcaatgcctcctgagggacctatgtgcccctcttcttctcctgcatcacttttaacctgtacacgtacacacacgcacacacacacacacacaattaagttataagttacatgttaaatccagatggtttgaagggctaaatggtaaagtaataatgataacagcaataataacaaatatttagggaatatatagggaagtatttttacaatcctgcatagggaaaggccttctatacttttcttcttcaacagtgccttgattggtcctaggggaccacttactcccactcagtccacgtgatttgggccgggatgagcaacctcaaactccgaagataagcatggatgtaggcctggccaatcatagtctcatacaccctcctggtcacagggtctgttcatgaataggacacataacctaagccaagacaatcagaggaaatgagactctagaataagacttctgttgaaactactgggaacaaatattttcttggaagggttgctgagaggccagaatgcaaacgcagagctcccggcagccatcttgccaccaggaagggaagcctcttctgaagatggagacagcatagaatgaggcggacctgaaaacggggttaggtaagcaagtcaactgaatgatgtcgctcgtgcctctgaatacagaactgcctaaagttgcacttacccctttttttcctaggtcagtttacagtttggggctgcaaacaaaaattataacgaacacacctccttagagcattccaaatgaaattaaaattgcaaaatgcacaaaggaaaaaaaatctctttgctcataccttttcaatatagagaatataaatcaagatctgaataccaatccctagatgtagacaatcttaccaacataaaaatgtgattgcctgtcccagtatgaaaaacatcctcctgtaaacattgctacaacaatttttgaatcatttaattatttgaagattacatctccaagtatcaacaataatagaatattattacctgcttaggaatagacagattcaaaaagattttaaaaggaggtggcaggccattaaaaacaacatgacaaatcatttctataaaactattattagtgtcatgaaactgtcctggtagtatcttttgagaaaatatgcaccaaagaattcctgaaaatatgctgctaaaccttgattacagccttctgtaaatagatgtaatctaggaaaactcaaaagcctgttatttgtataaatataacatattcaagctgacaagctgaaattatccgccctttgtattctcctcataagcacagactgtgttataaacaaatccttgctagtctaggcaccagttgaaatccccccctccaaaatggaggctattgataaaaggcttttaataagtcgtagtacagatagaaacacatgtatgtggtgactgatagtaaagtattaagttttcttataatactaaaaattcaaatgcttagagtccagacaagacaaaagcagggaccaaggaaatggttattgatgaccatgtaatgaacctgaaggaacgagtcccaaccaaagggggcagcagtcactcatgaatacatcttcccaattctgatttttcaaaagaagctagaaaacaaattttgtgtgtaatctcttgatatcaaaaacatgtggcccattggcctctaaagtattttgcttgacacacaatttcttaacatttgtcacagacatttaagatctagagatttcacacaaaattttgcagtgactgttgccaccttgtccaagatgtaagggtgagagattcggaccaatctctaaagaagctcaaagttaggactgagcaagtatgggctggaatttgagcaacgatcaaagagcaagtatcccagcagttatgcacaaatctctaattcttagattttagacaagtcatcttccctctctgggcctgtttccataaaatgacaaaactagattaagtaataatatgaacgtttccttcagcaatacaattttatcattctataagaagtccctaaaatagcatccctataagtgaaaattctagatttcacccataactaataatgtacaaaatagtttacaaaagagaaacacccactacctgtactattcatattagtaaatgagtgtgtaaaaataactgacaaactaatgtaattcacagacctgtgtattaagtagcttcatgaattttatgaagtttttcatgtcaaataccattagagaaaccacgctcaacctcaaaagtctcacaatcacacagaaagggtctttatctgtaggaagtatggaacagaactactgaacaaaatgaatgtattttaataccactccctaaaacacgggaaggaattctctcctgtatacacccaaaagtttttctaaaacgggaaaaaaaggtgaaatcacaaaatcaaacacaataaaggtcaagctaaagaatcatctagactggcagcaataccataacttcctgttataaatataaagtaatgggctttcaaatcagaaatgcaatttgatagaaaggccattctaccaggctctggaaattgagtccaaggtggacactatctgcctctctccagcactgtccctccccatcattatcaccattaatgatttccctaattccacacattacgtaaacaaagaaaaaggtagccataaaaaaaaaaaacatcagaaggttaatcatcagcatttattaaaaattaatagcactactggtgttttcagcatttttaaatttgaaaattttaaaattaaaagtataattttaatattaatatcaatattaattttcaatgtgtgctatttctaaaatgaagaaaatactctaataatgatcccaagtaaattttctttatgtaaccagaatcaattcagcgggagaggaatattcttctgtctgggtataattatgtttggggctgcctgcattaacttcaatcttccctcctgacatctttataaatttaacttcatgataatgttctattcctttatcctacttctttaaaataatctctcaaagaaatctttaagaatgttttataataatcacaagaaattagtaattatggatttgtaattagtaaccactgaatcttagcaggaattacgaaaaagaaaatctatggaatagtatgtgtcaaacaaatagtcacaccttgcttgccttattcaactgggcagaaatcagacttcagtgaaaacttttaaaaacttctttcaggttaaatgagcagacactttttgaattaacagaattctaatttttaaaatctcttaaaagagacaatctgatgtattaacaaaagaacaaaacagaagcttggtgatctggactcaggtaccagctggtgctactgctgactggctatgatgtaacttcaggcaagttcaaaaatgctccctgggtcctaagcactcttgctctgtgaaatcaggatggggacttcttttttttttgagatggagttttgctctgctgtccaggctagagtgcactggcgcgatcttggctcactgcaacctccgcctcttgagttcacgtgattctcctgcctcagcctcccaagtagctgggattacagacatctgccaccatgcccagctaatttttgtatttatagtagagccgagggttcaccatgttggccaagctggtcttgaactcctgacctcaagtgatccacccacctcggccttccaaagtgctgagattacgggcacgagccactgtgcctggcctaggatgtggacttctgaagtccatcataattctatggtaagcccctttctgataatattgtatccaattcacagggtaattaaaatagttcaaagagttatcaacactgcacccttttgtcagttcttcattgtatatccacccaggggaagtgtcattgatagatttctgagccttaatcccttaaatcataacaatatcccagaaatattaggtgtgtcctagaaagtctataaagatcttcactcactttttttttttttgaaacaaaactgccttcccttcttcctcctgttctttttctctgtcaaattaaaatatttcccttaaggtaaacttcacaaataagggtctacaaactcctctatgcgcccttattctgggttttcttttcactaacatgaagctattctcatctacacgatccctccgacaacttgcccactccctacatttcagaagacactctcaaagctcttgctctgtagccccgacctatcccccaagcttcagactctcacagaaactatgtgttgtacaaagccacatggacatcccatggatgcctcaaactcaacatgtccaaaactaacctcccccaaacatgttcctcctcccaaattctctatcccacttcacagcacctcatgcccaccaccatcccaggcacccagccagagacggggaatctacctcaccactccttcatctccctgactcaacacacatgatacacagacaaggcttttatctcttacatgtgttttgaaactgcccccttctctctattcctgcgaccatcaccaagttcaagtaacttttcttttattcacatgttttcatcaagcttaggttctcaccacctcctgcttaagaggcaaaacctctttttatatacaaagcatgcatacacacacacacacacacacacacacacacacacacacacacacacacagagtacataaaacatatacacagtatctctgtggtattaaaatgtcataagggagagggtgattaagaaaaaaatgtctaaaaagcccaggatggtcggggaagcataatgatgaaaaggttgagaaatgctacagttattggatttatagctccttatcagcaaagactgtataaatgtacatgataaaatctctaagataaataattcaaattaaaataatttgcatttttgttttctccaaaaatttcttttgtatcttggatattattgaatgtaatttgccctctgccaaagggatgatgccactggatagtcatgaagatgaataatttcctattaaaagtaacctagaaattaaggagttaaagttttgttttttttttttaaggaaattgttttttaaaacacattataaaatatgtgtgagaaagtagctaggactgaattaagattgaatagttatttatgtctgtttcctgtttagccttttgacaatgttcagccccatattttatagtcggctttggataaggcttcccagaataaccttgatgtggggtcggctggtagggaggaccccagaactacatcctgcaattcacaccctatgaacgcatactctgctaaactcaacaacttcaaaacaaaaaacaaatgtcactgtcccatttcctctgcaaagccctgttttcaaactccaaaacacaaagaatgggaggaaaggaagagaaaaaaaaaaaaaaaacccgaacacgtttagaaacaaaggcacattgtgagataacattaagagtcctttcatattttttaaattcagctaaaaattccccttcaaaatctgaaaaatggaacaggtgagtctatgagagaaacaaatatcacattagcaacgtatttttgatgtgtatagaacatccttactcaatataacatactaatttatggacaaatgcttgtcaggttgggcagttataaaaatgaaaacctcaaatcacagaaaaaaataaataaaataaaatgaaataataaaaacctaacaacagcagaggaacttccatgaatggggagagctggtgaatgtgaaggagaaaaagatgatggagcttttttacagcacgaagacaaaaattcctagctttggaagtgggtctctgaaacatgagggcatatttgattaaaaaaaaattaagaacaataaagggaagaaagctgatggtaaagaccagattcttaatacaccatcaaaaatggagggcttctagtaacctgctatgaactaaattgtatctccccccaaatgtatatgttgaagctccaacccccagagtgatggtttctgaagatggagcatttgggaaataactgggttttgagaggtcatgagggttgtctcactcagaatcaaagtcaaaccaacaaaactatctcttaccatgaccaacaagaccatctctcttcaccatcctatcccaccccacctccaaccttacctatctccatcttctctttctcggactcactctcctgcaaccatagttggcctcctggctgttcacttactaaccaaggttgctctgattcagggcctttgcaatactgtctcctctgcctagaaaggacttccctccactgtctgcatggcttactcctatagcttcttcccttacagggaaataaatttctctgactcccatcccatacactcttttttctcactgccttattaatcaccagagcccttaccaccatctgacattctttcatttacttatttgctaattgtaggtcttctctactcgaatgtaagttccatgaaggcaagaattttgtctggctcatcagagcaatgtcttacacatactaggtgttctttaatatttgctgaatgagttggtcttgctcatctctgaactgttagtgcctggtgctagctgtgtatatgttgaactaatgagtattcaaaggaagcaagtcatgggaatagatgaattcactccccaagacagaaaaagagaaaaaggccaagcatggaacactgagagactggtaatacttaaaaaaccagactgacggctgggtgtggtggctcacgcctgtaatcccagcactttgggaagctgaggtgggagaatcagttgagcccaggagtttgaggtcaacctgggcactgcagtgagaccctgtctctaaaaaaaataataaaaaataaaaaaaagaatcagtgatggaaaagaagccagtggaggaaacagaagaagagcaacccaaaaattagaagaaaaattaggatagcgtattatggaagccaaaggaaaaatgatcagtagtatcataacttggcagacaggatgcgggctgaaaagaagtggatgcatataaaattagttgagctgaggtagtagagtccaactaatgacccagttgcagttggctaaaaaaagtggaggtagaactttctatgtacatctcttttagaaagtccatcagtaaagagaaggaagagtcaaatgtgcaatggcagggaaatagagcagagaaggtatttttcagaatagaagatacttgagtcaacgaagaaggaaagacagaagaagatataagaggaagtgaagataacagagaaaaaagttcagaagggaacgggaagagtagaggtaaccaattaaccttgggaataaggaaggagagagataggtaacaatatacagaaacacttgaaggagagtaaaagtgcaagaattcccatctctagtttctaagtgaaggagttcatgaggtcatatctgagagtaagaaaggagaagtgtggttgtggttaagagcaaaaaaaaaaaaaaaaaaaactttaacagctgtaggagaaaagaaggaaatcaatccctagttgtctgaggaatacacagaattcctaaggcacgacagaggagccaggagagcttgtaagtaattaatcagtatcaaagccagccaacagggctatagcagtttctgtcacacagcaattggcagcctgccaggagaaaaaccgagttagagtggctgtgcctgggactgcatctcaagggtcctgtggagaatatattcaatgactggtcatagggtgtgtcagaccatttttgcattgctataaagaaatatctgagtttgggtaatttataagaaaagaggtttaattggctcacagttctgcaggctgtacaggaagcatggcactggcatctgtttctggtgaggtctcaggaagcttacaatcatggcagaaggctagcagggagcaggcctgtcacatggcaggagtgggagcaagaggtgggggtcgagggaggcaccacacacctttaaacaaccagatttcctgagagctcactatcatgaggacagcaccaagaggacagcatcaaatcaaccataagaaatccacccccacaatccaaccacccctaccaggccccaccttcaacacgaggaaccacacttcaacatgagacttggggggacaaacacccaaaccatatcacagggcttctggctaagcagggaaataaaagcagcaggtttgggtgaggctgacagaattggagaacaggaaagagatcagattttcaaaatcagcatgatgatgagaagcaagtttagttaaagttggagaagaaaatacctgattgtgcagtctctgaagtgggaagaacaaggttcagtaagttctgaggagtagaaatgaaggtcgctaagagacgaaggtctgtgattttggtggtcttgatgagagacatgatggtggagagagggagaagtacagggacatgggtagtagggacgggaccaaaaaaaacaccaagagctggtgacaaagggccattgaagatggagcagagtccacaggtcctgggggcagcctggagggagaaccatgttggctgtgaaactaactggaaatcccacatcttctgatcccagaacaacccagctctggagagatctagacttacaagtaggcacagtgaaggtcactagggtcaccattttagtctacctgaaacacaattcactctctgaaagaagttataaaaagcaaggtccacctcctaacagtgacaggctaactttatttaactaaatatagttttactatatttagtaatctaacttcaaatgctttcaatcagatgctatattaaattgaatcagcctatcttcctaattattaagcatggcttggaaaagctgaaggaaacacaacactgctaatttgcacagaggcttagaaagtgattcacttgaaagcccctcccctaattcaggtaagaaggaagaagataagtaaacaatgatgtaaagctttaattactggctcacactttttatgataaaacacacactgcaaaattctaaggtggccaaacaactcttaagcatgctttgaactttagtgcaaagaaagagatacgtctgtaggcttttgacaaacatctaggtattttcatttaattttcccactcttgtttgttgagtatgtttttccacaagcagaattaaattaaggaaagccaggctttttaaaaagtaattgaatattagcattagtcaacagcaacagtttgtaatatggtatttccactgcagcacctagggatggcagaaaacggaggctgctgataaactgtactggcatcttatctgtacccttactagatttctaaagtttatttaaatggttattctgtatctgtgtctcataaagggatgtcatcagaactgccacctaaggagctattcctaaagacctcagacctactgattcagaatctccaagaataaggatccaacaagtagattttaacttcttcagtgtccaccacactgtcctgtttaagaacacctgtagtgtaataaggtaagcatgaagtgtccccaattaagaacacaatcagctttagagcagtggttctcagccttgtctgcacaatagaatcaccctggaggacattaaaaaatcccaatgctaggccacaccacaaaccaattagtacatcagaatccctggggtaagacctagatattggccttttgctgcccatgggattcccatagtcaatcaaagttgacaaccagtgaagcagaggaccacgtcaaacaactgtttaatgaataaatgaaaaagactaatttaaaattctctgaatttttccttattgaacacaagaaatgatattccatgctatcagcaacatgcagactaggatcaaagggctatggaccttatagtaactggagagattgtctgtgagtcatcaggcagacaacagaaaccaaactaagcaggtggcaatgtgttaggaaactcctgaatgcatttaacatttagtaaaaggatctcgacatcactccaggcaaaaggaatgttgatctagtagttaaggtaaattttctttatggaagagactgcctcattaagtcaccttgtgcaatccagttcatttcttcaaacctttctgttgcaaaatagcatcaagaaagttctgaagtccaggttttagatacttattttgctctttttaaaaggaaaacacttgctacttagaagttcatctatgcttttgctccctggactttctgaagtttcagcaaacaagtctttaataaagataccatgcatttaacaaaggacaagatttctctcaccagtttaaccaccgacagggttcatgtcacaggatgagggtcaatcaggattggtcaaagtgatgtctaaaaggaagaagctgaggcaaaattaacatggagttcatttgggccaaggctgaagactgcagccagggacacttccaagttgccttagggggtgctccagagaactcaagagagaacaagtttgttttgttttgtatttttggagacaaggtctcactctatcacccaggctggagtgcagtggcccaatctcggctcactgcaacctctgcctccgggctcaagcaatcctttcacctcagccttccgagcagctgggaccatagaggcgcgcaccaccatgcctggaatgttttttattttttgtagagacagggttttgccatgttgcccaggctggtcacaaactcctgagctcaggtgatccacccgccttagcctcccaaagtgctgtgattacaggcataagccatcatgcctggcccagaggtcaagtttttttttttaaaaaagcaagaatcaggagaggggacaattacaatcattgttcaccaggaattctcattgtcttacaaaaataacattgattattggctatacattgttgaactataggtatacggcattttatggcttctcggcagcagtcagcatagcactcaaatagcaagtggcttcaagaggtaattatttagctcaaggggagtgatatgactcctgtttcattccaatgcctctcttgggcctgaaaatttaaaggggctcacgttcttcaaataatggattatgaagctgggtcataccacttccacagggcaccaagagcagcccaagtaatcaacatgtaaccccatgtaatcaacaccagcccagggagctgggagtagaggttaggaagattgaagaactgataaaaacaaagtaccaccaaatgaaaatctgtactcactcaattcaaacacaagtgggttccctgccaagcctcaagagaaaactggaaataggttaattttaaagttacagttagttatgtaattgacttaaggaatcagattttttttttttctttgagacagggtctcactctgtcacccaggctggagtgcaatggcgtgatcacagatccctgcagcatcgacctcggagctcaggtgatcctcccacctcagcctcccaagtagttgggactacaggtgcacaccaccacgtccagctaattttcccattttttgaagagacaggattcgtcatcttgcccaggctggtctcaaactcctgtgctcaagcaaccctcccaccctggcctcccaaagtgctgggataacaggcattagccaccatgcccagcccagatgatacattataagtacctacataaggttaagaaaccagtgagattattttcctaaactaaaagaacttccacaaattttggcaatctttgaagatcactaacaagtttcttaagacatgggagcattgcaagataggagcttgggggtgatgaaatagagccagaaaaactggactctattctgcataaattttctttcaaaattaagacaatcttttgcagattaaaataaggatcttcaaactctgtttccgtggatcactgattctctgtgccctgaacagagtcattctactacccaaaatcagataatgaagatcctttgtcaactaacacggaggaatagttaagaagattgttgtcaatttcatgatgcactcacattttgtaaccttgggtacttgctatatagcttgtctacacaagcctctattatataaggagtctgacttattacaaaattatacattagctattcgaagcttattttttaacattttgaggtgtcacaggaagaatgctaaaacttctaggggctctgtcaccactaaatgaatttgaggaccaaccagagcaacagtctgtagtctgtattttcttttatgactaatcttaatacataaatcataaagaagttgacaggagtaaatgcatagtttcttttagtagaagagctctaaatcacaaagaccctcatgatggttttatgaaaagggtcctttcaattccctagcacctagcctggtgcctggcatgtagtaggcccttcataaagtggtttgacctgaagatggagacataagcactgttgtgtgtccttacacgagttacgtggctggcacagccttgctttcctcatccagaaaaaatcaacaggggagaggggcaggggataaatgttatcacaaaattgtttacctaaagtttaataggaacttatcatttgcaaatcatattagtgaaggttgctttttgcattagagcaactgtgctctcctttctgctttggacactagcaactctaaattggtttccagtctttcacagctccgtgctgtgctttcaaatcctcactccagtcccgttgtgatctgaatgtttttctatcacgcctgtttagagacaaggtctggaaacatggcacagagtatagctaaccaccttggccaattataggcatgaccctgtaaccttgttttttcactgctccaatccttcaattccaggaacttatgttcccaggaaaagctagttactgaaatggacacacgtataattagtttagagaatgttccaaactctactccacgtcattttttttttatccttgcatttactgtttgttttaatggctggaaagggaagtttaaaaggaaagtgccagaaacaaaggagaatgtttaaaacatacaaatcaccctataaacataaaaaataaaaaacaaaggagaatgcttaaaacatacaaatcaccctataaacataaaaaattttaattcactggtagtaaaagatgcaaattaataattactattaacttaataaatccacaagatactttatcttaggtagtaaagattttgtttcgtctccctttaaattataacatctagagttgagataaggaggtgaagaaaaggatagtttctctcatactaagctggtggaagtataaataacaggttgagcacacctaatgggaaaatccaaaatctgaaacgctccaaaatccaaaactttttgagcgctaacatgataccacatatggagaattccaaagttgaactcatgtgatgggctgcagcataaaacagtcaaaactttgtttcatgaatgaaatatttaaaaatattgtataaaattactttcaaacgctcaaaactacacaaatacctggaaattaaacaatctcctcctgaatgatttttggggttaacaaatcaagatggaaattttaaaattcttcaagatgaatgataataatgacacaagttttcaaaacctctgggatacagcaagaggaaagtgctaagaggaaagtttatagcactaaatgccaacatcaacaagtctgaaagttcacaaaatgacaacctaacatcacacctcaaggaactagagacaaaagaaaacaccaaacccaaagctagcagaaggaaaaaaaaaaataacaaagatcagaacagaactaaatgaaactgaaacacaaaacaaaagattaataaaacaaattggttctcttaaaagacaaaactgatagaccattagctacactaaccaagaaaaagaagagagaaggttcaaattagttcaattggaaatgaaaacggagacattaccactgacaccacagaaatacaaaagatcatttgagactgctatgaacaccccatgcatacacactagaaaatttagaagtaatggatagattcctggaaacctacaaccctcctagcttgaatcaggaagaaatagaaatcctgaacagaagaatacacacagcaagatcgaatcagtttaaaaaaaaaaaaaaaaaaaagccaacaaaaaaaaatcacagggccaggcagattcacagccgaattctaccagacattcaagaaaaaattggtaccaaccctactgaaactatgccaaaagactgagaaagacggaatcctctctaactcagtctatgaagccagtattaccctgatagcaaaagcatgaaagaatgtaaaaaaaaaaaaaaagaaaaagaaagaaagaaaactacagatcaatttccctgatgaacacagatgcaaaaaagactcaacaaaacactagcaaaccaaatccaacagcatatcaaacagacaattcaccatgatcaaggtggggttcatcccagggatgcagggatggtttaacatattcaagtcaataaatgtaattcatcacataaacagagctgtaaaaaaacatgatcatctcaatagacacagaaaaagcattcactaaaatccagcattgctttgtgataaaaaccctcaacaaactatgcatagatggaacatacctcaaaataataaaatccatccatatatgacaaacccacagccaacatcatactgaatggggaaaagttgaaagaattccccctaagaactggaacaagacaaggatgctcactttcaccacttctgctaaacgtagtactggaagtcctagccagggcaatcaggcaaatgaaagaaataaagggaacccaagttggaaaagacgatgtcaaactctctctgccaatgataaatgaattcagtaaagtctcaatttaccaaatcagtttacacaaatcagtagcactgctatacacaaaaaacgaccaagctgagaatcaaatcaagacctcaacccattttacaataactacaaaaaataaaatacctagaaatacacttaaccaaagagatgaaagatctctactaggagatatatatatctctgtcccaaaatccaggctcagcagaaggatcaaagccaacacttcaccaaagaggaacacacccctaggaaagccaacatttgacttttgacctgagctgctaagataaactgggccaaatttctatttattaggaattcctatttggaagcccagtcgtgcttgtaggctctggatctgaggtgctatgaatcaggatcagagccagtgaccatgtggaatgtggagccaatttcaacataaataagcagataagttgtatgatgcatttttattataatcatatattactttcaaaattaaaaacaaatgcaaaaacttttggtaagaaataacccaagtatctgattgcatgtcagagaagaggatactggtttcctgttggtgaataccacctgcatctattccaagcccacacaaagaaagtgctggaggcaaaacagggataggtacttgttttcagaccacaattgttggtttctgctttcctgttggtttttttcagagctgtctataaacacaggagtattgacttattactgccataacaaaaacaccttgtatttgcaaaacatacttaagtggaggtacgggaactgttctgtagacactggctaagtcagacacacagtcatagaatcacacgggctgctgagctcaaagcactttataaatcaacccatccaggccaggagcagtggctcacgactgtaatcccagcactgagggaggccgagaggcaggaggatcgcttgagtccaggagtttgagacgagcctgggcaacatagttaagactttgtttctacaaaaaaaaaaaaaaaatttatgagtgaggcgtggtggtgtatgcctgaagtccaagctactccagaagcctgaggtagggggatcacttcaacttgggaggctgagctgtgactgtgccactgcactccagcctgggcaacagagtgagaacctgtctcaaaaagaaatcaacccatcctcccgttacagatggatactcatggagggacatcaagttttcacattattcacgagctatgtctgtctagccccatttttttaggggatctgaggcaagagattcatagagaaaaatcaaggtgctgggaaaagagcaattactaatccttaaagaactacactctaagagagtccaccttctcttgaaaggaagtcctagatcacaagctgatcctaattcaactataattcccatactgtccctagaatagctccagaatgtacaaattccccagggcacttaattctacctggggccaaaaaagtccccaatgcagctcaacatcctctggagtaatggaaagccaccagatcagaaggggaatggaaggagaggggcatgaaatgaaaaacagattctccctaagattcagtgatcaagccaaagctgccaagaaacatgaagatcacaggcccaaagcacccaccctgagcccctccaggctaagctgaggtggggaaacgggggcagtgtcatggaatggggagaacatgatgccagaggtggttgcctcaggctctgtaaggaaaacacacattttgaaacatgaacaaccatatagacaaattcaaagaaaggggcaagactgtattcagtctagacagctacttcaacccttgttgtccagtggagacactttcaatccagccaagctatcctcttggctctcaatttaggacagagaggcctacgttgaatgattagagcctaatagggtgcacctatgatcattcatcttggacccagtattcatcaggcctctaaacaaagaacagaacagcctggggtcaaccatgggcactcacccatttgaataggcaggactcactcaccccacatacacacacatactcatatatgcacacacacacatactgatatatgcacacacatataaacttaaccttggggttggctgctgtcaaacagttctgtcatccattcctgatgactcacaccagagaaatagatatataagtaaactggaaaactacaaatcacccctaaatcatttctttccaggaatgaggatgtgatttttcagcaactcaacatttctattagcttatttatcccacacatcttctccttcccaatactgaaactagttgaaattccctgaagtgacggcaagtgaaagaaacaggttagagatgagtggaaaaaagaaacagtccaggattttaacagattttcatggttgggaggtcatcaacattcagacacccaaaaatcaacaatatctatagacccctacactgcaggggaggtaaatgactacaataactcttctgtatctcagagaacatacaggcataaagaatggccaagtaatgtgctatctgacaaataggacaatcagcagtatacaacattatcacatggtcttacaacatcacagcaaaattataacattgctttacaatgagcaaaaatccttttcgttcctggccagcaacttgattgtaatacagatacccaatattttaagaatcatggaagaggatgcctacccaaaacacttagaatttccactacttttagtggtacaactgattctgtgaatacagacaaacaggaatgcaggaaatgctagaattcattcgtcaacctgaaataatttcccccaaataaaccctgaatgtgttagaattcaagagtgatgcaaaccattgtctaagcccatagtctcagaggaaagcacatttattaaagcacgttaatgttcccttggccatcctagcgtgaggtatacagcatgcgcatctttaatggtgccactctggaatgcacatcctgcactctgcactcttctttctttccttgtcctactcctactcagagccactctgagcttaaatgcaaaccagcttctctgtactagcagaaaaggaagaaccagggtagatgggatgaaagtgtgattccttcaaccattatcataacaattacataggtactaagtcaccactctatttgacattacagattcattaaaatgaattccataattccaaatcgttttcttttgatatgtctatgctgttcagagtctggtctgtcacttttggtacctcaggaactaattcaagagttgaacaagtcctagaagctccattcatattaacccaactcaaagaccacaatgctccaagtagaaataaatcccaagagaccacagggttctagttaggctgatttaccacttaacaaagaaataaaagtcctactggtttcaaccctgatttgaaaaaattctttatataatgcatatttttcctatctcaagagggcagagtgctctaaacaggatgaaactctctgacaatgactcaaggggcattcttctgaacacagaatcacagacatcttccacgctacagtccagccctcttgttttacagaagcagattaggacaagtgacaaatgtgtccaaagtcatatcagcacttacattcctatactcgatcattaattgacaccaccaatcccccaagtatcccaatctcagaacttggaatatagcctggataatgagtaaactccatgcttctctgaataggcttcaacagtatgagccaaagaaaaaaataaattagttccccccgcttctgatctaaacccctagaagacaggccagtaggtagcaggtcttgccctcatttgtgaggaatgaggggctgcaagtggggaagtgtgagaatgtcagaaggtaacttcaccatgagtttccttgtagacccagtaagagacacatggtacaactggtcattagcaagacagcattgcctgccacatccatcctatgggaagataccaggactatgatattctataggcaataacactttcttccttgccagctgcacccattaacagaccacagtttgtttttaagtgatctagtacttacatttcacaatccagttgaaccatgggaattcactgggtaggatttttgataaggtatctcacccggctcaaatatattaagctaactcagaaaggtctcctaaaataatcggtagattcctgaagggtcaggatgctgtcctgattctagggccaaccactttacttaacatatagtagatattcaatagttatttgtcaaactgaactggacatatgttgggtatgttaatattgggactaaatatgcaaaaaaaaaaagagagaacttcagaagtctgggttttattattacaatttgtaatgatgtagcatatgtactgaaaatatccccagagaatatctagtcaagtcctttatattcatacagcagaaaattgaggctcaggacagataagtgaatgcttccatacttacctgttatatggggtactgaaccagatcttacacacacacacacacaccccatgaccacaccgttttttcgggagggtgggggtcacttgctcttatcatctaggaatgaacaagcgaaaattccaatgacaggctggtaaccttggttctcatcaaattgaagtttcacattaatgtgttccagaggataatgtgctaagttaaattaatcatccaattatttagttaatagactaagtttatctgggataatgtatgttttcaatataagaccttttctaaaaatcattaaatcaatggaaaaatatgaacatttgaaataaatactcacatgtaagttaagggccatttctcggaaggatctggtatctcaacctctctcatttaagaagtctattttcctaacctttctgtatataaaacatcaccctcccacacacaatcctagattaaaatatatattcctgtctctcaacaacattttcatccccaagatccaagccaccatgtaaacctctggtttcaatgatgctttatagccaagactggactcttaagaagcagaattgggagcagaatagtgagaatttcattcaaactcaatgtttttcagaagagaaggcccagattataaaatattttaccccaggtcattcaattaaacagcagggcctgaatcagaacgtgcctttgtgatccacaaaactgtctgcctttatggaagtgattttgagactctcaaagaacctattactgaaaaactgcctcttccctaaaaaatggatcaaactccagttacctattttcattcctgttaataactatatttctacttcatattttatgtctagaggttgctagttttgttatttcttcttcttgtagctaataattattgtctcctatctctattaagtaaaataatggcaaagtatactgatccttttgccaagcagagctgagagccccttcttgtactcctcatatgatctcattaaaataaataattttcatgttccaaacttttaaaagttttatttaatttctaaattcacttattttttccccacaaaaaatttccatttgtctttctttcgtattaaaggtttagacaggaaaccagataatgaaattcagtggaatgaacaggcactttaattctgtttgccgggcactggcaacaaaaagtatttgggaacataataggcacaaagggagtcactgggcagtaaaacttctggcttatcttctcatccaggttgaattcatttggatggggtgggaaagtaggataacaatatggcaaattttccactttgttgccaccattggtgggaaaatgttaaggcagagactgcaagccctgtggcatggtacaatattttagagtttttttctttatggcacaatattttagttttttttttaaagtataatcacaggctgaagtgaattatgcatttataaaaactagaaatgcaaaaaaggaattctaatatcattagtggttttgtaataacacaactgtaattaataatttgcatcttgaacctgtgcagataaagctgaagtcaaatggcagttcgaatctcccagttaaccactgtcactgttaacaaataaaaaaagattagataaaagtaagacacaatgaagcaacttttgtttaaagatttttctacccctacagtgcagagagaaaaacaaaagggaatcacataatttaaaaagataagggtgaaggggaaagggagcattttaatcacagagtgtaaaataataaggaagatgcatgtatgtatgcttcccagcccattattgtctataaccctatggttccacgaagaaaggaaacaggaaactggagcaagccatctaatgaaccaatgaggccaaaagggtaaaacagcaaccctctccatttggatgacttccaaaattgcatccatccatctgagaaatgatcattgaatgcttactttgagtgaggcaatattctgagcaacagggatagagcagtgaaccaagcagagagcaaccccatccatacaacccccatttctaatactgcttttaggctgcaaaaatgtatttccaacatggcacctccaactcacacatctagttgcaagatcatcttctttgctccccaaattactccttctatgtgtcccctgtctcagttaaaagcattaccatccactcatttcttctgaccaccaaattgttgtcatgttaaactccaacctctccatttttacctctaccaactccttcagtatatcacagaatacctgattgctgaatatctacaaagtttcttgactctgtctccaccttttcattccctgtaccattagggacctaatcatcttttgcctagattactgcacaagcctcctgaggattttaggtcttccctctgaaagctgctcaatacatcctccatttcacttgatgaaaatcatatcctttctcctccctaaaaaacccccatatgaatccttgactcctctcttcattcttccgcacatccactccatgagaaaattctattgattcagtctccaaaatacatccatattctgaccacttgtcacctctccccttatcacactgttcaaaccaaattcatctctacaatgactataatacttcactggcctcccagctttaacattgccctaggttagcctattctcaaaacagcagcgagagtgatcctttaaaaatgcaagttagtcaatattgttccctactcaaaaccctatgaggtacccccacagtcactaagagtaaaagccaaagtccttaaaaaggcctgaaagccctagatgatctggcctcttatttcctaacctcatctcctctattctctcagtcactcaccctactctttctgcttcagccattggctcctaaaaattcctcaaacacagaattgctcctgtcttaggacctttgcataggctgttccttctgccaggaacattcttccctacatatccacatggctaactccctcactccttcaagacttttctcaaatctcacctcctccatgaagcctaccttgaccacctatttcataatgcaacttcctcctatatactcacaacccctttatcatgtgctattttttccccaaagcaattatcatctaacatacaatatgtagtttacttaccatctttattgtttactgtgtctctccccattagaatgtaaactctacaaggggagagattttgtctttgttcagggttttatgccaactgcctcaagtaccatgccatagttaaatgttcaacactgactgaatgaatggactgatcaccctggttgcaggatctttgccccaaggtcatctttttcaagcacagctcatgacatcaactccctgctgtaatttttttaaataaaagtataaatcagacttcccctaaaaaaacccaactctttttgctgatccctttcaacatttttgctttaatatcacttttaatgttcttagtacaattgttatattttacaaaatactctttctggaatgtagtggttgtttggccttctgtatgacattttaactcacctagtttcctttagaaagttactgactttaaaagaaaatctttttgagcacgagtgctgccactttaaagactacttacaggacattttaggggacataaaaacaatcctaaataatcacaaatattaaagtaagagcatggtacacttgcaaaaattctgccagagataaggttcagccgatggtaacatccatgagctgtattcaggcactttgcaattgaatgtatcatagtgattctttttaaattgaagagggactccgaattatttcagattttgcacttttatggtactttctatcatgccctttcaaatttatataaaaaatgttaactattgtagctaagtttgccaagaaaatttcagtgaaacaaaaggtttttagactcagattttctgtttatgtttacaagcacatctattccatatatttagaaatacttgtatttagacagacatacttaaagaaagccccttaacacattttataaaacactacaaactgactttgtgtatgagttttagaatgatggctgacacttacgaagcagttactatatatcaggttccatattaagcctcgtttaacctccaccacaaccctgtgaggttggaactattactattcgtatttacagatgagaaggcaggggttcagagatgttaagtgacttgcccaaagtcacagaactactaaatatccagttttttatttcagatccctgttctaaacggctccatgtcaggcttactgctttgcctcacacttaaaatgtatgaaagagaaacgactaacttcattaactgccagttgcagcaacatcttttgagcctaagcaccttcactagtcccagagtcatagcagccatatttgaacaacagaatcccacctcaactgactagaacagagttaggaaaatccacctcctcgggaattcagagttggaaatgagagcagacctctccccgtggctgtacataatagatgaccttgggaccagcttctgcctgctttgtaggcaaagtagcagaaaatgtcagtttgttgagaaagaagcagatgtgtagagaaaaatcacaaagtagagacaaaaatcccagagtcactaagacctcctgggtttggttccaagtcttcctgagtatgggtatgtccctgcttttggatttcatgagaaatcccagaaaccggaaaaatctattatctctctgtatttagtggtttaagtgggttcctgttacttcaactaaaagtttggttattcaatactcagatctgggtttatacatggggctgaaaaccaaataatcttcactgagcaaaaagaaaacagaacatagaaggatttgaaatgctggcatttagaaatatagtcaattaatctaaagaacaaagtatctttaaaataaaattgtgatagtctcaagacatcaggaaaatggttttatcttggagagttagaagatgaaatgaacttacaggaaaaccatgtgagatactaaaacacaatgagcagcagcaatagaagatgacccaaaaaaagcaagcttcttgccatcacattactaacaataaaatgcacacacacgtgagaagcaaaaaataattggctctattttcaggcagacaaaaagtaatttccatatattccctgtatctgtgttcaaagattttaggcagcagaatcatctggatatttattaaatggtggattcctgggtctcaacacagagctacagaatcactccctggggatggagctgtgtttttgtttttgtttgtttgttcgttttgaattggggtctcactctgtcacccaggctggagggcagtggcgggatctcagctcactgcaacctctgcctctcagattcaagcgattctcctgcctcagcctcctgagtagctgagactacaggcatgtgccaccacacccagctaattttttgtatttttagtagagacggggtttcacattgttagccaggacggtctcgatctcccgaccttgtgatctgcccacctcaacctcccaaagtgctgggattacaggcatgagccaccgcgcctggccagagctctgttttaaagcaatgatcctcgaaattgtttgtttcagcatcctctgcattaatattctgaagctatatacttatactcacttatccatttttaagttgacatctagtttgataagttgcataaggacataatttccaacttgttataaatatccagatttataaataaaactgttaatcattcccttacattgataaaaatctctctaggtatcacagagatttgaaaaacattactttttttaaaaaaaaaagaacaagcctggtggtgacaaaatctctcagcattagcttgtctgtaaagaattttatttctccttcacttatgaagcttagtttggctggatatgaaattctgggttgaaaattcttttctttaagaatgttgaatattggcccccactctcttctcgcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaatttggttccattctccccgtcactttcaggtacaccaatcagacgtagatttggtcttttcacatagtcccatatttctcggaggctttgttcgtttctttttattcttttttctctaaacttccttctcgcttcatttcattcatttcatcttccatcactgataccctttcttccagttgatcgcatcggctcctgaggcttctgcattcttcacgtagttctcgagccttggctttcagctccatcagctcctttaagcacttctctgtattggttattctaattatacattcgtctaaatttttttcaaagttttcaacttctttgcctttggtttgaatttccacctgtagctcggagtagtttgatcgtctgaagccttcttctctcaacttgtcaaagtcattctccgtccagctttgttccattgctggtgaggaattgcgttcctttggaggaggagaggcgctctgctttttagagtttccagtttttctgctctgttttttccccatctttgtggtttcatctacttttggtctttgatgatggtgatgtacagatgggtttcattgtggaagtcagtgtggtgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacgatgatatattggattaagaaaatgtggcacatatataccatggaatactacgcagccataaaaaatgatgagttcatgtcctttctagggacatggatgaaattggaaatcatcattctcagtaaactatcgcaagaacaaaaaaccaaacaccgcatattctcactcataggtgggaattgaacaatgagaacacatggacacaggaaggggaacatcacactctgggaactgttgtggggtaggggtggggggtagggatagctttaggagatatacctaatgctaaatgacgagttaatgggtgcagcacaccagcatggcacatgtatacatatgtaaataacctgcacattgtgcacatgtaccctaaaacttaaagtataataagaataaaataaaataaaataaaataaaagaacaagctccttttcagtcatatatcctcttttaattttttcttgaattcatacatcttttccatatccccagcagaacttcaataacatatttttatgcttgtaaatcttttactgatcactctatcatgctccccacaaataaactgtgtacataattgcagtctcacattttacatttcctgtggccgtaagttttcaatatttttaaattttctcttatggactaagttcctaaaattattattggtccacaattgatcaaaattaatatataataaatgttgacaaatccataatgtataaaaagtaaaacttttcagtaatacatctcttaatgagatggataggttatatttttatttacacaacatagaggattttttaatttttttatttttaattttttttgagacggtgtctcgcactgtcgcctgggctggagtgcggtggcgcgatctcggcccactgcaacctccacctcccaggttcaagcgattcgcctgcctcagcctcctgattagctgggattacagatgcctgccaccacacccagctaattttttgtatttttaatagagacagggtgtcactatgttggccaggctggtctccaacgcctgacctcctgatccacctgcctcggtctcccaaagtgctgagattacaggcgtgagccaccacgcccggcctgaggattattatttatcactaggatgagatacagttcagcatcagttctattcctatttttcacattttttaatgtagatataaaatatacgaaacctgctctcataaataaaataggaatagaagtttagcgactgtaaaatcattcaattctttggacttcttcttaattatgtaacaaaaaattgcacatgaattatcaatatttttaaagatcagctgacaatttgagtatattttgttttattgaaagcaaagaactgaaaatggtttgttatctggtaatattagagtcattcactttctcaacactaacatcatattttgagtttttcctttggcttgtgccctggaggtttttatttccaaggccaatgcaccaagatttaggatgagagagtagcgcctttctctcctaactgaaaatagagtagtcgtgaaaggggaagcgataaaggagaatccacacaaatgaacaatgattttcttagactcctatcactgctacctaccataacttagaatgcccacgtatccccaggggcatgtgtatcctggtttcgacacactaattggagctctgttcattcatgcattcattccacaaacatgtattaagcacttgcaacatgccagacacttatctaggcactggagatacagcaatgaacaaaacaagaaatcccctgccctcatggcccttctaaaggaagcacacaatctgttaggtctgtgttgggtgctacggccacctgcctgagcctcctgtggcctgctcttctctctactctaaagaactgtattcccactgtaataatttgaaatgccaactagactggattaaggaatatctagaaacctgtaaggcattgttttggaatgtgtctgggatgatgtttccagaggagattggcatgtgagtctgagcggactaggtggggaagatccaccctcaatgtgggcaggcaccatccagtctggtggatggtggtgaagacagtaaagaaacaggaaaaaggtgaatgtgtcattctatctccaggatctggaatacactcatcccctgccttggacaacagaactccagggtcccaggcctttggactccaaggtttacatcagtggctccccgggttgcctggccttcagccttggactgaaagttacaacattggctttcctggttctgaggccttggggacttgaactgagccacactaccagcatcccatggtctccagcttgcagatggcctgttgtggaacttctcagactctataatcacataagctaattcccctaataaatcccctcttatagatctaaacagttgtacagttgtccctcagtatccaaggggaattggttccaggacctccttcaggtatcaaaatccacagattctcaaatctagatataaaatggtatcgtatttgcatataacctatgcacatcctcctacatactttaaatcatctctagataacttagagtatctgatacaatacaaatgctatgtaaatagttacattgtttgggaaatactgtttagggaatgacaaggaaaaatatctatacatgttgggtacgaatgcaaatttgttttcaaatattttcaatggtggttagttgaattcatggatatggaatctactgaccatatatatatcctttttattctctctggagaactctaatatgctaacttagtcaacagagagccaggaagtacttactacgtgccagaacattagctaaacccaaaagaatagagaggatgcagactggtcctccacagtatacaataagcataaaacctctcattcagattcaccttatataatacattaagtcactgtttaaataagtttatgttctacaaagcaaagaccaaatcatcaccagggtcaagcagattctcctctgcctatgtaatattaatctattggctgtgcttaacatttatttatttatttatttatttatttatttatttatttaaattggtttttttaagacacagggcctttctctgttgctccggctggaatgcagtggtgtaatcataacttggtgcagcctcaaactcctgggctcaagagatccttctgtctcagcttcctgaatagctaggcctataggtgtgtgccaccactcctggctttttttttttttttttttttttttttgaagactaggttttgttatgttccccaggctggtctcaaactcctggccttaaagcgatcctcctgccttggcttcccaaagttctgagattacaagcaggagccagcatgtccaaccttacagtttgaaacataattttgttcccaaactacggatatgagtaaaccacatccttggcagtgactgcgttctaggataatttttaatcattgacaaaacaaattattcttcctatcaagaaaaaagtactagttctgaggataaaacactacatgtttgtcaagaaaacaaagtcgaccatccatgaaaagaaagtgcacaaaaatgtacaattcctagggtggaaatttccatcaatcagatatactcttggtgaaaatcaagggtcaccatgtcacttaagttgcaaaattcaaagtattttaagttcctaagttaaataaccccaaatgtttcttatcaagaaaaaaagcctctccacctaaacacatagctacaatttataattaccaaaagaaacctcacaatggccctttgtaaaggatgatcctcatgtagctaaacaatttcccactccctcttctgtggtgccttttaaaattatcattataacatctacagtcagaaggtaaaaattgttttttcctatatgaagttaatatagaatacataattagaacttattttccacttgtggtaattaatatgcttgcaattatagccactattccataccattaatccctaaaagtaaaggcagctagcagagtaaggagacctctgagacacagaagaaagctggctggaccacatgaaagtggaactcttaaatctgccttcaaaagtgcaacagtctagccacaagaactacctagtatagaattaacattctaatccaaatgagaggaaaattctaaggttccatcttgatcaaaatattatgattataaaaacattccaaagttcagcaaaccgtactaaacttacatagtcccatatctacctctaaatatgctataaagatacaataaaaaatagattgtgtagtgaaaaataagagatatagtaggctctaaatagggtacagtccatgaatttggggtaaagccagaaattaccagcctctgaaatttaggttaattatgaacttaaaaaagcaacaccaatgatgggataaactggcaccctgtgctcctgctgagatgcactgagaaggatacagtgtcacctatggaatattcctgtccaaaatgtttaatcttaacctaatcacgaagaaacaattagacaaatctaaactgaaagaaattctgcaaaataactggcctggcctcttcaaaaatgtcaaggactaaaagacaaaaaaaagttgagaaattattccagattaaattcaataaattcatattgaatacctactgtctggataacggcagtgtgtggtggctaagaatgtatcaaattctgcctcaaaatcctatctctaccagatggaaaagacatctaaccatgccatgtcctggtctcctctcagtaaaatgaggatagtaatattacagtaccttcttcaaaagattataccgagttcaatgagttcatctataaaagccttagcacagacactgctcaacacttaataagtgctcggtaaatgtcagtggtgatcatgaccatgatgatggtgaagagccaccagatgctgggggaggggaacagagagactaacatcgtcacgtcctcactgtgcttacagtgagatgtgagttacagaaaaatgaccaggcaattctaagatagtgcaatagatgcactttggctgatgaaaggctctagagttcaaaggaggccgttaggtctttctaagcaaggaatgctggcattggaatccaggtaatgacagagaggtgaggcaactagggtagaagagatcaaacttgaggactgctaggatcgtgaggcaggggagtgctgtagattgagtctagttcctggcttggcagctgaacgggctgtggtgccagtcactgagaaaaaggagcccagggcatgagcaggtttaggggcagcaagagagtcggctgacgctgggtcagactcaaccagaagggccacccaaggggacttgtgctggactcacaaaggcatgtggcagagaagtcctgatcttgagagaaaaggatacattctgcattccccagaataaaacacctaaagcaaacagattttatcttgttcttgcctggactctaatttcaaaacatgataaagaaaaatacagcagtcctatcaatcttatgtatttcacagtgtaactattttactgtaaaaatagaaattaggagggacatttgtggctctcaataggttcattaaacctaaaattgtaaattcccctgccagaaaggtggtatgctagccagatgttctcactctaattgagaacattattttgcttactaaaggtaagaaagaaaacatttaggtcaggctcggcggctcatgcctgtaatcccagcactttgggagactgaggcgggtggatcatgaggtcaggagttcaagaccagcctgaccaacatggtgaaaccccgactctgctaaaaatacaaaaatacaggcatggtggcacacacctgtaatcccagctactcaggaggctgaggcaagagaactgcttgaacccgggaggcaggggttgcagtgagcccagattgcgccactacactccagtctggatgacagagcaagattctgtctcaaaaaaaacctttataaactctcatttcctaggttataaaacacataacccctcacttctacccacagaaataaaactgccaggaacaactctgtgtgcttatgtgcctatgggcaaaaatacataaactatattgatatcataaagaaaacactagattcaatcttggcccatagagtctcaattatcaatccaatcagaagctgaagctggatttgccacacaacacaaaaccagtcttgctgccacactatgtgctcattcagtgtgtgcctgacaatggctacgggcaacactgattctctgcctacacactgtctttgaggtacactgcaccgtctgttggcttaatctcagatcaaactgccttagctcatgtacttgtgaaaaagatgactgattgtccccaatatccattctatatgcccccttaggagtagaacccctagagtcttggaggcttactagagttcacctttccaagcttctttggtagtcaggtatcatcacgtaccttaagttctggcaactgggatgtgagggcaagtgatgtctgtgatttccagatcatgcccccagaaggaaactacttggcctccactttccctttcccacagaataaacaaacatacgggagtggtgaacctcctgcagcctgcacatgagcagaagcactgaggcaatggaagaacaacaagctagaaagagcctgagcgcctgactcatgaagcaaagagctagattccaaagtgactactggcttaaatttaaaattttatattattattattttatttatttttttttttgagacacagtctcactctgtcacccagactggagtgcaggggtgcaatctcggcttactgcaagctctgcctccccggttcacgctattctcctgcctcagcctcccgagtagctgggactacaggcacccgccaccacgcctggctaattttttttttttttttgtatttttgtagagatggggtttcaccatgttagccaggatggtctcgatctcctgacctcgtgatccgcccacctcggcctcccaaagagagacagattcttgctatgttgcccaggctggacttgaactcctgggctcagcctcctgagtagctgagactactggcacacaccatcatgcctggccagcttggatttttatatgagaaacttattctgcttaagctactattattttggtctttataaaaacagccaagccaacaccttaattcatttccactcaaatcattaaaatgtgtgattatgcagaatttatgtaattaaggtgtgtctcactttgttttagagttttgcattcctttataatgactgcagacatctcagcatcccacacagttgacaataaatgcttatgttggaatctccaaggggcataataaacaggtacagttaataccactcttctccaaatggtcatatattaaatctgctctttaatttgttgctagaaccagtatttgcagagtgcaagacttccgatctatctgacaaatttttaaccttggttttatatatgatgacaacattctacacccagcattaggactaggctacactggttttcttttttctctagaagaggacagattgtactaaggcctaagatcgtactaaggtgcttatggtaggcagaataatgtctcccatagagtcaattaccatcacaacccaacacgttcatttcctaatcccaggaaactgtgaatatgttatcttacatggcaaaaggaactttgcagatatgattaaggatcatgagatggggagattcttctggattattcatgtaggcccaacttcatcacaagcgtccttataaagagggagacatgagtgtcagagtcatagaggagatgtgataatggaagcaaaagctagaagtatgccattgccagaaggggccatgagctgaggaatacagatagctgctagaagcacaaaggggcaaaaaatggattcctacccagaacgtccagaaagaacacagctctgccaacaccttgattttaggccagtgaaacccacttcaggcttctgacctccagaattacaagagaatctatgttgttttaagccacaaagtttgtgataatttgttacagcatccataggaaatacagtgtccttacatgtagcactgtatattgtaataacccaattgaattagggtaggatttgtccagacctaaagagctaaatgaaaataagcaattttaataatatataatcttattaataatattgttactaatattatcagtagtaataccaatagtaacatacaattgttttgcctttttactgtaatcacaaaggtagctctccctgcctccctccccccgcaaaaaagaaaaagaagtcacagaaattgaatataagtaggtacaagcaaatcttgtaactagataaaaggatgatttctacccactagcaaatgactcttcatctcaagatgaaattgaatgccatttttactgctattgttttgaaggatgaatgctttctctgctagtaaaacgcgttcaataatttctgcaggccgggcatggtggctcatgcctgtaatcccagcactttgggaggccgaggcgggcggatcacgaggtcaggagattgagaccatcctagctaacatggtgaaaccacgtctctactaaaaatacaaaaaaattagccgggcgtggtggcgggcgcctgtagtcccagctactcgggaggctgaggcaggagaatggcgtgaacccgggaggcagagcttgcagtgagccgagatcgtgccactgcactccaggctgggtgacagagtgagacttcgtctcaaaaaaaaaaagagaaaagaataatttctgcaaaggccaaagaagaatttaaagagtttttaaagctcttcttgataaccaaaatctgtaaccatgcaggacattcccctggtattatttagttcaaatctccatcacttgtttcagttttacgcagctgttgggtacagaaaaccaaacagtcacccctgtggcttccgtatgcttcaaacagtaccattcctggagaagggcaagattcactggccctagcttcattcatctgggccgttcaatgttggccaaaagggtccacaacccacaggaaggtcactagaagctaaaattatcactgctcccttaacctgcttcttgtcagcaccagctaattgcccaccattgtgcttctggctccatgatggtgttattatagttcccaacgcagggaagtctcagcacaacacctttggaaaatgcttaccctgacattcctaagagcattccaaagcaatgcccttgtgtgcctctctggcctggagctcaaccatgcctgatggtagaaggttcacttcaagatcacattcttaagcatggcctgttttcactgccaggatttcataaaatcatagaaccacaattgtactataaactcttggcctaaatttacgtcccctccttcctcctgaacagaaccaaatgaatgttgcttaagatccaaaacagatccatataacaggactccttttgtttcagaaactaaattacttctttgtgatacatccctacattacattagaataacactatctcctgtgctgtactcataggaagtggagttatctccttggaccagatgcttggttttaaagattgttttgtttgtttgtttgttttttatctgcttccctctgtctcaatttgttctgggctttggaagccttcatatctccaccactgataatgtctaagtttttctacctataccttaagtttcctgccacatcttcctgagttaaggccctttaaataagcatcactgcttttcagggtctggagaaaggtctgtctactccaaacctcagtgggaaaggtggacggcatgcactggataccctttgttgtctctgagtaatgatctttattaaaccttttaatggaggcatacatttacctgtatatcacacacttaacctaggaagctttctgtcctatatatgttccaatttggtcttgctcacttcagatatggattcctaatatgtaaaatataaggctttttgctccttaacttctaagtattttaactcactgctatttggcagtaacattaaaagcaccaaaaaaaacaactcagctcaacaatctaacactatttctcatcccaaaagctaacccataatctttttaggtttcctcttctactttttgttttactcataactcagcatttctttgcaacaggagctaataagagtttgtttttgtttttttttttctggtttatgttatctgcaatttacaagaattttttttttctcctccctgtgttaatctgccaaaacaaaataccttagactgggtggcttaaacaacagaaatttattttctcacaggtctagagcctggaagtcccagatcagggtgccggcatggtcagtttctgttgagggatctcttcctggcttaaagatgtccaccttcttatgtcctcacatggcagacagagagagagagaaagcaagcccttcggtgtctcttcttataagagtgctaatcccatcaggagggccccaccctcatgacctcatctaaacctaattatctcccaaaggccccatccccaaacatcatcacattcggagtcagggcttcaacacatgagttttgtgtgggacacaattaagatcatcacactctctccttttagggccgatttttatctgccttggaatgaatccatgaccagcctttcttcattaaataagcagggacagagactgaacacctgttaggtctcaggcccaggctcagtgctaggtattcaaagaggaatacatacaatttctgatatcagcagttccaatattcccaagttctagatggaaataccttattgtgctggcttactgcagcagccatggaaatatgccagtcagagctccctttctggagaagcacaactaactgccggcctcttgctgccacagcttcaggtctaccatggcattcgtgcagaaattgtgtttctactgggctgcgagccagcgcccaagtgtgcagaggtactggaatcactgctgttgttgcccagtgcgaaactccagcaacaggcaactttgcttagggaagccccatccatccagccaagacttctcaggaatacatggcattgtaaaattcttccccatccctccttccttcccactcttccttcacagatgtcagacctacagcatggtctgaaggctctctctaccttttgtggtttcctccctctttccacttcatagacattccccaacttgcattcaaatcccagcttggcaactgcttctcagaggatctgggaaaacagactcaggaattaacttcacttaaaataactaaaaaacatgtttagctttcaagtaacctgttcatctaaccggggacaaatactcatctgagacagctaaagcaaaaggtgatagaagaaataaagaaaatctgctttttcttacattcaaataaaggcaaaacagaaaattattctcactataacttaatataattgggcatacagctatggagcatttgccaagtaccagacgttgtgcaaggtattgtaaaggctataaagacaaacacaagatagactccctgccctcaaggaacttacaagctgcactcctatcttttattcagaatttttacatcattcattttaaacaaattccttaagcattttgtacacacatacatatgttcttctgtacgaagcagatgagtaaacaagattacttcatgtaaatatttttaagtccttacttagaaaataatttggtctttaaaagtaagtatcactatatttccatctagagtctccaaatccccaccctaggcctctaaagggaaaatgtcaagacattttatcacttaatctgattagaaaagtccttcatgctcatctacatagatacatctccaaaatcccaagttaagaaatgagctcaaggcatttgggtcaactgacacaggctggtggaaaaaaaaaaaaaacctcaaacatcttaaaatattcatttttgttgttgttgtattgtgaaatatttacatacaaaaagtatataaagtaaatatgtagtttaaagaataacataaaaaaacactgtgcgctcaccattcaagttaaaacccagaatattactataacttttttttgtttttgagaccgagtttcgctcttgtcacccaagctggagtgcagtggtacgatctcggctcactgcaacctccacttcctgggttcaagcgattctcctgcctcagcctcccaagtagctgggattacaggcgcccgccaccacgcccagctaattcttgtatttttggtagagacagggtttcaccacattggccaggctggtctcaaactcctgacctcaggtgatctgccttaagtgctgggattacaggcgtgagccaccaggcctggcctactataacttttaaagcactttttcttccctccactgctttagaacagtttctcaacctcacgctattgacattttgggcagataattcttaaccagaacattttggatgcttagcaatacccctggcctcaacccataagatgacagtagcatatcaccaccatcaccaccagttgtgacaaccggaaacgtctccaaacacttccatatatcccctggagggcaaagtcaccccttgttgagaactactgccctagaggtaatcacaatatgaatttttgcttttatttatagtatatcaacatatgtaaccctaaaacaatgtattgcttagttctactgtatttgaactccatagaaatgaaattgtactccatgtattttcccgtgacttgtttcttacattcaacattgtttgtgagatacatccacggtgtattattacaagctgtaattcacacaatcattttttcatatatttttgctgctgtattgtaatccgttaaattaaaactccataattgtttaatccaatctattattgatggacattcgtattgcatctaacattttgcttttatgaatatttctactaggaacctttcctacacaggtcttctggtaattacacaacaatttctctgagctatatacctaggagtagaattactcagtcacaagatatgctcatgttcagctttattgctttctaaagtggttgtatatatttatacccccatcagcagtagaggataattgccatcactccacatgatttccaacactagggtcttcacttatttttcacaacatgtggtaccacaaaaatatacattgcttaccgtgtaaatcccaattctacaaacagcaaatgagatctggatgcattcagacattctctataagattaaaataagaataagagaataagaaatgtttgtaccaaagaactgtcttcattccccttgctcttgtttccctctttaaagaaaatctgctgtattccaacatctgttttatgaggaagtggctgaatttcttccgtctgttttctaggctagctcaaagacagggataataaagtctggggcatgtggctttatcttgggactgtaaggcagatactttgtcctctaatacaagagcatcatttaaggagtgtaacttattgtaatggtttaattttacttctttcaaatcttgctctaatatcccattttaataataaatatttggctgctataagtagctttttaagcattctttttcagttcaattcttattagatcataaaagtctataatccttataatggatagaaaaaaatctctataaaagggaaatgctcatagttaaatgctgaaagttatgaatgggctaaattttgacagaagactgagatccttggtctcagaatatcaatggcagtactcaacttagaattcacaacttctaactcccaaatcaaattcagattcctaaaacacatgcccactcacaaaaccatgcataccaaacatgactactggtttcttttcctttctttagctggagaaatatttttagcacattaaattagcatgtagtcaaaataaccctaactttatacagtcgaacactgttattatggtttattgttgacaagttaaagcttctccctaaagtttataatgtcataaatctcagcaatcacggttttatccattgtggcaaggaggcaaagacataggatccctggctttctgtggtagccaaaaggcttccagagatgcagtccttgaggaagaccaagaagtcgcatcagacccattctgccaaaggctcttgcccctttagacaatatccacaagaaactgaattctgtatgattgaaggaatttggtaaataaaagattggaaagccaaaggctatatgcgtggacattaaaaataaaaattacagcaatggaaaatcaaactcttaggacactctgttgagtgaagtacttaaactcaatctaaactttcaaatatcaacggtgctattgttcaaaacaaatggctgataatttcatactggggatcatgatcacatctattattaagttattactatcatgactgtaacattattgggtttattttgaatgaaatacactactgaaaacaaaccaggggccatgccctggcatcctcagagcccaagactaagaacgctcattgccttgtccaagatcattcttcccatctacctttggaaattaccccaagttgtacctttgtaacataatagtgaatgactgaacaactctctgagtaagctggaaaagttatcttccccaactgaaagataactcttattttatgccacctggaataaaagatttaccagcctttcttggggttaagtgttgtcctgtgactaagttctccaaaatgagatgtaactgaaaggtgcttaaagggaactgactctgagaagagcccttttttgctcttctgcctttcctacttcttttccaggctgtaacggagacttaatgtagctccagtgacaatcttgggttgtgacggcacaatgagaacagtggacacatgaagtagaccatacagataagagaacccaaagatgcaaatgacagcagagttgccattccctcctcttccagactttgtacatgaaatagaaatcaacctgtaactttttgttttctgagacagggtctcacttggttgcccaggctggagtacagtggtgcaatctggaattactgtatcctcaatatcctgggctcaagtgatcctcccacctgagcctcccaagtagctgggattacaggagcatgccaccatgcccagcaaatattttaatttctttgtagagacagggttttgccatgtttcccaggctggtctcgaactcctgagctcaagtaatccacctccctcggcctcccaaaatgctgggattataggcatgagccatcacacccagccctctaacttgtttaaaaattgttgtgtgtctctcacagcctaacctaatcctaaccagtacagagcaacgtttgtttttaaaaagtaggtattcccagtgccatatgaaagggctctagcacctatcatgagagaattaactctttttatgagctttatcttttaaggagggagaaatatttactctttagttactaaaaacctactttccactccttttcatattctcaaaatgtacaagtattgttgttgggattgctaaaattattaccctgaaaaccctcaatttattttgtgtaactttttttctgactaaccatattacctcattctctctaatctctaatccttacaaatactgccttatccttgaacatccgacctcaggccaggtggcatgtctattgccccagcttgtaaattcattctaacaataatattctcaacaatggcctcttccctctaattactaggagtcggatacatatatttaaaaacataaccaaacttcctttgatcacagtatatgaactggtaataaattttaaataattatattatttccctatatagatgctatatttgcaagaaactattttaactgtaaacccatgagacataaggcataacttggaatgaaggataagtagttaactatttccaataaaagaatgagtttctatctcagataaactctgacccggtagcctctacagtaatattcataaatctacatctagacttccctgaggaagaactaaagaatattatttcaaagatgaatctcatcttctttgctgcctcatctaataaaacagcaaaaaagatgtcaaaaacaagacagattggttacaatctgtttaagagaggtctatagaaaaagaatgcctaagacagaaaaagaatactaaatttgaaattaatgtgattacttacagtttattgttgttttccctaagaaatttcaaaggtaagcatgaaaataaaggagaaaacaaaacttcaacaagatggcagaaaataaacgttatttactatacagtccaaaaaatggtatcaaggtataatttgagttccatcagagggctaataaacacaatattcttttagagagctattttttatacttaacataattgacagttctaattttgatgtcctgtgcaatccctcatcctgatacaaagcaagatgacagttatattatcttctcctctataattctgcttgatgaaaattaaaaagttaaaacagccaagccagttcttcagagtcctgcaagcagtatgttaaaactggtaaaacaagaaagggcatacgggagcagtaaaaccccttcgaatgaggccctagcttgggtcctctatttccaaataaggttaacaaagatccagcatttcctctcaatagcagacaaatgggctgaaggcaaagatgcaataaatggaggatacagagagtgacgacccgttccaaggtacatgggaacgctaaagtgccgcgtgggtcgaatcctttctgagtaaaggtcgcgtctgtcaattatgctttagtcactcctccagagtggaaataaacacttgggaatgccacctacttcagaactggcatctccttctgttagtattgtcactgaaaacattaacagtgcattatttcacaactcccttagtacacttgaaagtaattttccccaaatgggaaaaaagtaagttttttttttaactaattacaaaataaaattaggatttgtttacaaaatgtagagcattttgctcctcagcatatattttatagcttcttcaaattaggagaaaggatgatgataatctacccaaagagaaacatttgcaatctaaagcaaagctaataaaattggcctctcaacattttctaaaaatgttttcagtggtaacagtgccaacagcacgccaagagcatctatacttccaagcaatctaccaatgtccatggatggaatatgtaagagttcaatcagtattcaaaaaggaatcaaccctctccctattaaaaaataacaatcatcatgattagcacatgatctctgtgaaattcaatcacaaagatttgaaaagccatctagcagaaataacctgagatttgaaaagtcatctagcaaaaataaccaaatgaaagcataaatcatcatatcagaagttacagatttcatccagcaaaatgttagcccatcttctataaaacatcactaaaaatcacacgtaatatccaggcagattttggctgaaatggtgaaggtaagaatagttctcgttctgaaaattctgattaaaaagtatggagggagagaaatccccttctaacttagagtaaaataatgagtaccacttatcttggaggatttattccttcacttttgaccaggcactgggaattttaaaactcagttcaaagaaagaaaacgaaaaaaacatttgcagggctttttttttttttttttaatgagacagggtcttactgtgtcactcaggttggagtgcagtggcgcagtcttggctcactgctgcctggacctcctgtccaggattgcctcaagcaatcctcccacctcagcctcccaaatagctaggactacaggcgcacgccaccatacccagctaattttgtttatttttttgtagagatgagttctcactatgttggccaggttggtctcaaactcctgggctccagtgatcctcccacctcggcctgccaaagtgctgggattgcaggaatgagccactgtacctggcccagagcatccttaatgtggcaagcacttctaggtaagtgttaagtatagaaacataaagaagaccaaaccctagcatcagtgatcttccagttcaggagaaagcggtaattaaacatacctgtgccagacaagtgcaatgtaaatgtgttcagcacaatcaggggtatgcacaatgggctttagggaaacagagtagaggcatcaaagtcattcttataggcatgtcaggaaagacttggaagcatctcctgaattttgagtctcaaaagattgagaggtatccaagttcaaaggagcacagaagaaaacggcattccagataaaagtgaaagcaagaaacatcccataatgcgcaagcatctgagggctgctaatgcatgccctagacaccttcctagtctttgcaaataattgcttctcagtccgatatcaattattgataactattaactgacaatctacatactaattaaaatgcattcatatgaatatacaaaacatcctcattttaagacttatctctaactccctgccaaaggaatttccatttgtcagggacttagcatggtcacatcatagagtctgttttgcctccccacccttttagatgcaaaggcccacaagcaagatgccacagctgattgaactagcaggcagtttagccttagtagctgaccaacaaccatggtgtggcctagcaggaagggccaggctaacctaatcatattctttttctcccaaatttgagttgaaaaatactgaaaagatgaagcagttcatagtgcaaaataaaactgagggaatacaaaaagcaaagctattaaataacttcataaccatgaagaatcacagcaatctaaatttacaaagctactagtatgaataacaagaaactatacaaaaaagaaaagctacacaaagcagaggagaataacaaccctgctaataaccccaggagaagtagacccagagagaaatcagtatgtgaagaatggctgagtgcagttgcagacaagtctgtttcttagttaaaaaactatattcctcagtttcttgcagctaggaatggcagcatgatcaaattctagtaaatgagatataattagtaagtcttacaagtcttccaggagggaagcacactcttcttctgccctttcaccatccagctatctggaatgcagaagtgatggcaggagctctggcactaattttggaccataagcttaaagtctacatatagtgggcagaagcttcttggggccctaatgacttctggacttacttgcctgagcaaaaaatgaaactgtcaaagccactatattccaaccaattccagtcctaattgatacagtggttgagagaatgtgacagaaccacaatttgaactcaagtcttttggacgtgggggccaaactcaatcattatgagcaagtgcaaatgaagtcaaacaaactgagtaaagcaggtttacagtttacatgtattttataattcaacaaatcataaaagtctgactaccaaaggccaataaaaaagaaaaacacgcagatgcagtgtcactcacctactacaaataacactttggacaagcctctttgactctgtagcctacctggacatataaggtttttccctcaatacaagtacctacaataaggcatatgggcaataaaaactgaatataggcaccagcttctcatgcatggcagaaacctatcaaattcagatttgtaaggagtagatgagacttgcaagagcacacgggattctggaaagcctacagcatattttgcaaggaagtaagaggcctgtctcattaacttcaagcaaaagaattttccatacgtcattaacaactagaagaactcagcccaggcattgtaactccctaaaccactgatgccccagggtggcaagtgtagcatagatcggcaattcctttgaaaggctcaaggattttagatgcccaagctgaagcaccaatgaactttgtattaattctcttcattaattaaacaatttcatatttgcattgaccacacattttgtgcccagccatgtcccatgctggggacggaacagtgagagcaaagtccctgctcttatggagcctacactccagtggtagtggcacacaaaacaacaaataaaatcaacttagatggtgacaagtcctatgaagaaaaaaaaaaaaaagagagaatgtgcaggagagggtggatttccggtactgctatttttaagagcagacgtggtcattctaacaatattatagacaataaaagagatgccaaaaaagctttcaacagctttgcttcccaaaccccttgcataggcaaacacagtatttctaccgtaaaaagtcacagcattagacactcaattcaataatccacaaatatttattgagaagcagttctgggagacattaagagcaaatctaacagctttcagtgttaagactttctggaatcaaatcccagccatacaacttactatttgtaggagcttgggcaagttgcttaacctctgtgcatcttaatttgtcatttgtaaaatgaggatcatagtagtacctatttcattgggtactaagaggattcaatgagttataaaaggaaatacagtaagcttcagatttgtattttgttttatatattttgtaattgacatataatgtatattttaattgaatatctgctatgttccaggcacacaacttcctctaagcatttgcataatggggccccacacaccaggaagccccaggggctgcagtctgccatcagcttctacagatgccttgcattcaggccttgtctgtactcttggtgtctccgcctgctgtcacctgcattaccaggactaactcctgtgacttcttactgcaaatactgtaacccagaatggtaactctgagattccccaaaggagtaaacattccaaatccaagtttctctcttaccactctgtctcaacagagccagcaactgatgcaaaacaataaacaacatccattttttagccaggcctcacaatattgtccagattggcaatgcgacatgtttaaactgaagaagttttagtctacattatataagattatatcaactatcactcaacctttttttttttttttttgaggtagagtctcactctgtcatgaggctggagggcagtggcacgatctcggctcgctgcaacctctgcccacctcctgggttcaagcgattctcctgcctcagcctcctgagtagcttgggattacaggtgagtgccaccacgtccagctaattttcctatttttagtagagacggggtttcaccatgttggccaggatggtctcgatctcctgatctcatgatccgccctccttggcctctcaaagtgctgggattacaggcatgagccaccgtgtccagcatcactcaatattttaatattcaataatatttaatatttttaatgctattataatgataggcatctactttgccatgcattgtccattaggcacttggaagcaaaattaattagaatcataaggaaaattatatttattcaattatccagagtatgaattcatcttccattccctacgtcccattcgtttttaatataattaaatgaacacaacttttcagcactgtccttctactaaaaccttagaaatcattgtttaggggttctttccttgaatttatctttttaagccacttctttgggcatgatacctacactgtcaaatctatatttaaagtcctcaaaatattcaaatggccaaccccttttactgaatcagtacttctatattaacttacaaaaattattgtactgccaggaaaaggctgactacaggagaacgtggtctaacaaccacttaaaggttcaaaaaaatttctatttgcctattaattagacaatctcaacttttcttcttgtttttctaactgtggagggaaaagaaaggtaagctttgaggttagacaaacctgggtttgaaccattcaataagttactttagaaaactcatccaccctgaacttcaataagtggtcctcagatgagaaaagagaacagataatccttggtttccatgggggattggctccaggaccctctgcagatactaaaatctgtggatgctcaagttcctatatgaaatgctgtaatatttgcatgtaacctacacatatccacctgtatactttacatcatctctagattacttatacctaatacaatgacaatgttgtgtaattattagactgtattttttattttgtattattttttatattttttgttcaaatatttacaatttgcagttcattgaatctgcagatctagaacccgcagatacagaaggctaactataataatactaaagctactaactctactgaattaaataagcaagcatcaggtgcttagcaaagggaagatattttctcacacctagtgaatccaaagccaagccgcccacatctactactggaatgtggatgagtctcctgaacaggccccactagttcccatctgatccctgtataatccatcttccattcaacagccagagcaagttttcaacatgtaaatctggtgctatcacctcctgcttaaaactatttaatagtttaagagtaatcttaacagaaacccaactcccagccacaactgccagaccctacggaatcttaactgggctcccctggggcttgggttcacagccaatttctttgagccactcttcagcatctgataccccaacctctgagattcctatgagcagctataccactgtctcatacttgctgaagacaaatagccccaatctatatgctcagggaactacttggggttttctgtaagtcccagggatccctgtgcccaactcaggtggtagtatctacctacttttgtccccagggactcaccctatttcccttttctttttcaagggataccactttttcctaagtcttgtagattttctccttaccccatccctaaagcctggctgccaagtggcaggagccctcccctccctcccttgctgttgatgttcttgcttctccaaagatgtgcacactggcccttctttatgaatgggttttagtgctaaggactaaagggaacagatatgtggaggttgatataaaaatctaacaactaaaggcagtatagtcattgcctatgtttctgacatgtcgtgtggataagcaagccactgaaactcctgccctccacctgttatcagcaagcggatctctccaaagtcctcccttcactctcaaaccagaaggcagaatcacaacccatgaaccaggtgagctatagaccctcgtaagcccactcctttcagatgaacagtttgcatttctgagggcagagttcctattcaagcgtttcattaagatagtgaataatgtctagtaactatacctatagaaattgagtagaaccacgcacaattcaatttaaaaggatggccttatcttacaagtcacaagagaaggaaaaaaaggcatttactaaggttctactatgcgctaggtatttttatactgtcgtctcactcagcgctcacaattagagcaacgtgggtatttccaggcctgtttctcatattaaaaaaacaaaaggatactagcccgaggctagcaagtggcagaaggtagactactgcccaggtctaattctaagccagtccttttccaactctgcaacctcacacggtgttgcaaagagacagttggatattcaagaaatacttttaagtagaaattgaattttaattagagactgaaatgagaaacaacatgttcaaatgtactgtatataaaattttaacacacaccacccacacataactcatgctgccagagtaacttggggtggggggaaagatcaagtttcatgataaaacctatgttctgccttctcactgaagatcagctcaacattgcacagtgagctactttccaatctgtaacatttgcaactatgattctgttggaatcctgtttttcctcaatgctacaccaaaaagagaacaaaatgcagaaccaaataaactatttgataagccttcagttctcaaccatgtctaaaggcagtttttgtgttcatcagaacagcttcattgtcctcactgattaatatataataataataaacgtgtaagtaaatatcataaatataggcttgtaaaaagtcaaatatagtaaaatatcacttgtttaatagttctgcataaaattagttggaaaaaactccactgcctaaatgaaaagaaacatgttagttcctcccctataccacaatgttttcttaaataactcatagtaaagtgaagagagattggctgatacattaggatcaacctagaagcaaggaaaaagttgaaaggaactttgcatctattccaacctctcactcagtgcatgaacccctttctgtgatgtccctaacaggcagggacccagcttctgttctgtcatttcctactcaaggaagatgaacaaatcttaagagaattcttctttacctgaaccaatacctggccttcctatgatcatgacctgctcagattcatagaagactttatgcccttcaaacaactaaagccactcatcatatcatcctttttttttttattgttttgagacgaagtctcactctgtcgccaggctggaatgcagtggcacgatctcagctcactgcaacctccgcctcctgggttcaagcaattctgcctcagcctcccaagcagctgggactacaggcacgtgccacccacacccagctaatttttgtattttagtttcaccatgttggccaggctggtcttgaactcctgacctcatgtgatccgcctgcctcggcctcccaaactgtcttgctcttctttaaaggttctccccaagtccaaaagccaaaactccaatgccaacgaaaagtatcatgcaatactgcctctcttctttgaggaggtaggtaaatcctattctactaacccagcggctggcaaattccaatctgtgggaaaatccagtccactgcctggttttgccaataaagttctgttgaaacacaaccacagccatctgcctatctattatctacagctgctttcaaactactaaggtggagttcagtagttgaaagaaagacatatgtatattacgttcagtgttacaggctaccgtctcagtagttacaagggtcatccctgtattatttaggatgcccaaatgcctgccaaacattaagctcacaataagtatttgctgagtaaggaaggtcagaaaaggaaagagggagattagaaagaagggaaggtagggcttttcttctcccaaaactaacctgaaatccagccttatagaatactttaaaacctgacagatccttgtcttgctgcaagatcttttaacacagggctacacagcagaattaaaattgaggacctaaagcgactatgttttatttcaggcacataaacactgattaaaatatcatttaataaaacaaaagtccttgttaattttgaatgcacaggaaaatactactcatagtgttagaagcatatgtatttgttactgttgctactgcttattgtcttaatatcactcactgcagttatataaagcaattgggataaataatctttccctcagatgaactcttaagcactctggatttggggaaatagaaaagaactgctttaagacagatgaggaaaagactgaatcatcaatgagcttactataactcttgattcttcatctccttcatggtttaataatcactcacttttacgatggtttattcaagacaacctttgtagaaagtattaaaatatgcatcacatcttgcacagcttttcaactttttaagcaacttgtttcattatacttgtgttctcttacaaagaatctgatgtgaagaattttagaattagcaatgcaagatctttctcaacatggaatcgaaatttttactgagtccattttatgaaactatttcacgtgaatattaagtacacataattatttatgataaaacaggaagaactcagaagacatgaaatggaaaatagtcacctatgggtattaacaaagatccccagtatagttaggtattctccccaaataatgacataatgaaactaaaacatcactagcacaggaatctcaggatgcacaaaaattgcagcctacatccacagaaataataaataggggctgcactccaggctcaaaaagtgatgctacccacagcccaaggccaggtcagtagggaccctgaaagagtcaggaaatgcaaaggaaacctaggagcaatcgcgtgatcacatctaaatgacccaacctttaaaacacacatagaaatcccaaaaaattataggaaaaagtatgttacactgaaaaaaacattactggtgaacaatataaaatatacatttctatacaaaatgaaacaaagagagaaatccaataatccaaagaggttttctactttagcccagtgacttgaaaagagaaccagcctcattcaggaaacattcgaaatgaccaagaacggcaacattacccaataaatcgtcccaatgctccttcctctaccataccctgcctctcaggaaacattcatacaggaagaagggataaaagagctggccaataaatcacatgctctgcttctcaaaagcagaaacttgactttcaaattgtttgactccaatgaaataggaactgaaggctccaaacaatcacagaattccagagtagcacctcagaaaactcatctactgagtcggctcgtgtggccgaacttaggtaacagctgtaagcataactggcctgaggagagatgtgggccaccctcttccctgccaggacctttcaccctgtgaatcagaaatagctgccacttaaaacaccagcaagcagttgaagtgtctttaacccagttaccctacactatgcgtattaggcagaggcagggagatttttggaaggctggtagggggaaaatgaatcgaaatggagcaaaatctttttggtgacaacagtaccataagtccttgttttatatacacttttgtagtacttacagaattaggctctcttttaaatgctttatacacacattaactcaattctgcgaggtaggtatttaatactatcattacacccactttgcatacaaggaaacaggcacggaggctgcagagcaggtaagtcacagagctagaatgcaaatgcaggcagtctggctctgcccctgaccattattatgtgcagcatctcagtccaatcaaatatttactcagcacctgtcaggtgtacttgtgccaggttctgggcatattaagaggcctgcaacccagccctgcactgtgccacaatgtgctctgtcctataacacagacaggaacaaaggcccgaggctgggttatggctagcacattaggcacctctgtgccagttcacaatggggatctgggcaagccaagcaggggctggatttcagccccacttgcccccttggccaggcacttctgtgcagtgtctaacaggcctcactgtctgaggcagccctgcagtggccctggaaggaccctcaattctgttttggtagtgaaaggttgggagaagagaagccctctttcctaacgagttctgcagagttaatgcaccaccaccactgtggcagagggttgtatggaaaggctggagagggcaggtactagtgtgagatgggcttattggaaaggaggcacagagcagtgtacagtaaggatgaccttaatatgaaagatgctatttcatctagcatttccctggtttaggtagttgggagaagattaggcccaggtttattgtgctacagagggtcctcattcagattactaaactcacagctcaattactggattcgtaagactctcggcctatttttttctactaagaggggttgcactaccaggggagttctagttcctgatgaatgggcagactggacccccctcaagggactcagttgctgtctggatctatcactaggctggatttctttggaggggtccctgggattgagtcctgccagcttcaggttcctggggcagagaattggtagtttgaagtgctgagtccagaagctaatgaagatggcccaggccaaggcctttccaacaggactgaaatctggttgcaggcagttgttggagcctggagtttgttttgttgtgggcagcctgcttagggctgttttgttagggcagtttgtgaggttagccctcttatgttatgtctggaacaattgtatagtaatctggatgcattgtcagtaaagctaaaatgggctctgtgatcatgacttctatctaattaaaattataaggagcatagtattgtggaaataatttttagttttccctccccttggagagtctacctctgacctctgcagtcttcaattcacacccctattgtctgaccacattgaactttctttccctccagttttctgacttgttactccatacaacatttatggttcagcctcatcaagaccaccaggcccttccatcttctactttctttttttttgagacggagtctcgctctgtcgcccaggctggagtgcagtggcacaatctcagctcactgcaagctccacctcccaggttcacgccatcctcctgcctcagcctccccagcagctgggactacaggtgcacgctgccacgcccggctaatttttgtatttttagtagagacggggtttcaccgtgttagccaggatggtctcgatctcctgacctcgtgatccgcccgcctcggcctcccaaagtgctgggattacaggcgtgagaaagtagaagaaagtagaaatcttctactttctatgtgcccttccttcctttcctataactcagatctcagtctataatttcaaatattttcttaccagtgtactaagttcccgcaccccattgtctacctatggattcaccttagattaggaaaaaccctaacccttaccaatctaacggcccaccttcttaaaactacatctagatggctacaaaggctacacaaggaaagaaaaaagaaatcacacaaccatctaaatgtgtgccaagacggtctgcaacttcagcacgacacaactaccaaccctctgtgtctctggtcatcctcggccctccgtcctcactgcagcttcttctatcctcctcagttaaaaccgctacctgaccacatttcagtcacacttggcaaaatgacctcacgttctactgcaccagcactgcgccatctctagtcccatttaaggaaagccaccccccaaccttcctgcccctccagttccagccctttctcttctctttcctggtgaatgtctcataaaacattcattggagcagcatcatttcctcattccccactcctccactaatcggcaccgcaacaaggcccatgacagccctctggccaaggtcaccactgacacgaattcagtggtcattttccagtcattatcttccatgatctctggtcaacatttaacaaaattggccactttttcctggaaagtctctatcctcacctgcttgacatcacactctccaggtttccttccaacctctcagttctctttctcccagactcctctttctggttgctgttggttttttggtttttttttcctttgcattttttgttttgagatgaggtcttgttctgtcacccaggctggagtgcagtggcacaatcacggctcattgcagactcaacatcccaggctcaggtgatcctcctgcctcagcctcccaggtaattggggccaccggtgcatgccaccatgcttggctatcttatttttttgtagagacaggggtctcactatgttgcccagtctagtctcaaacacctggccccaagtgatcctcccgccttggcctccaaaagtgctgagattacaggcacaagccaccatgactggctgccaagttcctctttggttcctttacttttggtgatcccataaaagctgcatgtatactacacgccagcagtggctgaggccgtaggcatcctcaagtattttcctttcccacacaactgaaccctcatgcatggctatggcttcagctaccatctaagtggttgcaaatgtgagctcaaacattagccagacctaggttcaaattctggctccaccatgtcttaggcacaacatttaatttctctaagcttcagttttctaatctctaaaacgataatagtaaatgtatagcatataaaaaatactgagcactgtgcctcctgcaaaatattaataatatagtatagtatacagtatgtaacaataaatgttagctattagcttttttttttttttttttttttttgagatggagtctcgctctgtcgccaggctggaatgcagtggcgcaatctcggctcactgcaatctccacctcctgggttcaagtgattctcctgcctcagcttcccaagtagctgggactataggtgtgcaccactacgcctggctaattttttgtattttagtagagatggggtttcatcatgttggccagatggtctggatctcctgatctcgggatacatacacctcggcctctcaaagtgctgggattataggcgtgagccaccgcacctggccctaggtattagttttaactacatctccaaacctcacctctgagtttccatttacctatgtgaaatctcaagttgaattactgcacaagcagttcaaactcagtcactctaaagtcaaacttctccctttcccaccaaacctgctatttcttcagggttacagatcatagtgcatgaccccattacccacctcaatacctacagtggttttaaaacatgcccaaaaattcttcaaccttcctcccaccaagagatatctcccttctgcccttgaacctagcaatgccttttttactgccttgatgaaaagaacacagtaaaagtgacactgaatcactgttgaggattgggtagaaaagaccaggcagtttctgccagtttctcttggtacgtttgctctgtaagccttcggcctcaatatgagaagtccagctatcttgaggccatcacatagaaagaccacatgaagagagatgccccagggggccacccttgtccagcacccagctgttgcaatgtacccagctcagatgccaggcatgtgtatgaagccttgaggtgaccccaccctccatctgattacaacttcatgagggatcctgaacaataactgcctagttgaacccagtcaaaccccgattcacgagtaaaatacattgttattgtgttaaactattgttttaaggtggttcattactcagataaccaaaacaatgctcaaaccaaaaacctaagaattatccctgagatctattctgttgtcatcttccacatccaattacaaaattctggcaattcttaaatgttgttaaatccatctacatttatgcatccctcctgccccttcctggttgtgaacaccatcatctcatttctggatcaggacatcttcctaactagtcttgctccagtcttccctccctttccaatccttctctgcactgcagacagatctgaccatgtcattgcaggcaaactttcagagtttccatgaccctagctgggctctgcagcttcatttctagcactgctccaaaccctgctccaaaaacacagaacccctgaagtcccttgaagtcatggggttactcacccccaaatttccgcacagctattccttttgcctggccctggccctgcctgtcactgggccaactttactcagctttaatgttgcagatgttaaaagactcctctgggaagttctctttggccctgaaatctaggttaggttgcctttcatgtgctactctagccgtctttatttccctccagatagactatgctactccaaaatgtaattgtttatttttcatcgtacaggagcataagtaccttgagggcagactaatgtcttattcactcaacatttttttttagggaaaaaagcaaatttagaaagatagagcattatgttacaattttggtaaaattcttaaagcacacacaatgatactatatatggtttacacccacatgcatatatgataaaaagccaaaaacatgcatgagactgttactcactaacctcgggatagtggtcaccactgagaagggtggaggaggaagcgtgcagggaacaggagtctttagtttcatttaaagatcaccagaattttgaagtcaaaatggcaaaatgttcaatcaggaaggcaggtacacagaagtctgttatattattttctgtacttttctgaatgcttaaaataattcataattagaaataaaactctgaaagaattatatttctgtttagctcctgactccatgtctatactgattaggaacgggtatagacctccaatgcctcaatcagtggtcctggagtgcctccagattgtcattcccttccccaagagaaagagagagagaggccagagcagcagctctcctgttgaaaaaagaacccaagggaatccctcttggagagacatggacataattagtgggataagtcctcaactctgaaagcagcagtccagaggttaaaacagttcccagcaaatctaggtacagaggaacttgataaatgagattggcttgcaaatgcaacttttcagatggtgagctactatcaaaatcatgtaggagtgcttggctctatgagccaaagggcagaacacctacctttatgcacactgaaggagagagtgggtaatcaatgaaagcaaaatcagtgagcagactcccgcctcaaacacaaacccacacaactttcccagtgggagctgcactgtcactgagttcccagagggcctctcacaggcaaccaggtgacagaaacaatcaagtgacccctcaatttccagaattgttatctatggttcacacagtctctctcactcatcctctcaacaattattaattataatagttaagcagcaccgaagaatgctcatggccatgggcttagaatcagacaagctcatacactgatcctgaccctgaccctccactggttatgcaattctgggcaacactcaacctttcagagtctcaagtttcctcttttctaagttgctatgtctttgtggttaacagcactgttgggaggattaaattaggtgatccaaggaaaacactcagcactgtaaatggtacacagtcctgtatttaccagacactagactagattccagtgataaaatggtgattaagacggtcagggaaccagcaatgatgcaggttacagactcagatgccagccatgtatttagcgctagaaatctgaactggccttataaattgtgcggcccagtgcaaaatgaaaacgcaaagcacctgttctaaaattaagatttttttttttttttttttttttttttttccaggatggggaccaaagagcagtaaaccaggcatggggctcttctgaacccagcggttgcatggctgggaagccagccctgctaaaagtagatgtgacttggtactttacagacactcggaaaatgagggtcaaccagaactgggcttcttagactcatccaaacacctgggacattgggacatttggggagatgacaggggagagccacaacataacacagggggctgcaggatccaaaacaaaagcccctcaataatttaatttgtgggaagtatcagaggaaattcccacttcttgtcacctacaatagttatgagaccttccctaacaagctttccttctctttagtctaccttagaaataaatccttttataaagttaataccatcaggagattttgcccagctgaagtccataagcaacaggctgcttatggcctagtatctattgggaacagctgacttcccaggcagtgcgtggcaaaagaacatagcacagtctcagtacctcttcaaaagaaatggggctgggcacagtggctcacgcctgtgatcctagcactttgggaagctgaggtaggtggatcatttgaggtcaggagattgagaccagcctgggcaacatggtgaaaccccgtctctaccaaaaaatacaaaaactaaccatacgcctgtagtcccagctactcaggaggcttaggtgggataattgcttgaacccgggaggcagaggttgcagtgagctgagatcaagccactgcactccagcttggatgacagagtgagaccctgtcaagcaagcaaccaagaaaagcaagaaacaaacaaacaaactgggacttggggcaggtaggaatgtgcccctgaaagtgacactaggggactgagtaaggagatcgcaccactgcactccagcctggatgacagagtgagaccctgtcaaaaaaaaaaaaaaaagaagaagaagaggagaggaaaaaaagaagaaagaggaggagaggaaaaaaagaagaaaaaggagaggggaggggaggggaaaggaggggaagggagggaagaaaaacgaaacaaaacaaaactggggcttggggcaggtaggaatgtgcccccaaaagtgacactagggggctgagtaaggaggttgcctgaaaatctatatgtggtcacctggtggaacactagatgctgaagatcacctcagtggctatgaccagggtatggagactgtaaggcaggagttcccagcacacaacatagttctcttcctagccagccttctctgtaacaatcacctgccagagtccttggggacaagggcgcatcagcctgcctgctcatggccactgctttctttaacatagtagtggtcaaggaccacttttctgtacctgtttacttaagaagcaatatactaaaaattttgagtgcatcccaactgccttaacaccaagctgcctgagcctctgcctagcacaagggaactacttgtaggtggaaggcaatgaagagggagggccctggggccacaagcgcagttcaactacttgctagctgtgtgaacttgaggaaattacacaacctccctgagcctcagtttaatgctattacacatgcaaagcacttagaacactggcacagagtaagtgttcaataaatgttaactgattttgccctcctgattataactcatatacttatctcctctcacccccgacctgagcactgcccacatgccaacaagcatgtggctttggcatctttcagaatgcaagcccctggagggcatgaatcaaggtccctatgtgtcctctcctagggctcatactgttagactggagccacagaagtttgggaaccagacttaacacctttgtagaaaagttcctacctaatggtacggatttgctcaaaacatttttgctatatgaactccatatatggtagatctgtttattgtgctcagataatttttatcttataaattattaagaaaggaatatttaatatgactgcctaatccactcgacatttagactaaaaagtgacctacattatcactttaaagttagtcacaataaatacaacttacaatgttcatagatattcagggttaaaaacaacgaaacaatgtacttttttttttatcaataaagaagttcagttcacagataactgaacataatatgaaatcacaaatgtaccttcactcctcttttcaagtaggatcctttacaatttcatagtgcctgtgggctctaccctttgtagcacatcatgggtttctattgttggttagttagctggtttttatcctgcaaatggtgacagatttgtgatgatcaacccaattctctcaccacatcttccccactgagacatacatttttatgatggcagatacagcctataaccaagaaactaaataggtcaagtccaccagtctatacaaagaaatcttattaaactaacctatcaaatctaatcttattaaatcccaaacactggcagggcacggtggctcactcctgtaatcccagcactttgggaggtcgaggcaggtggatcacctgaggtcaggagtttgagaccagcctggccaacatggtgaaaccccgtctctactaaacatacaaaaattagctgggcatggtggtgggcacctgtaatcccagctacttaggaggctgagacaggagaatcaccccattgcactccagcctgcatgacaagagcaaaactctgtcacaaaaaaaaaataaataaataaaaaatccccaacacggtacagtagtttcccctcatccatgggggatatattccaagtcccagtggatacctaaaaccacagatagtactgagctatcatagaactaactaacatagcacagagcacactatattttttcctatacacacacacctatgataaagtttaatgtgtaaattaggcatagtaagtgattaataataactaataataaaagtgaacaatgataacaatatacagtaataaaagttatatgaatgtggtctctctctctcttaaaatatcttattgtactttactcacttattttgagacctcggtggaccatggttaactgaaaccttgaaaagtaaaaccgtggatgggagggtggaggctactataaacaaatgcaatgaatattaattgacaattagcatccaagactaatcaaccatttttacttgtcacattttcaagtctaagtttatattttagttcacaataaaacacacaaaatgagagaaatgtactagaaagcaaagaagcacatcagaagctaccccctcccctatgtgccttacttaacctgtcctgccacaggttcctctagagccacacgactgccagtcctgcagtcaaggaggatattacagctgagggttcatcccgcatgactttcagggccatgcagaaagtaagggctccataaatatttgttgaatagataaattattcaaatgggttttattttcgtagcttttaaaagattcttaaaagagtcttgtgacttcctgcttgttgattacaactcccagtatttccataaattgagactagtttaaaaggtatttcaataccactaagcagtaacagtcattctacaggaggtataaaagtaacatcagcaacataatcacaatacgttaactttttttttttttttttgtcttgagacggagtctcactctgtcgcccaggctggagtgcagttgtgcgatctcactgcaacctctgcctcctgggttcaagcgattctcctgcctcagcctcccaagtagctgagattacaggcatgcgccacgacacccagctaatttttctattttaagtggagatggggtttctccatgtcagccaggctggtctcaaactcctgacctcaagtgatccgcctgtcttgccctcccaaagtcctgggattacgggcgtgagccacctcgcccagccacacaatacgttaacattttatatttgaaaagcaacgtactgtttacaaatggctttccctccactatctcatttaatcatcataggtattacacagagtacaaccaattctaccactgttgttttgatggcgcagagggaaaaaaggttaattccagatcaatcatcacatgagtcaagacagaaaattttgaactgaaaggaatctagaagttgatcttgtccaacctcccaggaaaactcgagaaatgtgtttttctctttcattttaacctgactattttctcctaccttatccaaaaagctctgcacattgtgttactagttctacctatgagaagaaagagtaagatgctggtactgcctgttgggacagcagctaaatgtttacccagagacttggcagatgtaaacatggcctttaaaccccatcatggaaaggggaaaagttgtgtgcccttctaggaagattcactcatcaactggaaaacagagatttttatgtttaaattgccaccctggctaaaaggattatatcttgatcatcttcaagttaagagtaaaggatacattctgcattcccctgaacaaaacacctaatccaaacagattttatcttgtctcagtttaaaaactggtgaaaaaaagcagaattttcctttccatttcatattcatctgattcaacaaataaaatatcgggccctaactattaatacatgccagaaaccaagtcaggcaccgcaccaggtgatacatctaattgattaggattagcaaatttctattctttctctcgactgaaatcaataaaaccctgtcttaaatattaaagtactatccctgtccctcaccttgactgtcacttctgagaacatttgttttaagaaatcaacagcgacccgaagatcagtagagcttcttcatctgttttaatatctcaatcttattaaaaggattaatcctgttaagacaaaatagcacctccacctttctctcccttcttcctttccactctcctccaaataaaaaggttaagtgacgacatccagcccaaagaacaatgaacaatagatacatacacacacacagctctctcttccagtttccaacaggaacaacacaagaaagtcaaatactgattaaaaagaaatgacacacaccatcattcttgtcagtgcatggaaagggaacttactctaatccattcagcaaaatctggagtcaaacttggaatgaaaggagcattttttttccctgcaaggtaagtaaaagaactcaggaattttttaaaaataaaataagataccagatgcaaataaattgatttctattcctcagaaatagggcttttaataaacgccacacagagtatgcataagcaagcaagtcaatccgaaagacaggaagagaaaaataatgtgtggcacatcattttctctgaaagtcgacaagcaaaaggtgaacacaaaaaggctacctcgggagggctagttttttgttttgagatggtttttctgtttgtttccatccagtttaatgctaaagaattttctgaaatcttttcacaggggacacttggcacactcacaaaaactaaactgtttcctttaagatttcttttctcacctccaaagagtagccactggcttttatggggttggtcactgcacttgtgaattttagatggataaagtggcaaaataatgattttttttaaatataaaagtaaaactaagatgtatggcaagtaaagctttttaaaaagccaagtcaaatttgaggcctgctgattttgacacaaagctgttagtaaattggcaaagaaattaatctgcttttagggtaaacttgagcccaggtaaaacaaaaaggccaagtcaaatttgtgacctgttgattttgacacaaagctgttagtaaattggcaaataaattaatctgcttttaaggtaaccttgggcccacaaacattcatccactcacctttagactatgcctatctagaggttagcctgagtaattaaccagagttatcaattttgttttcactaagcattttgataggtttggcacctcaaagacagctttgtgatgcaatttataaatttaaaacacatccggtaaataaagaaaataataaaatgtcagaaccacctgattttcttttttaagaactatttaagtattcaaaattagcttttagtagtacaggcaatgtcaccctttcctacttggtaattatcccaacaaactttcgctttaatttaggcagactgcaagacaaaaaccatgtattgtattttataagataaattacaaattaaatcagttatttaacttagaaaataatcttctggcagctctcttaacttacagggcaccttgtattgtgaagaatgttcataatcagataatccccgtaaccagctacagtactgggtgaataatatccctttatcacaaagataaaggaagttactgccatcaacaaatgaacaacaaaacagaacttgaattcagaattttagatccagctccattcacaaggctatgcattaactgcagtcaccatcctttcccacaagaccatcaagctctgaagcattaggagaaacattttctttatgtacactaaaataagcccaaatacacagataacagcacaaagccggtccggcgtttcttggccatcaaagcatgcacagactttctcagtacagccttaagtgtaattcctagaaggcactggcaaatctctgccaggccaatctgcagtcgaaaaccgagtgcatgtgtccaacaagatgacaggagggtcaatgtttctaaccgtctacttcaactctgcatggcaatagcggttctgcccaacatggtaaacacaataatcgtataggatcgaacacaagtctctgtaaatgaggatccccttaaacgcaaacaagcaactctggggaaatataatttctggaacaaaacatggtgctcgcataattccacaaagacacatagaagtccatttttaaaatgatgttcggtcccagcactgtgctgacacttttcccacctaaacttctcagcacaagcctggcctaaacagccgggttccaatccgtgcacagtggaaccgcggcacgcacccaagaccggaatggtggggctatacctgtccctactcagtcctgttcgtgccagcctgcgaggtagtttagacccgtctgctttatggtaatgtgcttttaaaaccccgccacgaccgaggtcatagctttagagatttaataacaatcaaatgaccagggctgctgggcacttagtgagccattctggttatggctctttaatagcacctggagttctgctccagggagagaggaaaactcctgctcccccggaaagaaagtcctctgcggagagcgcagagggaagccaggaagccgatcgcgggcaggggacgcgccgccgcggccgccccatctctcaagcagccccagcgcgaccctcgccctgcagccgtgctggcccaggccgcacctttacctgtcagctccaccacccacccgccctggaggctgcccctccgagtccagggaaaggcttaccagccggctgcgggagaaagaaccccagaggcatcctatcccaaagaaagaaagcaaaaaggctgctcctcaaggcagggggccatcgggcacgccgagatccgagaggcgacatgccacccctgccctgcacctaccagataatccatgtacagaaacgcctcagttattcggagatcagacatccggcagcctaaagcatccggaacggctccgaacccggaaaaaaaaagcagcgtctctggctgcgagcgagcagctcctgaaaaagccagcaac

SEQ ID NO: 1597 - DNA, 208252 bp, Homo sapiens
gcggcagtgcgagaaagccgaagatggcggtccccgcggcgctgatcctacgggagagccccaggtagctgatccgttaagctcttgcggtagccgcgcccaggaaggcccagatcgggctcgcacaaggctgtccttgctgcctgccgcctgggcgccgcggcgggcccggttgagtggggtggggtggggtgggctgccgaggttgcgacgctgcgtctgcggagtgcgtggggccgtgtagcgcctctacagtcacggtggtccacctgtggggctcacagtgcgcctggcagctgaggtctgtacggaagcgtgtggtctgcaagcgtggggtctgcgtcactgttcgcggagtttggtatcagaagttcccgggtgctgccttcagtgctgccgaatcacgtggaacggtattccgtttccgatttcagttccggttcagacactctggtgggaaaggctcacgctgctgctggagggtctttaatagccaacatgtgttaataccccttttaaatcagtatcgaataggggaccgaatttttggttggtagaagaatctagcctggctttggtagcatttgcttttatttgcattttaaacagatttttagttaatttctacttatggtagataaagttggttgtccatggtagtgatataaagctcccctttaacattatttaagtaaaaaaagactcaatttgtgaaaaaataagcaatagtgcaggtagcgtgtggatacagaaaaagtactgaagtatataggcaaaatagtgttcggaagtaatttctttgtgcttggattgggtagaaatctttcagaagaaaagagttattttaaagtttttccttctttctggattccttttgttaccagtggagggtgtccaggttcttggcgtcttgaacaaagaactggagaagacgcacaaagaaagcgaggaaagaatgaagaagacatttattgaaaatgaaactaccctccacagtgtgggagctgcttgagcataggggctgaagggcccctacagaatttttgggaatttaaataccctctagaggattccattggttacttggtgtactccctatgtaaatgaagaggatgaagtaaagttacaaagtcattttctccgcctatgccatatggagaggacatttcttgtcatagctgaagtgggaatcagctttatgttcccagcctcctgaccctattttcctgcctcactttggttctgatcgccagtttctttcctcataccagtgtcttggggaacaccgctacatcagtaaactgtatccaatatggtgcagtatagaattgttctcatcacatcatttaaagttgattattacaggaaaggtgctgtggctcatgcctgtaattccagcactttgggaggctgaggcgggctaatctctctctcttttttttccctgagagggcgtttccctcttgttgcgcaggctggagtgcaatggcgccatctcggctcactgcagcctccgcctcctgtgttcaagcgattctcctccctgagcctcctgagtagctgggattacaggcacccgccaccacgcccagctaattttttgtatttttagtaaagatggggtttcaccatgttggctaggctggtctggaactcctggcttcgggtgatctgtcctccctggccttgcaaagtgctgggattataggggtgagccactgcaggactgattgagctcaggagttcaagaccagcctgggcaacagggcaaaactctgtctctacaaaaaatacaaaaattagccagcgctgtggcccgcgcatgtagttctagctacttgggaggctgaggcacaaggattcttagaacccaggaggcagaggctgtagtgagctgagatcgtgccactgcactccagcctgggtgacagagtaagaccctatctcaaaattgattactgttgtaataataaatttgattttacagttgaaacagggttttaaaataactgtgtgcttagtgaccccagatgattttgtacatagtatttgaaaagttatttgccttgcagtattcttttatgtttttggtgtaattgccataattgctattcctctcctcccacccctttcagagttccatttttgggttaagtgtttatataaacgctctactaaattaaggctcttccctgcgcagtacaaggtttccctagtagtttggtttgcccaaaagaaagagaaaatttgccaaatggaccttttcagcagaagtaattttgggggcatctttttggaaatgtacccgttgccctgccttttttgctggctgtcatctgtttttatttcactcagatttaccatatagcattcagagttgttggaatgaaaacttatagacaactatagaaagtgcagttcaacttggaaaactcatttcaaaactctgttttataattttgtttagcatgaagaaagcagtgtcactgataaatgcaatagatacaggaagatttccacggttgctcactcggattcttcaaaaacttcacctgaaggtttgtatttgtgtgtttccatgccttgtaatcttccttctgatttaattgaaagtctgattatttggagaactttttgcaaagcatagtgttctccaatatgttcttagagacactggttctgtggaagatttggtaatgtttcatggtcagaagtttgagaaactctgtcttcaataaagttaaatgttttaaattatggaacttttcagagtattttatatgctagtgtttgtggtatgtattcgagggtgattatggcaggtaacattttccaaatgtgtttgaccttggatctgttttattatggtatatattttgggactaaagttctaaaaatatactttagggaaaaattctgatgtcttggttttatttttccgcttaaaaataattctgtggtattttctatcaactggtatttaatctttcacttaattttgtttctctttcacttttattttaaggatatggttgttttggacatgtggatgctttgtaattctctacctggcccaatccaagttaatttagttaatttctttatcaggttataaaaatttgattccatctcatatttatggagcacccactaactgctctgtgcagtgccatgtatcaccatccattgagaaccaagactcttactctgtcatcttgtttttcttggccaagagccagcctcaaaactgtgcctttcccctttgaagtgtctttcaaatccaagttctcacaattctaggtcaaatctttagtacctcttttttagatgacaatagttaccttcaagctggtttccctgcctatagtcttcttgctttctactgcttcataatactatgtaaattactttctaaattttttttcctgaaacaaagatgtattatattttttacagtgttcaaagccatcagtgactgtccattgccctatggagaaaagttagaaatccttaacattgcgtacaagtcccattgtagtatggctgcagtctacattctcctcattttgtaagtgctgcagttacactggatggtacccatttactacaacttgccatgaactttttcagcaatgtgtctatgcatatactctttcccttgcctataaatgtccttcttcccctttactgagtaacttgttcatccttcaaggatttcacaatctcagtctcagcagtttgttctttcttctgtgctcctagttcattctcacctgattttagtactgcatcataagtatttgtttcatgattagcaggcaaccaaatccccaaacctattaatgtgtcttcctctggttttaaatatcttgaggattatgtcttactcatctttatgtttcccattcctaatacattgctactagtatagttggcactcagtaaatgttcttgaagttaattattttccttgctgtggaaaacacaaaacaaacctaagtcttctataatatattcctttttctaaggaatttgtgaggtggatggagagaaaggagaaactgcaatgatagcggcaacattctgtggtatttgctgttcataaagttacattggcttgtttttgactgttgtggtgctaatggctttgtgttactaactcatctaatccgtatggcaacttgaaaacataggtactgtggtcatctctggtcatcttcattttatctatgaggtaaccaagatagagatagagatcagttaagtaactttcccaaggtaacacagctagctagttgggcaacttggctccgtaactctctcccttattacacgaaacctcaggaaagagtatggaacatttcataaattggcccaaaagtgaatgatgtgggtaatacagatattctgctttatttcttcagctggtgggtgcttgcttatgtataaaaatatgggacaagaaactcttatacatgtcttttgttcttcacactgagggagtggagaacttgcacagaaaattgtgatgtttagtttgtctttgacactctcagtcatgtatggagttgagaatagttagtatctatcttagagttaactgagtggctaaagcattccatggaggagcttgaatgctttgccatcagaggtaggggagtggagaggagaagaggtgcttgttgaaaagtgaagttacccgtcctgctggcatttaatgtccagggacttttaaataaagaaacatatgtatgtgaatacttgcctgctaagaagacgtcaggaaaggtctaattgtttttttcctgtacagtttcaggggatcttcttttagaggggctcctattttgataagggcttttcagtcaagtttgcagtgcatttcaggatctgcctactttcatttatgtatcccgactccatcgagttggcctttaccttgagacagaattcttagaatagtgaaactgaggcaggcagattggtgaagaggtttagggattttgttgcccctctactggtacttttattttattaagtttgacctgtttatgggcagaagagatgtatttgtccagactggttccttggaatcccaagggggaatcaatatgagggactaagacaacttaggtatagaatgtgggcatgccagattatggatctgggagtcctctttggccatcttcttggctcatcctggcatatacaaatacatggagattttgtttctttgtttgttacaatgtgtggagggtgcttctggtatttaacgtccagggactttaaaaatattttacagtgtttagggcagtcctgcacaaagacttgtctcatccagcgtgccagcggtttgcattgggaaatgctgatggaagtcaggtgaacttgcatagctgggaacttagaaataaacatttgtggcctttgcacttcaaaaataactgtcacaactcatgcaataaaaaaactcatgtacttggctccataggagagattttgaggccctcacacaaagcctgttgagataacagtgctgtatatctagttttgagaggtcagctctctgggttcctgaccatggcagactaaaaatagcaaactgggggttgaaggtactgtcatggggcatgtaggcagcttcaagaaatgactgctgatcatgaaatgaaatgggagaattatgaaaatcacacccaagaaacataaaaggacagaagtctgagatttctgtttgctctggttaaaaattatccatgtatctcagcagttctttaggatagatgagccccttagcacagggctctgatgcttgtaattatgacctgcgtcaccacaagatatttgtttaatctaatttattttgtttacaaaggtctagaaatgagcatcatatgttttataaatttacatgcacatcagtttcttttcaccatgtatttttctttaaagttctcatctcatatacgaataaatgaatcttctgtcaagtatgaattttgaatgcctgaatatgtgctaatataatagattgctatttgtattataggctgagagcagtttcagtgaagaagaggaagaaaaacttcaagcggcattttctctagagaaacaagatcttcacctagttcttgaaacaatatcatttattttagaacaggtatttttattgcatcaaattttctagccatgatttgtttactacatatttgtattgttatgatatctatgacattctgttttttttaattaaaaagtatgcaagatggaagctgtgaatgtattttagttaagaatttcagtgtaaaaatatttgaatattgtaaagtatttaaatatgaattgagacttcattgatttgagacagttatacaagattttaattcattggtacttggtataatggaaaaatggacatattttacttaagatattaaatgatttgggggatatattgactaggatggtaagtaagacatttagaaaagaagtattgtcatattatgtgccactaagctgccttctgcatccctttttctcatctaaattcacttcctgatttaagctcctattcaaggctcatctcctttacttgagctgtgaccccttatacttcctttatttggatttttaaaaatccttggctcatcacagtagagcacattgttagtctttcagcagttcatatgcgttagttatacctccttcaccagattctaatttgtggggagcaggatcatattttttgtgtatcttatataagcctaccacattggtgtgcttaaaatagatcctcataaattcctgttgattaaaaataatacttgtgaaataaaagtttaaatagttttgtaacttcatgagcattttaatgaacatattaggaggacaagctaccagttatctactacagccttacatacattatagatcacaaagataaatgtggttctaatttttggtgggtgttcagtagaagaaaaggatcattgagtaggacagcatagcatggtgttccagaataatgtaagaaacagaacaggtatcagtgttaaaattttttacaacttttaatcatatattatgtaggaaattggtagataaggtaattttgagaaagtgcttctgggaaaaaatttgttagttgggaaacaaaactattgtatacttatttgaaattattaagtgaaataaatgaaattttaattagggtaccatttacatagccaaagcaaagaagaagttttttggtttttaagtggatttaggattacttaaagcataggtaagagtgagaaaaaaattcatcttgaataatttaggccatttaatcctgaatcttccagcccttggtcgtgtattttattatgtgtaaaataaccaaaaatgttggtaataggactatgaagttttcttttgacttaagtcatttaaaaatagttttgtatttagtatagtttaaagtttcagtatgaagatgagggacatatgtaattttttgtttctttttaataggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaaggtatagaacatactgtcttaaatatgtttttcaataacatatggcataaattattatacctgaagagtttttaaagtgataatattttgttgagaggtagagtcaggcaaaagaaacacagatgctcctcaacttacaatggccttacatcctgatagacctgtcacaaattgaaaatatcgttaagtcaaaaacagagtacactctagagaatcagttgtttacccttgtgatcacatggctgactggaaactatcgctcgctgccattgcccagcatcatgagagaatatcatacatattgctagcccaggaaaatacagaattcaaaatatgaagtatagtttttgctgaatacatattggtttcatgccattataaagtaaaaaaattgtctggtatgggccctgacttaagtttagattttacagtagtgcaaaactatcgcaatttcgatatacttttacttttgatctcttcttcggctagtggtgtggtacataagatattcctgtttttggaggcttttcaagatggctgactagaggcacaggacacttctccacaaagaagaaccaaaatagtgagtaggtaatcacactgtaaataaaacatctaaaagagaatgctagagttcagtagagaagtgaccggaaacacctgaggagagggaggagaggtggacagccttgctgggatcaaccagaagcctggagaggctcctcagtgtggagttggggtaagtgagagatccctagctgtccacattcttgctgcagactcctgtaatcctaactgtgggagagttcttgaaccccatgggccccgagactggcatagggagctccctgaagttcatgcaatggtattgctctagaaagggtgctcttgctgggttccatgctccccctgagtcttaggtagctggagcacggctccattttaagagtctaatccctgttagaaacagaataatcttaaaatttgtatgaaaccaaaagagaacccaaatagccaaagcaatcctaagcaaaaagaacaaagctggaggcatcatattccctgatttcaacttgtattacaaggctatagtaaccaaaacagcatggtgttggtagaaaagcagacatatataccaatggaacagcataaaatacccagaagtaaacccatgtatttatagccaactgatttattacaaagttgccaagagcatacaactggggaaagggcaccctctttaataaatggtgctaggaaaactggataactatgcagaagaatgtaatggcccttctctctcaccatgtaaaaaatcaactcaaaattgattaaagacttaaacataagacccacaactgttaaaatactagaagaaaacaggagaaatactccaggacatttgtctaggcaaaaattttatggctgaccttcctaaaacatggacaaaaaaccccaaaatagacaaatggaactatattaaactaaaaatcttctgtacattagaggaaacaatcaacaaaatgaagacacaacctgacaaatgggataaaatatttacaaactattgacttagcaaatgattaatatccagaatatacaaggaactcaaacatctcaactgcaaagtaactaatcccatttaatgtggacaaaggatctaaacaaatgcttcttgaaagacgatatataaatggctaacaggtatatgaaaaaatgcttaaaatcactaattatcagagaaatgcaagtcaaaaccaaacatgccatatcatcttaccccagttagaatggctattattaaaaagagaaaaaaataatggatgcaggtgaggatgtggagaaaagggaactctcatatgcttttggtggcaatgtatattagtacagccattagggaaaagcagtgtggagatttctcaaaaaactaaaattagaactaccacacagtccagtaattccactacttggtatatattcaaaggaaaggaaatcggtatattaaagaaatatttgtacccctgtgtttgttgcaacactgttcacaatagcaaagataagaaatcaacctaagtgtccattagtggatggatgaataaagggaatttggtataattacacactggaataatattcaaccataaaagagagtgaaatgttgtttgcagcaacatggatagaactagaggtctttatgttacgtgaaataagctagacacagacaaatataacaggcactcactcctatgtgggagctaaacaagttgatgtcatggaggtagagagtagaatggtagtcaccagaggctgagaagaatgcatgggatgtggggtcggagggtggatgagtagaagttggttaatgggtacaaacatataatcagaagtaataagtttaatgtttgatagtttagtatggtgcttatagttgacatcaatatattggtcatttcaaaatagctagaattaaggaagtgaactgttctgaacacacacaaatgataaatgctcagggtggtgaatatcttaaataccctgacatgatcattacacagtctatgcatataagaaaatataacacatatctcataaatatgcaaaaatattatgtattgattaacaaataggctttgtgttagatgattttgctcaaccacaggctaatgtaagtatactgaacatgtctaaggttagctaagctaagctgtgatgtttggtagattaagtgtattaaatacatttgtgaattattgtattttaacttaacgatagattaattgaggcataagcccattgtaagtcaaggagcatctgtatattctctagaagtcctctgtgagatatatgatttgcacgtattttctcctaatctgtagctttccttttcattctcttaacagtatctttcccagaacagaaccattaactttgatgaaatctgttgtattttttttttctcttttcatgaacctacttctggttttctaggaatttgcagcctaatcatgacataaatatttactgttttcttctaaatgttttacatatttatattttatgtttagatctaaaatccatttactgttaattttgtatgatacataaagtgcaggtcaaagttcattttttctatgtatggatgttcatttgctccaatgtgatttgttgttaaaattatcattttgtcattgaattaccatgtgtttgtctaaaatcatttgatatttttgtgagtctttttctggaatctctctttgatttcattgacttatttgtctatgccaatatcacactgccttaattattatagcttaatagtaagtgttaaaatcaggtattgtgaacccactgacttttttcttcttttttataattgttttggcaatcctagtttctttgccttttcatatgtttgaaaatcagcttttgtatttctgtaaaaaatcctgcttggggtattgattggggttgtgtttaatttgtaaataactttattgagaaatgactccttaataagtattgagtatatctatttatttaggtcttctttgatttcttttatcagtgtcttttgttttcagcttatcaatcctgcccttattttgttaggtttgtaccttaagtactttttctttctttttttttttgttgttgaactattggtagtatttttcaaattttgttttccaatggcttattgatagtatatggaaatacagtagacttttctatactgatctctatcctgtaacttggtaaattcactaattagttttagcagctttcttataggttttttgtgatttcctttgaaggcagtcacgttgtctgtgaataaagacagttttatttcttccttttcaatctgtagagcttttatttttcttgctttattttactgacaaggacttccaacgtgatgctgaataggagtggtaagtctgaatatccttgccttgttcccaattttagggtgaaagcattcaggctcttatcattaagtaggatgttagaaaatgcccctttattgttttcacttctctacttccctttttaaaaattctgtattcttactactctcaagtgtcttctatgtcattgcttcattttttatcattttaaagtctactttttcctatatcctctatagattttaagctttccatttgtttccctgcaattctttttttaagccattttcatttttaaaaaaaattcttggctttttaatagtagcctgttttctgtttatatttttcctatattttatacagtccgtttttttccttgcactttagtagtcataacaattaaaaatatttttgttttctgcttctaatagtaaattactttttagtgtcttcatgatgaaagtttgtttttttaaaggtaatatttttcccatagttggattacagaagcttctctttaagaaattaattaatcatttgtcatataaaatatgcaaataaagaagttggaatgatctgattaattgtacattgtcccattgagaatgctggaaattatcttttggtaattctgggtatatcataggattgctaatatactattttaaagtctgaaatgcttaaataatataatgataacaagcatttattgtgcttattgtgggtcagatgttataatgagttctttgtatgttacaaaacccattaatagttctagtttatacatgtacttataaaattgaggcttagagaggtttaaaaagttgcccatgattgtacagctaagtaagtggctgagttgggatttgacaagaatagtcacattcctaagctattatgctatcctaacacatagatgttagctgcggaatttttctgcgtcaggcattatgcagggtgatttatatagttgtttgtatgtacttcatattagtccattctcacattgctataaataacctgaaatagggtaattatataaagaaaagaggtgtaatttgcccacggttctgcaggctgtacgggaagcatgatgtgctggcatctgcttggcttctggggaggcctcaggaaacttacagtcatggtggaaggtgaatggggagcaggtgtctttcatggcaggagcaggaacaagagagagagggaggagggaggggctacatacttttgaacaagcaggtcttgcgagaactcaactatcacaagaatagcactgaagggatggtgctaaagcattcatgagaagcctgcccccatgatccagtcacctcccaccgggcccacctccaacactggagattacaattgcacatgagatttgttgtggtcacagatccaaaccatgtcacataccttttaaaagtgaggaaataaaactttagaaaatattagtcactttatcatattatcccaagtggtccatgatgaaactgaaatgaggattggatctgtctgtctctaagtcttattccttttatatcatgctacctctggcagctgtaatgctatctttctttttcattctgagaactgtttaggatactgtggccaaaatagccagatgtgaaaacagatcatgccatttaaattgtaacaaaaatatattacactgacttatatgatgaaaaaaggtgtacatgcaatgactttaactgttttatggtaacttagggtcctacccacataaactgtggggtgcttgcagcagaacacatgttggtagtacagtcagccctctgtatccctggatttcgtattcatggattaaactcgcagcagatcaagaatatttgggaaacaaaaaattccaaaaagtgaaacttgaatttgccatgtgctgagtactatgttaaatccacagaaatgatgtgttgtcattgtattagttattataaataatctagagatgatttaaagtataaaggaggatatgtgtagattatatttaaatactgtgtcattttatatgagggacttgagtatctgcagttttgggtgtctgtagggggtcctggaaccagccctcgctagatactgaggaaagactgtgattctgaattcaaagagggtaagatcaatgaaataatgttaaaaaatcaaaaggtgtttatttttattccattttaaaaacttcttttttaagctttatcgaggtataattgataaacaaaaattatgcgtattcagggtgtgcaatgtgatgatttgatagctgtatacattgtgtaatgattaccataatcaaattaatcaacatatctgtcaccacacagttaccaccttttatgtgtgggtgagtgtgtgcgtgaggacatttaagatctactgtctttgaaaacttaaagtaaacaacgtggtattattaactatagtcaccatgccatacattagattcccagaacttaatttgttttatagctaaaagttgtaccctctgaccagcatctcctcatttccctcataccccatccccaggcaactaccattctactctctgcttcagtgagttaaacttttagagtatgcgtataaattagctcatacagtgttttgtctttctgtgcctggcttatttcacttagcataacaccctccaggttcatccattttgtcacaaatggcagtgttttctttttaaaggttgaataatattccattcattatctgttcatttgttgacagacacttaggttgtttccttatcttggccattgtgaataatactgcagtgaacatgagggtgcagatatctcttcaactgatttcatttcctttgcgtataaaccaggagtgggattgttggattgtatgatagttttatttttaatgttttaaggaacctccatactgtttttcataaaggctgtaccaatttacattcccaccaacactgtacaatggtttctttttctctgctgtcttcctaacacttgctgtctcttgtctttttgataataggtattttaacgatgtaacgtcatgttgtattatgcttttgatttgcatttctttgatgattaatgatattgaccactcttttatatacctgttgatcatttttatgcctttttttggtggggagaatgtctgttcagttcctttgtccagtttttaaatgggttattagttttcctgctattgagtttgtgagttccttatgtattttgtatgttaacctcttatacatggtttacaaatacaggttgggtatcacgtatctgaaatgcttgggaccagaagtgttttggattttggattttttgaattttggaatatttgcatatacataatgagatgtcttggggatggtaagcaagtctaaacactgaattcatttatgtttcaaatacaccttatatacatagcctgaaggtaatcttacacaatattttaaataattttgtgtatgaaacaaagttttgactgtgacctgtcatatgagatcaggtgggaaattttctgtttatggtatcatgttggagttcaaagagtttcagattttggagtattttagattttggatttttggattagggatgccgaacctctgttttctcacattctataggttgccttttcattttgttaagtttcctttgttgtgtagaagctttttagtttgatataatcacacttgtttgtttttgcttttgttatgtatttcatatccaaaaagtgatacgcttttggtgtcctatccaaaaaatcattgcaaaggccagtgctaaggagctatttttcctgtatttttttctagaaattttatagtctcagatctttcatttaagtctttaattcatttttagttaatttttgtgcatggtataagataaaggtccagttccttttttttttttttgcatgtagattttcagttttctcagtaccattagttgaaaaggctttttcccatggtgtatccttggtgcccttgtcaaagactggttgaaagacacttctttttatctcttattgtttagatttaataaatgagagggccaattgaaaaaaaaacttgacattaatagctttttgcagaatatgattgaagggattttaaaatttcatctcatctcactttaatacgtctgttttttgccatttatttatttttctttgtataaattcatggtgtacaactgaaattttgttacatgcatagatttcataatggtgaattcaggacttttaggtaatttctcattatccaccctcgcagcacctcctctcccttctgagtctccattgtctgtcattccactttttacatccatgtgtacacattatttagctcccacttatgagtaagaatatgcagtatttgtctttctgtgtctgacttgtttcacttaagataatggcctccagtttcatccaagttgctgcaaaagatatgattctgttcttttttatggctcaatagtgttccattgtctatatatacacaccatattttctttatccagtcatccaatgatggacacttaggttgatcccatattgttgttattatgaatactgtgataaacaggagtgcaagtacctttttagtacactgatttcttttcctctgggtagatgccccattgagggattgctagattgaatgttagttctagttttagttatttgagcaatctctatactgttttccatagagttcccttttctatactattttccataagagttctcttttctccacatccttgttaacatctattattttttaacttttttattttttatttatttatttatttattattttgagacggagtcttgctctgtcacccaggctggattgcaatggtgtgacctcggctcactgcaacctccgcctcccaggttcaagagtttctcccacctcagcctcctgagtagctgggattacaggcgcacaccaccacgcccggctaatttttgtatttttagtagagatggggtttcaccatgttggtcaggctggtctcgaactcctgaccttgtgatccgcttgcctcagcctcccaaagtgtgggcttacaggcgtgagccactgcgcccggactttcttcactttttaatagccattctgactagggtaagatgatagctcattgtggctttgatttgcatttctctgatcagtgatgttgagcatttttaaatgtatctgttggccatttttatgtcttcttttgaaaaatgtctattcatgtcctttgccctgtgcccactttttaatgggattatttttgttgttgttgttcagttgtttgggttttttgtacattctggatattggtcctctgtcaggtgcatagtttgcaaatattttctcccattttgcaggttttctatgtactatgttgattatttcttttcctgggcaaatcttcttagtttaactaagttccatttgtctatttttatttttgttttctgtccttttaagatcttagtcatgaattctttgcttagaacaaggtccaaaagagttttcgctaggtttcttctagtattttaaatttcaagtattccattgaagtctcttaattcatcttgagattttttttatatgatcagagacaggggtctagtctcattcttctgcttttggcaatgcagttttctcagcaccatttattgaaaacgttgtcttttcctcaatttatgttcttgttgactttgtcaaagaacacttaaatgtaaatatgtagctttatttctgggttttctagtctgttctcttgatctatgtgtctatctttatactagtaccatgctgttttggttattatagccttgcagtttaatttgaagtcagagagtgtaaggcctccaggtttgttctttttgcttaggactgctttggccattcaggttcttcattgcttccatatgaattttaggattgtttttcctaatttagtgaaaaatgacaatggtattttgataaggattgcattgaatctgtagattgctttgggcagtatagtcattttaataataattctttttattattatgttttaagttctggggtacatgtgcagaatgtgcaggtttgttacataggtatacacgtgccatagtggtttgctgcacccatcaacccgtcatctacattaggtatttctcctaatgctatccctccaccagccccccacaccctgacaggccccagtgtgtgattcccccaccccttatgtccatgtgttctcattgttcagcacccccttatgagtgagaacatgcggtgtttggttttctgttcttgtgttagtttgctgagaatgatggtttccggcttcatccatgtccctgcaaaggacatgaactcatccttttttatgcctgcatagtattccatggtgtatatgtgccacatttttttttaatccagtctttcattgatgggcatttgggttggttccaagtctttgctgttgtgaacagtgctgcaataaacatacatgtgcatgtgtctttatagtagaatgatttataatcctttgggtatatacccagtaatgggatggctgggtcaaatggtatttatagttctagatccttgaggaattgccacactgtcttccacaatggttgaactaatttacactcccaccaacagtataaaagcattcctatttctccacatcctcttcagcatctgttgtttcctgactttttaatgatcacattctaactggcatgagatggtatctcattgtggttttgatttgcatttctctaatgaccagtggtgatgagctttttttcatgtgtttttggctgcataaatgtcttcttttgagaagtgtctgttcatatcctttgcccactttttgatgggtttttttcttgtaaatttgtttaagttccttgtagattctggatattagccctttgtcagatggatagattgcaaaaattttctcccattctgtaggttgcctattcactctgatggtagtttcttttgctgggcagaagcccttcagtttaattagatcccatttgtccattttggcttttgttaccattgcttttggtgttttagtcatgaagtctttgcccatgcctatgacctgaatggtattgcataggttttcttttagggtttttatgatttttaagtctttaatctatcttgacttaatttttgtataaggtgtaaggaaggggtccattttcacttttccacacagggctagctagttttcccagcaccatttattacatagggaatcccttccccatttcttgtttttgtcaggtttgtcaaaggtcagatggttgtagatgtgtggtgttatttctgaggcctctgttatgttccattggtctatatgtctgtatggtaccagtactacactgttttggttactgtagcctcgtagtgtagtttgaagtcaggtagcatgatgcctccagctttgttcttttgcttaggattgtcttggctatgtgggctccttttggttccatgtgaaatttaaagtagtttttttccaatgctgtgaggaaagtcaatggtagcttgatggggatagcattgaatctataaattactttggacagtatagccattttcacgatattgattcttcctatccatgagcatggaatgttttttcatttgtttgtgtcctctcttattttcttgagcagtgatttgtagttctccttgaagaggaccttcaaatcccttgtaagttggattcctaggtattgtatcctttttgtagcaattgtgaatgggagttcactcatgatttgtctttctgtgtctgttattggtgtatagggatgcttgtgatttttgcacattgattttgtatcctgagactttgctgaagttgctcatcatcttaaggagatttttggttgagatgatggggttttctaaatatacaatcatgtcatctgtaaacacagacaatttgacttcctcttttcttttttttctttttttttttgagacggagtctcactctgtcacccaggctggagtgcagtggcacgatgtcggctcactgtaagctcctcctcccgagttcatgccattctcctgcctcagcctccctagtagctgggactacaggtgcttgccaccaagcccagctaattttttgtatttttagtagagacggggtttcactgtcttagccaggatggtctagatcccctgacctcgtgatccgtccgccttggcctcccaaagtgctgggattacaggcgtgagccaccgcacccagcctcctcttttcctaattgaatatcctttctttctttctcttgcctgattgccgtggctagaacttccaatactgtgttgaataggagtggtgagagagggcatccttgtcttgtgctggttttcaaagggaattcttccagtttttgcccatacagtatgatattggttgtgggttgtcatgaatagctcttattattttgagatatgttccatcaatgcctagtttattgagagttttttttagcacaaagggctgttgaattttatcaaaggtcttttctgcatctgttgagataatcttgttgttttttcattggttctgtttatgtgatggattacttttattgacttgcatatcttgaaccagccttgcatcccagggatgaagccgacttgatcatggtggataagctatttgatgtgctgctggatttggtttgctggtattttattgaggatttttgcattgatgttcatcagggatactggcttgaaattttctttttttgttgtgtctctgccaggttttggtattaggatgatgttggcctcgtaaaatgaattaggaaggattccctctttttctgttgtttggaatagttttagaaggaatggtaccagcttctctttgtacctctggtagaatttggctgtcattctgtctagtctgggactttttttggttggtaggctattaactactgcctcagtttcagaacttcttattgctgtattcagggattcaaattcttcctggtttagtgttgggcaggtgtatgtgtccaggagtttatccatttcttctagattttctagtttatttgcgtagatgtgtttctagtattctctgatggtagtttgtatttctgtgggatcagtggtgaagtcccctttatcattttctattgtgtgtatttgattcttctctcttttcttctttattagtctggctaagggtctgtgtattttgttgagcttttcaaaaaaccagctcctggattcattgatttttttgaaggacttttcatgtctctatctccttcagttctgctctgatcttagttatttcttgtcttctggtagcttttgaatttgtttgctcttgcttctctagttcttttaattgtgatgttagggtgtcgattttagatctttcctgtttttgttgagttttgttttatttttttttttgtgtgggcatttagtgctataaatttccctctgcacactgctttaaatgtgtcccacagattctggtaccttgtgtctttgttctcattggtttctaagaacaactttatttttgcttttatttcgttttctacccagtagtcattcagcggcaggttgttcagtttccatgtgttgtgaggttttgagtgagtttcttaatcttgagtctaatttgattgcagtgtggtccgacagagtgtttattaatgatttctgttcttttgcatttgctgaggagtgttttacttccaattatgtggtcaattttagaataagtgcgttatggtgctgagaataatgtatattctgttgatttggtgtggagagttctgtagatgtctattaagtccacttggtccagagctgagttcaagtcctggatatccttgttgattttctgtctttttgatctgtctaatattgatagtggggtgttaaagtctctcactattattgtgtggtagtctaagtctctttgtaggtctctaagaacttgctttatgaattggggtgctcctgtattgggtgcatatatacttagaatagatagctcttgttgcattgatccccttgccattatgtaatgcccttgtctcttttgatctttgttggtttaaagtctgttttatcagagactaggattgcaacccctccttttttttgctttccatttgctttgtagatcttcctccatccctttattttgagcctatgtgtgtctttgcatgtgagatgggtctcctgaatacagcacaccaatgagtcttgactctttatccaatttgccagtctgtgtcttttaattggggcatttagctcagtcacattaaagattaatattgtcatgtgtgagtttgatcctgtcattatgatggtagctggttattttgcccattagggtttctgctgagagatctgctgtgggtaacctgacctttccctctggctgcccttaacattttttcctttatttccaccttggtgaatctgacgattatgtgtctcggggttgctcttctcgaggagtatctttgcggtgttccctctatttcctgaatttgaatgttggcctgccttgctaggttggggaagttctcctggataataccctgaagagtgttttccaacttggttccattctccccatcactttgaggtacaccaatcaaacatagatttggtcttttcacatagtcccatatttcttggaggctttgttcatttcttttcactgtttcttctctgatcttgtcttctcactttatttcattgagttgatcttcaatatctgatatcctttcttttgctttatcgattcggctattgatacttgtgtatgcttcatgaagttctcgtgctgtgtttttcagctccaagaggtcatttatgttcttctctaatctggttattctagttagcagtttgttttacctttttttcaaggttcttagctttcttgcattgggttagaacatgcgcctttagcttggaggagtttgttattacccagcttctgaagcctacttctgtcagttcgtcaaactcgttctccgtccagttttgttcccttgctggcgaggagttgtgatcctttggaggagaagagctgttctggtttttggaattttcagcctttttgtgctggtttctccctatctttgtggatttatctacctttgttctttgatgttggtgacctttggaagaggtctctgagtggccgtactttttgttgatgttgatactattcctttctgtttattagttttccttctaactgtcaggcccttctgctggagtttgctggatgtccactccagaccctgtttgcctgggtatcaccagtgcaggctgcagaacagcaaagattgctgcctcttgcttcttcctgaagcttctttccagaggggcacccacaagatgccagccccagctctcctgtatgaggtgtctttcggctcccactgtggggtttctcccagtcaggatacacaggggtcagggacccacttgaggaggcagtctgtcactggatcagagcttgaatgctatgctgggagatccactgctctctccagagctgccaggcaggggcgtttaagtctgctgaagctgcacccacagccacccctttccccaggtgctctgtcccagggagatgggggttttatctataagtccctgactgaggctactgcctttttttcagagatgccctgcccagagaggaggaatctagactggcagtctggctgcagtggctttttgagctgcagtggctttttgagctgcagtgggctctgcccagttcgaactctctggtggctttgttacactgtgagggtaaaaccgcctactcaagcctcagcaatggcggacgcctgtccctccaccaagctcgagcttctaggtcaactcagactgctgtgctagcagcgagaatttcacgtcggtggatcttagcttgctgtactctggggttgggacctgctgagccagaccactttgctccctggcttcagccccctttccaggagagtgaacggtgattcactggcattccaggtgccattggggtatgaaaaaaacaaacaaacaaactcctgcagctagcctggtgtctgcccaaacggccacccagttttatgcttgaaacccagggcctaggtggcataggcacccgagggaatctcctggtctgcaggttgtgaagaccgtgggaaaagcacagtttctgggccggagtgcaccgttcctctcggtacagtctcttacggcttcccttggctggggaagggggatctcctgacccgttgtgcttcccgggtgaggcaatgccccaccctgcttctgctcaccatccgtgggctgcatccactgtcctatcagtcccagtgagatgaactgggtacctcagttggaagtgcagaaatcacctgccttctgcatcgattttgctgggagctacagaccggagctgtttctttttggccgtcttgccagcatatcatcataatagttcttttgacccatgagcatgggatgtttttccatttgtttgtgtcgtgttcagttttctttcgtcagtattttgtagttctccttgtgaagattgtgcatcttggttaaaaaaatattcctatgtatttggctgagcactatgggctcatgcctgtcatttcagcactttgagaggctgaggtgggtggatcaccactcctgggtgatccccaagagtttgagaccagcctggccaatatggtgaaacaccatctctactaaaaatacaaaaattagccaggcgtgctggtgcgtgcctgtaatcccagctacttgggaggctgaggcctgagaattgcttgaacctgggagggacaggttgcagtgagccgagatagtgccactgcactccagcctgggcgacagagtgagactctgtctcaaaaacaaacaaacaaaaaattcctatgtattgtatttttcttgtagccattgtaaatgggattgttttcttgattttgttctcaactagattgttactggtgtaagaaatgctactgatttttcatgttgattttgtgttgtgcagctttactacattcatttattaaatctaagaatttttcatgaatctttaggttttcctagatataagttatatcttcagcaaacagtaataattttactttctcttttcccatttagaagccttttatctcttgcctgatggctgtggctaggacttccagtactatgttaaataggagtagtgaaaatgggcatccttgtcttgtccaacgtttttgaggaaatgtttttaacttttccctgttcagtgtgatgttgtctgtgggcttgtcatatatggcatttaatattatgatgcatatttcttctatgcccagtttgttgagagtttgtatcatgaaggggtactgcattttatcaaatgctatttctcagtctattggtttgatcataaagtttttctccttcattctttttatgtgatgaatcacatttattgacttgtgtattttgaaccactcttagatcccttgactaaaacccacttgattgtggtgtattatctttttaatatgctgttggattctgtttcctagtattttgtttaggactgttgtgtctatgttcatcagggtattggtctttagttttctttattcgttgtgtccttgtctggttttggtattgggatgatactggagaatgagttagggagaattcctttcccctgttccaactttttggaacagttttacaagaattggtattagttctttgtatgtttggcagaattcagctgtgaatccgtctggtcctgcgtttttggggggaagattttattactgatttaatctcactacccattattggtctattcaggctttctgtttcttctttgttcaatcttgggaggttgtgtattagtctgttcttacattgctacacagaaatacctgtgactgggtaacttataaagaaaagaggtttaattggcttatggttctgcaggctgtactggaagcatgatgctagcacctggggaggccttgagaaacaaaacaatcatagcaaaaggtgaagggggagcaaacccatcacatggtcagagcaggaacaagagaggaaggggggaggtgctacacacttttaaaccaccagatctcaagagaattcactattgtgaggacaataccaagaggggtggtgctaaatcattcctgagaaacctgcctccatcatccaatcacctcccatcaggccccacctccaacattgggtattacatttcaatatgagatttggatgggaacatacatccaaactatatcaggttatatgtttccagaaatttacctattttctgcaagttttctagtttatgaacatgtagttgttcataatagtctctgatgatcttttgaatttttctcatatcatttgtaacgtctccattttgatttcttattatatttggatcttctttcctctggttagtcttgctagcacttgatcaattttgcttatctttttaaagaacgagctttttgtttcattaattttttaatttttttttggtctctgttttatttagttttgctctgatccatgttacttctttacttctgctaattttgtgtttggttcgttcttgcttttctagttcctttagatgtattgttaggttgttaatttgcaatctttctacttttttgatgcaggtatttattgctgcaaaattccttcttagcactggttttgctgtgtcctacaggtttttgtatgttgtatttccagtttcatttgtttcataaaattttttaattctccttaattttttcattgatccaaaggtcattcaggggcatattgtttaatttttctgtatttgtatagtttccagagtttttcttgatattgatttcttggtattggttttattctactgtggtctgagaagttacttggtatgatttgatttttaaaaatttgttgaggcttgttttgtggcataacatatggtctatattggagaatatcccatgtgttgatgagaagagtatttattctgcagttgttggatagaatgttctataaatgtgtgttaggtacattttgtctgaagtccaatttaagtctgatgtttgttgattttatgtctcagtgagctgtctaatgctgtgagtgagatggtgacgtcccctattattgtttttctgtctaactctctttaggtctagtaatatttgttttatgaatttgggtgctcaaatgttgggtgcatgtatgtttagaattgttatgtcctcttgtagaactgacacctttaatatcaggttttatacttttgtgttttcttgatggggttgccctgtctctttcaagtttaggactcctttgaacatttcttgtagagctggtctacttttgacaaattctcttagtattctgttaataatctgtctgggaaagaagattatttctacttcatttatggagcttgatatttctcgatgtagaactcttgactgataatgacttcattattttttactatttttattttaaagtatgctttatctgataaaaatatagctacctctgcttgctttagattttcgttggcccataatatcaatcaatatctttttccacccctttacttttagtctatgtgtcttcacagataaggtgggtttcttgtaaatagcatatagttgattttttttctttttttttgagatggagtcgcgtgctgtcgccaagctggagtgcagtggcgggatctcagctcactgcaacctccgtctcccaggttcaagcaattctcctgcctcagcctcctgagtagctgtgactgtatataggtgcgcgccaccatgcacagctaatttttgtactttaagtagagactgtcaccatgttgacagaatgttctctatctcttcacctcattatccgcctgtgttggcctcccaaagtgctgggattacaggcatgagccaccgctatatggcctatagttgattttttttattcatttagccaacgtgtattttttagtaggacatttaatccatttatgtttgaggtggtatatgagattttgttcctgtcatattgtttttttcatcattttgtaaacttttgggttttttgtctgtctaaatttatggtttgttggaattctgtaatggtttcatttgattcttcttctttgtatgatatctttactagtgtattttatatttttgtgtgttttcacaatgataaatattgtcctgtctcttccaagtttaggacttctttgagcatttcctgtaggactggtctagttttcatgaattccctcagtatttgattgtctgggaaagactatttctcctttatttatgaagcttaatactacctggatatacaattcttggctgacagttgttttctttcacactttgattatgtcgtcacattttttcctgccttgtaaggtttctgctgggtagtctgctgttagtttgatggactttcctttatagatgacacttttctcttgattgtagaatttgttctttcactttgacattagacactcattataatatgttgtattgaagtcccttttatgttgtatttgcctgcagatcatggagcctcctgtatctattatgtctgtatctcttgctagccttgggagtttttcaatctattattttgttaaagatttttgatgtttctgtccctttgggaataccagtaattcataagttcaatgctgtatgcagtcctaaacacttggaaagctttgttcatttttttcttatttttaaaatttttatcagactgcactgtttgaaaagacctgtcttcatgttctgaaatcttttcttctgcttggcctagtctattattggagtttccatgtattttatatctccttcagtgaattttttagttccaggatttttttaaagacgtctatctccttggtaaatttctcattcatatcctgaattgattttctgattactttgtattagttttcagatttctcttgtatctcattgaacttaattgaaatcaaaatattgaattctttggggttgtaaggttttctttttggttctgctctattgttggagaattattgtgttcctttgatggtgtcatattgccatgcgttttcatgtttcttgtgtttttatgttcattctagcacatctggaacaattgctttttttttcaatttaacttttgtttggagtagactttgctcctttatatgtgacttcgatgttggttgagtagggccacttgtttttatttctgggtgtgcgcattggtgaatactttatgatattcttggctataaatattgttattggtatctgtggattcctttgtgtgttagggtgtgggttttgatggaggatgtggtgaaattatgctagggactggaatgcttgataggtccttcttcaggtttcagtggtagcagtggttgtctaagcaggtctatatctagggcagtgtgtgctggcacatgagttggcagttccatgcaggctgattattgggggctctgggtggctcttttggataccagttgtggtagcagtgtactgggcaagtgagtgggctcatgagctcttgggtagctgggtggcctcagtaatggtggcagcagtagtggtaagatgctctccccagtgcccttgtgttgggagtgattgcaattggctgtgtgggctgacctccaggctgggtggcacttgcagatagaaaccaaccgagagagtaatggcagggtttttatgcccaaactctgtcccctgggagaagtgcttgggtgtctcaggcagtgggctggactgtgggacctccagaagtccagatcctgcattgtgtctcagagagtagggcaaagctgggtaaatctggattgggaaagcctgggcttgtcctatgaaatgcttgcatgaggggtgacaacacctttgctgaagtactgccatgatgggagagtggggctactggtcccagtggtttcagcattggctggcaagtggggaatctgtgtccctctcatgtctcagtcctggtggggcttcctcccttatcccgactcttgcagctgatcctgtagtttagtcggactgggtagttgtcacctatctcataactcagccctgcccaggtcaggaccagactgctttggcggctcttattctgctcacatcttgggggttgcctagctcccaagctgggggctggagtttatgtcacgcttgcttttcagtcctggttgcagaatcccatttcctacacaggccccagttcagcaaaccacagattgagttactctgatacttaggactggtgctataggttcccaggtcacacaatttgttaaaccctaggattgagaatggcatcttactgtagctgcttaggtctcagggaaggtgtggaacccagggtgtgttatttccctatagcagttcctttatacagtctcctggttgcttcccaagtcaaattcaaggtttgggagggtcaagatacactcccatggcctggattatacaattgattctccagtaggaaagtgaaccacagaaagacactcagttaccttctcccacgttgcagactcccttttggttgccagcctgccctgtccacattagctgtttgttgtcctctctttttggagtttctgtttgcttttctgttaaatgcctgtgttctgtcttggaacacttacattataagtgtgactttaacactttatcttaacctctttggagacttgagactgaaatgtcactaccacttattagaatttgtattcttccctcttgaatctgtgttgactgttagcagtgttcttctaacagggttttctgtttgattttgttgttgtaatacctatgtgttcataacatttattaaatcatgaattcttttcagacagaaattgaatgctatgtttaattttattcctgaaattctatttggagctcttttacgtgtattcctgccatactaaatgtaaaaactgacatgtcaaatgtttttgacatcaatgtatcttttctgggagatacctaaaggaaacgacttgagttcttttatatatattttctaaaatatttttacaaataagattatgagacttgtaaataatattttaagcacttctgagtatcttgctctttaaagcatgcatttattgactccttaaaatgcacttatggttttgtcagggagttttaaaatataaattcaacagttctgtctagtttgaatgtttagaatgtgtttaatgtgattttctcctgctaagaatgttctttatttcgccaagtacatggcagattttccataatataaactattatatagtgaaactttgtattttcttacaggttcttgagaaatctacatgaaaaaatggatagacaatagtcctaagataataatgttcctataacattaaaaaaatcccctttaagccattgtaagatttactttattgttaacaactagttgtttcattaattattgaatacctatcttttatatggagtataagaaattataaattgttactttaaaaacttatgttctcttgttttattattttctttaatttgatttcatttcttttggcattctatggatggtcgaatggctttgtcctaaagaggacagaaaaagcatactttatgcagctaaagcttgaaacacaatatgtaactgtgaatacatatctgagagcttcttcaagatttaaatgcttctgaacattattgtctttgtttatagcaagggtattttgttgtaattatattcacatgcaattcaaatttctgccttttttgttactttagtttcggtatgttatgtaaaaggcataggttttctgtatgcttaaattcactgactatacgtggttgtgagctttaaatgctgctatgtattctctacctttactgaaatgtttatctgcagtaaaatgcagagattttttttttttttttttttttttttgagacggagtctcgctctgtcgcccaggccggactgtggactgcagtggcgcaatctcggctcactgcaagctccgcttcccgggttcacgccattctcctgcctcagcctcccaaaatgcagagattttaatttaattgttcagtctgatgggttttagaagttatatacacacatttaattatgatacctaacaaagtatagaaaattttcatcagcaggaaattactttcaacctcatcctcacttttttatttctgtcaccacagattagttttgtctgctcttggatttaacgtaatggactcatataatatgtatttgactgtcactcaaaataatttttttgattcattcatattattacatttattagtaattcttttattgctaagtgtcattccattatatgaaaatatcacaatttgtttatctgtatttctgttcatgtatgtttgggttttttacagtttctggctaatatgagtaagattgctatgaacatttgtgttcaagtcattttatggatattatatttttttcccttgcgtaaatatctagtaatggggattgctgatcccccaagccaaaaagtctgagacttcctatttaagttttagtctctccatgctacatggattgggaaaagtcatatatgtgtgaatctcaccttgagtggtttcctttaagagtcaaatttcctttaacttttgcctgattttagtcattcttttttgtttgtttgtttttgaggtagggtctcgctctgtggcccaggctggagtgtgcagtggcacgatatcggctcactgcaacctctgcctcctgggttcaagagattcttgtgtctcagcctcccgagtagttgggattacaggcacgcaccaccactcctggctaatttttttgtatttttagtagaggtggggtttcaccatgttggccaggctggtcttgaacccctgaacttaagtgatctgcccgccttggcctcccaaaatactaggattacaggtgtgagccaccacacctggcctgattttagtcattcttaatgcattcaaattgttgttttaaaaaaacgttttgtatagagattatatatttttatattcaaggaggttggtgtgatataggctatttcccaaccattactagactaagaactccaaaagtgattttttaaaaatgtgtcttattttatccaccccactccatttccattttagggtttccatgttactcattgtagaagttggagttcttacaattgtctttaaggaactacatgccctgttgtctcctcagcccacaacctacattgttgaccatctccttttaacatcctctatctggcttattgaatacctctaatctctttacttcaaaagttctgctggatgttcatagggctggcttggttcctttttccagctgattgtttaaatgtcacatttgtcagtgaatctttccctgatagtgccacctcctctgtggcattttattatcttatttttctccataatatttattttttttgtggcccactatatattttacttatttacttttttgtctgtctctaccaccagaatataagctcctcaatggcaataatttttgtctgtttgtttactgctgttattttcactacttttggtctttgggagatagtagagtgtcagtaaatatttgttgaatgaatgcatgtgcaatattccatccttacaaactgtgctatttttaagttcactttattcggtttccttatgaagagggatattttttttattgacagagaaaggacaataaaaggaggaggctatgaactgcattttgtatttcctaatattcttttgtgttttcatttttggttgtacttcaagcctttttgtggttcatttattttatggctcttgaattttgctagagtactagattctagtcatttaaaaaattttctctttaaaagtgaaaatatagaaagaattgctttaggttgaaacagatggaaattctccaggaaaaaaaaaaagtgatggacttagctgttgatgcagaaatcaatttaaaaatctttagatctaagagacccttaatcagtcttatttgaaacagaatgtatttctccactgcataagtaattggctgaaaccagaaccattaacaaattgaatgaagatttcgttaatgccagggaactgtgctgttagcaaaatcactcttattatgtcacagtattcaaagatgtgcatttgttaaatagagttgatgtactttttcagagtgttgccaattgtgagaacatttgttgaatgacatttcagtgtcctcaaacttgtgctattatcttcatatattcttggtatgcagaggtgacaaacaatttgaaaaaaaaatacattgatgatttccctcacttccctccaacttgaatatgaaggccagtcttatgatttggtactttggtcaagtctgtgggtcaagggatataattaagttccttgtcaccctaacagtgagactaggccgacttttgtggtgtctaaacttgagggtattggttagggaatatccctgaattgtgtttgtaataaggcatttgcacttcttattgtgatttgatgtagcagccaaattaaaagtacagagtgccaaaatgaatgtgttggcttagtcacttttggagttttgcagagggcaacagactcctgaggtcttctggaggctgcctaatgggtaaccctgttggagatttgtgcagtatgtcttatgaaagtaggcagtcacttggatatggtaatatattcacttctgtgttttataggttatatattgtataccagtcatctctgataccctggccctggcatcttattattttttttccagagacagggttttgctcagtcactcaggctgaagtgtgcagtggcttgtggtgtgatcatagctcactgcagccttaaactcctaggctcaagggatcctcctgcctcagcttcccaagtaactaggactacaggtgtatgctgtcatgcctagatactttttaaagaacattttcatagagacagtgtcttgccattttgcccaggctggtcttgaactcttggcctcaagcaattggtccccctgcctcagcctcccaaagtgctaggattacgggtgtgagtcactgtgcctgccttgtatctttaaaaaataatgttttataattataatttgtatagtatatactgtattcttttgaattgtatggttccatgaattttgatagctgtatttccatgagatcaccatggtaatcaagatacagagcattatgtttatagcggcacaatttgcaattgcaacaatatggaaccaacctaagtgcccatcaaccaacaaatgaataaagaaaatatggtatatatacactatggagtactactcagccataaaaaggaatgaagtagcgttttttgcagcaacttgggtgacactggaggccagttttctaaatgaagtaattcaggaatggaaaaccaaatatcttacgttctcccttattgggagctaagctatgaggttgtggtggcatgagaatgatataatggactttggggatttgtggggcaaggttgggaggaagatgagggataaaagactacacattgggtacagtgtacactgcttcggtgacggttgcactaaaatctcagaaatcactgctacagaacttacccatgtaagcaaataccacctgtaccccaaaaactattgaaataaaattaaaaaaaattttttttaaagatagagtattttcattaccctcaaaagtttcattttcctttgcagtcccttactgccctaacctagccccaagcaacccctgctctacattctgtcactatagatggcattctctagtattttatataaatggacttacagatatactttttgtatgtgtctggcttcatacactgattataatgattttgagactgatcattttgttacttgtattagtactttttttttttttattacagagtagtattctaccatttggatatacctcagtttgcttatctgttcacctgtttgtggatatctgggctatttctaggttttggctattatgaataaacctaattaatgtttatctgtgattaacatttatgtatatgttttgtatgtttttgtatatgtttatgtatatgttttgtatgtgtatatgtatatgtttttgtataggcctatattttcttttttttaattatactttaagttctaggatacatatgcacaacgtgcaggtttgttacatagatatacatgtgccatgttgttatgccgcacccattaactcatcatttacattagatatttctcctaatgctctccttccccctgccccccaccacatgacaggccccgtgtgtgatgttccccttcctctgtccaagtgttctcattgttcagttcccacctatgagtgagaacatgcggtgtttggttttctgtccttgtgatagtttgctgagaatgatggtttctggcttcattcatgttcctgcaaaggacatgaactaatccttttttatggctgcatagtattccgtggtgtatatgtgccacattttcaaaatccagtctatcattgctggacattcgggttggttccaagtatttgcttttgagaatagtgccgcagtaaacatacatgtgcatgtgtctttatagtagcatgatttataatcctttgggtatatacccagtaatgggatggctgggtcacatggtatttctagttctagatccttgaggaatcgccacactgtcttccacgatggttgaactagtttacactcccaccaacagtgtaaaagcattcctatttctccacatcctcttcagcatctgttgtttcctgactttttaatgatcgccattctaactggcatgagatggtatctcattgtggttttgatttgcattctctgatggccagtgatgatgagcattttttcatgtgtctgttggctgtgtagatgtcttcttttgagaagtgtctgttcatatcctttgcccactttttgaatggggttatttgtttttttcttgtaaatttgttggagttctttgtagattctggatgctagcccgttttcagatgggtagattgcacaaattttctcccattctgtaggttgcctgttcactctgatggtagtttcttttgtcatgcagaagctctttagtttaattagattccatttgactattttggcttttgttgccattgcttttggtgttttagacatgaagtccttgcccatgcctatgtcctgaatggtattgcctaggttttcttctagggtttttatgttttaggtctaacatgtaagtctgtaagccatcttgaattaatttttgtataaggtgtaaggaagggatccagttttagttttctacatatggctagcctgttttcccagcaccatttattaaatagggaatcctttccccatttcttgtttttgtcaggtttgtcaaagatcagatggttgtagatgtgtggtgttatttctgaggcctctgttctgttccattggtctgtatctctgttttggtaccagtaccatgctgttttggttactgtagccttgtagtatagtttgaagtccggtaacgtgatgcctccagctttgttctttttgctcaggattgacttggcaatgagggctcttttttggttccatatgaactttaaagtagtttttccaattctgtgaagaaagtcattggtagtttgatggggatggcattgaatctataaattaccttgggcagtatggccattttcatgatattgatttttcctatccatgagcatggaatgctcttccatttgtttgtgtcctcttttatttcattgagcagtggtttgtagttctccttgaagaggtccttcacatcccttgtaagctggattcctaggtattttattctctttgaagcaattgtgaatgggagttcactcatgatttggctctctgtctgttattggcatatagaaatgcttgtggtttttgcatattgattttgtatcctgagactttgctgaaattgcttatcagcttaaggagattttgggctgagacgatggggttttctaaatatacagtcatgtcatctgcaaacggggacagtttgacttcctcttttcctaactgaataccctttatttctttctcttgcctgcttgccctggccagaacttccaacactatgttgaataggagtggtgagaaagggcatccctgtcttgtgctagttttcaaagggaatgcttctagtttttgcccatttgatatgatattggctgtgggtttgtcataaatagctcttattattttgagataatcaatacttagtttattggaataccatcaatacctagtttattccaacaaaagccaatggaaactaatacaaatggaatctaatacctctaataccatcgatacctaatttattgagtgattttagcatgaagggctgttgaattttgtcgaaggcctttcctgcatctactgagataatcatgtggtttttgttgttgtttctatttatgtgatggattacgtttattgattggcgtatgttgaaccagccttgtatcccagggatgaagccgacttgattgtggtggataaactttttgacgtgctgctggattcggtttgccagtattttattgaggatttttgcatcaatgttcatcagggatattggtctaaagttctctttttttgtcgtgtctctgtcaggctttggtatcaagatgatgctggcctcataaaatgagttagggaggattccctctttttctgttgtttggaatagtttcagaaggaatggtaccagctcctccttgtacctctggtagatttcagctatgaatctgtctggtccttggctttttttggttggcaggctattaattatttccttaatttcagagcctgttattggtctattcagagattcaacttctttctggtgtagtcttgggagggtgtatgtgtccaggaatttatccatttcttctagattttctagtttatttgcatagaggtgtttatagtattctctgatggtagtttgcatttctgtgggattggtggtgatatcccctttatcatttttttttatctatttgattcttctcgcttttcttctttattaatcttgccagcagtctatcaattttgttgatcttttcaaaaaactggtttctggattcattgatgttttgaagggtttttttctgtctctgtctccttcagttttgctctgatcttagttatttcttgccttctgctagcttttgaatttgtttgcttttgcttctctagttcctttaaatgtgatgttagggtgtcagttttagatctgtccatctttctcttgtgggcatttagtgctataaatttccttctacatactgctataattgtgtcccagagattctggtacattgtgtctttgttcttattggattcaaagaacatctttatttctgccttcatttcgttacttacccagtagtcattcaggagcagattgttcagtttccatgtacttatgcagttttaagtgagtttcttaatcctgagttctagtttgattgcactgtggtctgagagacagtttgttgtgatttctgttcttttacattggctgaggagtgctttacttccaactatgtggtcaattctggaataattgcgatgcggtgctgagaagaatgtatattctgttgatttggggtggagagttctgtagatgtctattaggtctgcttgatgcagagctgagttgaagtcctggatatgcttgttaaccttctgtctcattgatctgtctaattttaacagtggggtgttaaagtctcccattgttattgtatgggagtctaagtctctttgtaggtctataaggacttgctttatgaatctgggtgctcctgtattgggtacatatatatttaggatagttagctcttcttgttgaattgatccctttaccattatgcaatggccttctttgtctcttttgatctttgtttaaagtctgttttatcagagactaggattgcaacccctcctttatttttgctttccatttgcttggtagatcttcctctatccctttattttgaacctatgtgtgtctctgcacgtgaagtggttctcctgaatacagcacactgttgagtgtcttgtgtcagtctgtgtctcttaattggaacatttagcccatttacatttaacgttaatattgttatgtgtgaatttgatcctgtcgttatgatgttacctggttattttcctcgttagttgatgcagtttcttcctagcattgatggtctttacaatctggcatgtttttgcagtggctggtaccagttgttcctttccatgtttagtgcttccttcaggagctcttgtaaggcaggcctggtagtgacaaagtctgtcagcatttgtctgtaaatgattttatttctccttcacatatgaagtttattttggctggatatgaaattctgggttgaaaattcttttctttaagaatgttgaacattggcccccactctcttctggcttgtagagtttctactgagagatgcgctgttagtctggtgggtttccctttgtgggtaacccgacctttgtctctggctgcccttaacattttttcctttgtttcaactctggtgaatctgacaattatgtgacttggagttgctcttctccaggagtatctttgtggcgttctctgtattacctgaatttgaatgttggtctgccttgctagcttggggaagttctcctggataatatcctgcagagtgttttccaacttggttccattctccctgtcactttcaggtgcaccaatcagatatagatttggtcttttcacatagtcccatattttttgaaggctttgttcgtttctttttattcttttttctctaaacttctcgcttcatttcattcatttgatcgtcagtcactgataccctttcatactgaatgggcaaaaactggaagcattctctttgaaaactggcacaagacagggatgccctctctcaccactcctgttcagcatagtgttggaagttctggccaggccaagcaggaaagagaaagaaataaagggtattcagttaggaaaagaagaagtcaaattttccctgtttgcagatgagatgattgtatatttagaaaaccccattgtctcagcccaaaatctccttaagctgataagcaacttcagcaaagtcttaggatacaaaatcagtgtgcaaaaatcacaggcattcctatacgccaataacaaacagagatccaaatgacgagtgaactcccattcacaattgcttcaaagagaataaaatacctaggaatccagcttacaagggatgtgaaggacctcttcaaggagaactacaaaccactgctcaacgaaatgaaagaggacacaaacaaatggaagaacattccatgctcatgaataggaagaatcgatatcatgaaaatggccatactgcccaaggtaatttatagattcaatgccatccccatcaaactaccaatgactttcttcacagaattggaaaaaactactttaaagttcatatggaaccaaaaaagagccctcattgccaagtcaatcctaagcaaaaagaacaaagctggaagcatcacattaccggacttcaaactatactacaaggctacagtaaccaaaacagcatggtactggtaccaaaacagagatatagaccaatggaacagagtacagcccttggaaataataccacacatctacaaccatctgatctttgacaaacctgacaaaaacaagaaatggggaaaggattccctatttaataaatgttgctgggaaaacaggctagccatatgtagaaagctgaaactggatcccttccttacaccttatacaaaaattaattcaagatagtttaaagacttaaaaattagacctaaaaccataaaaaccctaggaggaaacctaggcaataccattcaggccataggcatgggcaaggacttcatgtctaaaacaccaaaagcaatggcaacaaaagccaaaattgactgatgggatctaattaaactaaagagcttctgcacagcaaaagaaactaccatcagagtgaacaggcaacctacagaataggagaaaatttttacaatctacccaactgacaaagggctaatatccagaatctacaaagaacttgaacaaatttacaagagaaaatcaaacaaccccatcaaaaagtgggcaaaggatatgaacagacacttctcaaaagaagacatttatgcagccaacagacacatgaaaaaatgttcatcatcactggccatcagagaaatgcaaatcaaaaccacaatgagataccacctcacaccagttagaatggcgatcattaaaaagtcaggaaacaacaggtgctgaagaggatgtggagaaatagcaatgcttttacacctttggtgggagtgtaaactagttcaaccatcgtggaagacagtgtggcgattcctcaaagatctagaactagaaataccatgtgacccagccatcccattactaggtatatacccaaaggattataaatcatgctgctataaagacacatgcacacgcatgtttatagtggcactattctcaatagcaaagacttggaagcaacccaaatttccgtcaatgatagactggattaagaaaatgtggcacatatacaccatggaatactatgcagccataaaaaaggatgagttcatgtcctttgtagagacatggatgaagctagaaaccatcattctgagcaaattatcgcaaggacagaaaaccaaacactgcatgttctcactcataggtgggagttgaacaatgagaacacttggacacagggtggagaacatcacacactggggcctgtcttgtggtggggggaaggaggagggatagcagtaggagatatacctagtgtaaatgacatgttaacgggtgcagcacaccaacatggcacatgtatacatatgtcacaaacctgcacgttgtgcacatgtaccctagaacttaaagtataataataataataataaaaaaggtgggaaacataacagattatcagagaagactgctctggataaaaattgttttgtgaaacctttgtgtatgtgtgtcagttcgcagcataaaaagtattcttgctgtgggacatagtcgaaaaaactttaatgctgctgtttttagagagcttctagtaaaaatttagctggtaaatttacattttcttttcctattttgaggagttaatgtagtaattttgtctaatttgagatgtgcttagaattttggtttacagagtaattgtaagaatttaagattatattgaagttataatattttgaggtgacattttagtaacattctcaggtaaaaggtaatgtaagtgagatgcctaactactgtgttaacagttttggcatgggttgaaaaccattataaatattagtggcttattttcctgtgttttatattattttgatcatatttaaacctaggacattaaagtgtaaggaccctcagatttaaatttgaatatgaaataataaagaaattacattaatataattcattgatatgatgtacacaggatagttttattttaaatagaagcaaatataattagctaacttaaggcaaaactctatactgggttttatttcacatgtaactaaaatattggtgattgtcttatttgcttagttatgagtctcaggaataattaaatggtatgagatttttcatctttgtatagtaactgtatcttgtttatgtcagcaatgcctactataggtctggcaaataatataagaatatattctaaacaatgtaaggaattatttattccctttgcttttaggacattgatatttctgaagtatacgtgccacttattttatggcgtatccctcaatttttatttttctgttgttaattcatgatcagatttagattgtgattttttggttagaatactgtgtaagtgacgttgtgacttttgcagaatatcacacctacaggtgcttgatgttcattagccactttttgataatgttaattttgatcccttgggtaaggtgaggttctccactgtatcactactcttttcttttataaataaagagcagtcgtgggtagatactttgtgactatgtaaacatacaattccacgtgagactttctccactttgattcagtatctactgatgattcttacttgattgaacttcttgtaacttttgattttgatataatttatataattttaaacttacagagaagttgccataatgatgtaaggaagccccatatattctttatcctgattcaccaattgtttacatttgttttacgtttttaatctgtaaaatgggggtaataagcgttacctgtctcacagggttgttagttttctttgtcttcttttttgtatatatagtatagtatatatatgctatatactatagtattttatatatattagtatatatacactatatactatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactatgtaatatacattagtgtatatatatactatatactatgtgatatacagtatatatatatactatatactatataatatacattagtatatatatactatatactatataatatatattagtatatatagtatagtatatatactgtgctatgtagtatagtattatatagctattaagtattagtttgtaataatagttatcctttctatattttctattcatttaagctttctgaatactgattattctctgtgaagctgtgtgtgtgggtgtttgcatgcacaaacacatatgaggtcagcaattttatttactttttttattactctgtcatatggccatggaacaaatatttttcaatgacaaagtttaatagaaaaggctctggaaattaagaaagccaatccatgaatacttttagtcatgactcttttaaaaattactttccttgtgcatactctttaatttatttcaattcaattctacagatagatgtagaatgtgcttactgtatgcgggacattattttaagtgctccgggtatagcactgataaaaagggcaaaatcctttgttctcaaggagtttagaatcttaggtggtagtcagcaagcaaataaatactatatgttatgatagatggcaaaaagccctaagaaaataaagtgaggcaagtagtgacacagttcacttattagttttctgttatccggggactgagaatacagtttgttaatttattgaccctgcttctccgtcttctggacgtttgttatgtcagtcattcttactgttagttgaggccaaagaaactgtaatctagaagttatttagtcctctacttagggagtgggtagtgaatgagtctttcaaaatttgatgcaattatccaaaattagtgaatgtgtatgcgtttttctgagacaagtttctatacttttcattcagttatcaaatagtctgtgacccaaaatatttaagtggcgactctaatttgtcctttcttctagccacatggctaaggagttttgtgaatgagtaacacagtcttgattaacatgaggtttgcaggctagcctttgtgtacctatctctagttagtaacttttaaaattagagttgtatccttttgtcagatggctttctaataattttctaaaatgaacataataagtataacattgtaaatatttaaaatatgcaattttgtttgtagttttaaaatcaaaatacttgatagtttcttgtgtgatgatatatattttgagtagtattttccaaagacaatttataatatcaacaaagaaggctaactcatggcaatattacaaatatacacgtatctagttggggaaagaatatactgattggacagaacacttaattggagaaattgggaaaggaggtgccactaactcaatatttgacaatgtatcatttaaccctttacaacttagtgaggcaggtcttattgtgtccattttgcagatgagaatatcgaggcccaaagaggtgaatagaatatgtaacttgcttaaggtcaattagtatggaacttcacagcccacactcagctgctactttagcaaaccaaatgaaagctagggtaatgtttactcattataaaaaggatttctggacatgctttggcctgcagataatattgtatgtgtgacaggtgggaggggtatgtgtgtgtgtgtgtatgtgtgtatgtatgtatgtatgtatgtatgtgtatgtgaagaaccaaccaaatattagctctataggttgcagtcctgcctcctaccaaagccatagccaagtggaaatacaactttttttcttcctctttcatacattcattttcatgtgaatacttctccttgaaagtttgtatatgttatgtgattgatcacttgtctgagaggaatctttagtgttgactctgtcagaggctgttgtaggtcacaaggatataaaggtgaataagactccagctgtctcctaatggagattgcactctactctgaggagatagacatgtagacaaattattgcaatacactgatctaaatgttaatagagaaagatgcagagtgctgagggaacagagtagcagactacagagggaagggaaaggaaaaaataacagaggaggtgacactggagtcaaagaagaggcatgtgaaacagcatagtatgttttgggaatcttatttgtttcactgtggctaaattatagataattagtaatatgttttagaacgtaggagtggaaaggttgttatcccatcctgaggggttttgtatatagagtttggattttattttgtaggtagtaaggagctattggagaattttaagaagggaagtgggatgatgggacgaggttctataggaggcaggtagcccagttagaagactattgtgatagtctgggaatatgtggatgatgagaatctgaaatgagtcatgaattttggaaaatatttgaaaaatatttagaagatactgtagaacaaattaggtgaccaaaatgccttatatttataatactttatagtttccaaaatcctttaggtgtgcatgttattggatattatcagtaacccagaaaagtaggtagttcagatggatttatttccattttatatgaggaaattgagatcttgaaagattgtggcttagccacggtcacatagctggtgatagtttaagcatgaaccaaatcataaacttcaaatatagggttctttttaatttgtctgcatcatctctatgcagtgcctaagcatacattagttaatatcaaggcctgatcacagtggggtgtgagttttaatttattcacttgatatctctcttcattagttatgttaagtgcctaatggagagggataggatcaattaaataaggtaaatgcaacattttacaggtctatataaatacctagaaagtgcttttcaattaagacggcatgtatgccagtgcttttttatatatgagaatggttatgacatttattcctattttattggagagtctattgcatgggacttgataatagtggcaggctggtatcagagactatgcttgctgtaatcagtgttaaagatcagtatgtaaagaatccttacttaacatgtaccatgaaattgattttttattagttattatagagatattatagattatatctctacaacatcttccttctttttacccataacctctaaaaggcttagtgccagaaggaacagaactgtatctttattttctcatcacatcctctctcaaatagataatacttccattgctgtctttccaacttggctttgagtcactgctgtgattctagctgttgaacagtctttcaaattaagtgattagtattctagtcaaggaaaaattgtgagcctgccattcttacccagtattgctaaggtagttttactaaatctattattagggtcatgttctcagaggcatatgacaattgcatttcacaaaacttccctaaatattgatacttgagatttacaggaaattaaatctaaaaccttacacttctgaagctggaggcaccatagagctgtgaagttcagtataaagtcacatctgtgctcaatactttataagaaaagttactctgccttagtcttcctttactatttttgtcttacttgattaaaattttgctgttgtattaactaataaattcaaaggaaatgttctgattagtttctgtcataactgggaacgatagtaagagtaccttggaaagtatgatagtctgttgcgtaacacttgctgggtagtagatatcaattctctgcctgtttcaatctcattgtgtctaaaggtgtgaacctcttaccatctggatactttagtttccctctaaattaaaaagaaaaaaagcaaatcttacctgtatagtacctacgcaaagattttggaagatagtgggaagtcattaaagtgcttttcaccaatttatgcaatttactagttgaaatttgtaactatttaaaaatcattagttttaaaaaatactattttaaaatagtaatttactatttaatatttaaaaaccattggctcttttaatatatttcattgcttggtattagaattttttatttttagaatagagtatatttaaagatgacttttgctgttaaatttgacaggcgtggcaggaggccaatctaataagcccaaagggagaattcgcagagtatgcaggttaaaagagccctggaactgactttctgtgaagcctaggctatccatatacattcctgctgagtggagatttgcttaaagttgactgttttcttccttctgtaccatctgattccaatctgcacctgtcttttatagctagagaccgttggatggcagcttaaccttcagatggctcactctgctcaagcaaaactaaaatctcctcaagctgtgttacaactcggagtgaacaatgaagattcaaaggtaagaaatggtatcccattaaaaggatgtattttgtttgttaggacttaaactttttattcttagcagtctttgctctctggatttagaatttaaacataattcagttaaacagttattaataagtggatcttttttgacagaaatagcttatcttgcaaggtgcctttcttacaaaaacatttcataatgtcttcttttaaattctgcagtgaaaaaaaattgttgaagaccatataaaattatgattttaatgttttaggtatttgcagatattcctgagtgtttcatgttttaagctgaatatatgtggtagagagaatattgtttgttgtccagctagagcctggaacaataaatatgatggtgacctgaattgtgtttttgtgtgtgtagtagtatagtatgcctgcatgtgtttaaatcccagcttttgagaaatacaatttatttattttttttgagacggtgtcttgctgtcgcccaggttggagtgcagtggcgcgatctcggctcactgcaggctccgccccctggggttcacgccattctcctgcctcagcctcccgagtagctgggactacaggcgcctgccaccttgtccggctaattttttgtatttttagtagagatggggtttcaccgtgttagccaggatggtctcgatcccctgaccttgtgatccacccccctcagcctcccaaagtgctgggattacaggcgtgagccaccgcgcccggcctacaattttttttataccacaggattttactttattattaatttcagaacaacttgaacgtgattattaaagatcaaagcattgctatgaaatactttttgttactgcggcatatagggaaatatatctttcagatatgataagagctttttatcatattttatactgtaatggattatcttttaaggtagaaaagggggagtgactttttcctcctaagtagataagactatctcatcttaagacaaaatagaattgagaatgaggtattagagaagatctgaggcaggagattacagtgactgaatgataatagaataatggaagaaatgttattatttataacaggaattgaaggatgggaatattattacttttttgttaaaactttcgctattcattctattatgcaggtttctggcttctttaagaagtatctagcccagattatatgactataaaattctgtggaattgacttgagtcttacatataatgtattagtttattacagtgtttcaaaagtatcattttatttcacacattttcactggaacgtaatatgaacttagtggttagagtcaagctattagagtatgtctggtggtttccctttatgtgcagtttcactttccatagtttcagttacccgcggtcaactgccgtttgaaataggtgagtacagtacagtaagatgagagaaagagaccacgtccacataactttattacactatgttgttgtagttgttctattttattattattgttgttaatctcttacagtgcctaatttataaattaaactttatcataggtttgtatatatgggaaaaaacagtatatattgggtttagtactatccatggtttcaggcctccactgggagttttggaatgcatccccccacagtgggcagggggactactgtgtgctctgcagtttagtgtagtgtaacctcaggcaaattacttaatctttgattctcagtttctttatctgtaaaatataggtaatagtatctatctacacaatttttatgaagactaaatacctagtatatgtaaagtgtttagtccagtgcccagtattacagcgtgtgctcaataaatgctggctactaccatcatcatcaataaaacttttttgtttttggctaaaataaagaaatcaatccatttgttttaattcagagctctcactaaatttatttcctgatgaagttattacctcttcccttgttccttgcattccctctcccttttttcttgattatatttttcacatgtatccttactggaaattaggaggggaaaaagagcctgaaaagtcccttttgtttcttctgtgaactgagtaagttattcctttaggtgtaggatgatgatctggaactcactagcatagactggagctattccatgagtgaaaatacatacatacatgcacattccaagtagctatatacttcctttgttttatttttcgtgactacctaatgttaagtctgcgtagctaaaagcattttgtatgttggaagtgtactattttgaccacatacattggatatgctttaagcatcatgagttcagcaatgcttgtctttgggattctcaagtccttctagcttctttgttacatcttcaaagtatgcctatgtgtctgttatatttttaggcagtaggaataaaagagtaatgcttctagtaagacagccatgttaataagacattcagattattcaggaagatgtgaatatctagatgtgaaatctaactcatttgaaatatgagcttgagtacatttatgtttttctgtgtttgtattttgagattttggatagatgcatatatgcacattgattaatcttataacttgcagagctagagcaccattttcattaacaaatatgctgaggaagaagaggagaagcacacatacataaaagatatttctctttcatcttgtatgtagacttaagtgacttctttgtattgtctttctcttctatggcattgtacacattttgtgcctgtgtcttatatctcctaaacaatagacagacacataatgaggtatagagctaccatcacctaggcagaagcatgccatctccaagtgttatggtgtgccctagctgtaaaggaacagttaactactatacctcttttcctcaatgaactgctgcctggaattactgctctttctcttgtttaccttctccttgattttatgatttggtattctattctttgtactcttcatcttattccttatgttaatttttatgtgactcctgttattaaggaccacaaactacttttctttcaaatatttacaaatatgaaatgagaattcttcacaggttggaatattaagtaaaaaggaatgagggtatagagcatgttttaaaaaacaagtttattaaaggaaaggaaagcttttacaaaaagggagattaaaagttaccactgcttagtttatgatataaagtatcttaaagtacaaaactgtcatacttatgaagttggtgttggtttaaaacaggaagcattgggtacagttctcataaatgtgtattttatagggtagttatcctgaaaatatacatatattaaactactgggaggattagaatcactgtaaattgtgagggattattttggttgtatttacttttgagctgttgtactgaaaacttactgtaattcactgaagagtacggtttataaggagctccttatcttctttttcacttctaacatacaaatgaaaaatgcagcctgcagtgaagttttaattgctatcacactggataacactgtttgactgtggtctcctttcttagaacacttctgtctcgaggctttcctgttttgctattaattttatcacaaaaactaggtgattgtagctttcctgcagtattttgatatgtattctagttgtttttggttaattgtcttagtgtttgtctactgtgtttagcaaagtgagattattttcctgttccacagatacctcaaatcgagttttctgacttaaagtttttttcgttagggggcagtagagtgctttgcttacctagccttttctggcattcacagtgttatttgaaataacattcaaaataatttgtgaagtcagtagttgaaggaaatgctaagtgtttacatttcaaatctttatagaacaatagagttctcttatttatttccataaacaaaattaatgcttattaatcatatacatatagaacaaataaatgaaatcatcatgatttggcttttgaaatttgtatatgatcatttgccaaaatgaaatatattaaaagctttctacattattgacttttttgttacattctgtcacttgtattaatttcttcatgagaaaaaagaataaaatagtccataagataattgaatggctctattaggttatgatgtaactagttctaggcccattgtagtcagctgaaaattctttatttctagagagtaatgtcatttgtaacaaatgttgataattttgactgacaccaacactttaactttgaatatcttaaaatacttaaattttgctattaatcttagtacatttttttccccagtaaatttcctgttaaagacaaacctgttttgttaatacagggattccaaattttatttgtgcatcttttgaggaaggatccttgtgtttcatttttttttcttttacagtaactgtggtaaaatcaccctgacagtagaatttttatttatcttaatgttaaattagattataatcagattgcagaaagtactttatgtagaagtaattatgattttgaatgaatttggggcttctaatactagttttctgacttagagctcttcattcttatttccaaaatatatgacaaattctgtttagtgtgagaaaatgggcaaaagttcttttttaaagtgtttactctgtgctacacatagtatcacttctttttgtggttaaaacctctcttccaggcatgatttcttattattcttattttattgataaatggagacacggaagcacagagaagttaaataatattcccatgttatacagatagtaaacagtagacctaggatttgaatccaggcaattttatttgagttccagtttatcagtaggatgctgtatcaccttgttaatttaataacttagcagttgaaattgtaatatgtgtatatgtttcaaggtgttgaaagctgttgtaaaatgtaaggttgttcataggattatcgttacatggactctagatttaatttttctttcccctttatttgactaagttgaaacaattttacatttttagtcaattagaaacaccatttattcttatgtagtaagtaaagtataaatgatgtcagttcaacagaggctgccttttattaacaaatattattgtaagggctacatgacatcaatgatgttgatgtgagcaaataactgcatcagttaaaaagaaaagatgtcctcagatctatttaggatagatttctcagagaaaaatatgtatgctattcaaatcatgaattcttgttatagaaatttaaatcttttcatcttaaaggtggtgttagtattgactgatttggaatgaccttcacattttttagctacttatgtgagttcgtctgcattttccttttttttttcattgaagtatcacgtatcatatctttattagaataaatcacactaaagcatactttctcacccttaattacacatacaaatgagataattcaactgataggacataattcaaatataaataaaatcattctctcacatatttaacattgttgagtggattttaaattgtatatatttaaggtatacggcatgctgttttgatataaatatacatagtaaaatgattgctactattaagaaaattaacccacccatcacctgccattattaccttttttgtgtttgtggttaaagcacgtaaaatctattttcctagcaaaatttcagtttacgatacaatatcattaattatagtcctgatgctgtacatcagatctccagacttatttatcctacataactgcaagtttatatgctttaacctgcttctccccattttttccctttccttgtctctgataatctctgttctaataggcatttttaaaaaattccacatataagtgagatcatgcagtatttttctttctacgtctggcttatttcacttaccataatgtcctccagattcatccatgttgttgcaaatggcactatatcctttttcaaggctgactcatactactatgtgtgtgtgtgtgtgtgtgtgtgtatgtgtctgtctgtatatatgtctatgcgtatatatatgtacacatatggacacatacacataccacaatttatccattgatagatagttacgttgtttccatatcttggctgttatgaataatgctgcaacaaacatgggggtgcagatatctctttaacatactggattcatcttctttgaatatataccaagcaggagattcctggtagttctaatttgaatttttggaggaaccttcaaactgttgtccttaatggctataccaatttacatttccaccatcagtgtacggggttcccttttctccacattctcaccagcgtttgttgtctcttgtctttttgataatagtcattctaacagttgtgagataatatttcattttggttttgtttgcatttccctaatggttagtgatatggaacatcttttcatgtatctgttggccatttttatgtcttctttggagaaatttctatttaggttctttgccccttttaaaatcaattaatcttagtacattattattattttgctattgaattgtgtgagttccttatacatgttgtatattaaccccttatcagatatgtggtttgcaaatttttcttccagtctgtaggctgtgttttttgttgatggtttccttttctgtacaggagcttttagtttgatgtagttctacttgtttattttttgcttttgttcctcaagcttttggtgtgataattcaaaatatcagactaggatgaacatcaaggagctttttctctgtgctttcttctaggagttttatggtttcagatcttatgtttaggtcttttatctcttttgagtttgatttttgtgtatggtgtaaaggtccaatttcattgttttcacatggatattcagttttcccagcaccatttattaaagagacaattctttcgttattgcatcttctcggtagccttgagaaaaattaattgaacatgtatgcttgggttatttctgggctctctatagtattccttttgtctgtgtatctggctttatgccagtaccatactattttggttactataactttataatgtaatttaaaattaggaagtgtgatacatctaactttgttttactttctcaagattattttggttattccatgcgaattttagaattttttttctctatttctgtgaaaaaatgccattggaattttgatggaattgcattgaatccatatattgctatgggtagtatggacattttaacaatgttaattcttccaattcatgaacgtgggatatcttgctatttaattatgtcatcttcaatttctttaatcagtgtgttatagttttcagagctttcacttctttagctatatttatttataggcattttattctttttgctctcctagcaatggtatagtagcggggggctgggaagaggggtggtggctgggaaagtgggagcacataaataagattgttttcttgatttctttttaagctaggtcattatttttgtgaagaaatgcatctgatttttgtatggtgattttgtaaggtgtatgctactttactgaatttatttgttcatttaacttttttgtggcgttttaagggttctttttctttaaatgtaggataatgtcatctgcaaacaggaataattttattgtcctctctcaagtgaaatgattttttaatattgcctgcctttttttaaaaatcatgattcatttttctgttaccaaagctgtatgtgcttactgtagaaaacttagaaattatagaaacgtgaaaggaaaaactgttaaacttaccacaaagatgcaggtaatccatttgttttattttatttagtgtttattcaacataaactttttctccagtctgattataggacttgtttaattttatattctaccttttttcacttaatgctgtaacaaatcattttttatatcatttcaaactcatcattaatatattctaaatgactgcattatgttatggctatgacagacatattaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtataaaccaaaataaaacaaaacatcttatttagtttgataaatggctttctgaaatcattttggggaatatacacagaaacgcaaacgttgcattcagaagatttcttagcttctagagaaagatataacactatttcaaaaataggttctttaataactaggtaattaattactttggattttaggaggccagtaaaaagcccagatatttttgtaatattatagcgccccctcttttaaacttttgtattactttagtgcacaaattaaacaagcttttgttatgtgtattttgttttattatagaacatgtagaaggaatctgatcaaatactcaagcagttagagaaaatagaaataactcttatgtgttagataattgccaagatactttgaaaacaaagcctgcttctttggaatcaaatttatttaaatatttttaaggctttgtgactctggtttcctgattctttgttttgtatcctttttcattgtgatcaatttctcaatgaaattatccttcaaggttttacgttttctaaataacagcaatacagaaatgttttccctcaatttaatgtgtgtttttggtttttttttttttttttggttttgtggtcaacatgactttttaaaagacaatattatgtagtcaggtatattgatacaaatcatatgtatataatttctgcataacgcaatgcaaacttcctccatatatgtgggtgtgtgtgtaagattttttcatatttcaggctgtcaagtggaaagtctacatttatccataataagattttataagctaacaaaaatactgtttcagatgctacttacctttgaagagtgaaaatacacaatattaatacaccattagaggttagtatttatgtggagaaaatgataatagagacttggaggagaaaatctctgttaaaaatactccaaacattttaggcaatttagaattaaaatattgttttactaaaattcttttaaaaattttgtgggattccatagtaaagaaacaaatactgtcttcacttgtcttttctagcttctgaatcgtgtagtctctgaaacccagaggcagttgataaatacagaatttttaaaacagaatatgtttagaagtacctttaaatttcattagataccttttcatgtattagaaatgacagtaatgtaaatgaataatataaatattttgacataaaagtattaacaatgaattagacatctggacaagtaaaatgctcaattcaataaagtaaatatgcactaactttttaaacatcttgaattcagttccagaaatagtttttaagcatttactacatgtgagttactaggcaaggtattcgtgatataggcaggttttattttctgtcatggagcttatgggctagcaggaaatacatatgttaagccagtaaatataagtttgatgactagtacaaaggaggaagtacatggaaaccaatagcaaggaattagaaactgtgacaggcagagaagttttcagatggaggaaaaagcacctgaaagacgacaggtttattttttgagcatttcaaatatggaggtacctgagatatccaggtggagattgtcaggtttgtagtctgagacatgggagcaaattgtaaactagaaattgaggtttggaaatcattgagtttataatttcagtcatgagaatggaagagatcacttagaggatatattagaactaacatttaaatgacaagtagaattgaaggagcttatgacagtgattgggaaggaacagccaaataccaaaggaagagagcatttcttaggggtgaatcatgtcacatgttgctactaagtaaagttagagggaagcagggtcagagagagaagataataattctcacagccatgaagtaggtgctagtattttcctattaactagatgaagaaacccagactcagtggttaagtatctttctctaaattggatactagaaagtgatggtgctataatttgaacccaggtctgtctgactccatagtctgagcttataatcactacatagtgttaaaaaatgaatttagtgacatggagatcattggtgatcagtttgtgggacaggagaaggaaatatttcaagatggagggcagtattggatgctatttgagaggtcagaaaagagaagaatggacatgtgactgttggattttgtaaaatggacttctctgataacctagacaattatgatttcaataacaattgagaggagaagaaagaaacctaattgggataaactgacgaaagaatatgaggtgagagtggaagtagtgatacaggtaactttcggaaataggacagtttatgtaggggaatgtggattcagtaaatggagatactagaggaggtttgtatgcagatgccacagatccattgggggagaaaatgatgcagaatggagagggatatattaatacatttcttgagaaagtgagatgtgagattcagagcacaaacggaaaggtaggattcaatcagagtgggaacatttcacttgtcttcatagagaagagtatgggtcaggtgagtggttttgatggtggaaagagaaagttgcaatgatctgattgcttctgttttctcaatgctgctgtcatgaggttgggagaatggggcggttctagtaggtttgagaacagaggacaaagtgtgaaatggttattttggatattggacaattgaacaaactgggtattttagggtatttttactattactacacagtgctgattgcccaattgtgatttgtgatcacgactttgagaggagaactgttggcaggttgtgtagttttcttcatctatttttaattgctcaggtgcacatgtggagtaggtggataattgggtttaatcatgcttttatctttgccgggtgttgtcagtggagggtgaaaaggacaaagggtttgtctgtgtctatgaaagagtaaattttagtaactgaccctggagtctaaattgggccaggtggaaagtgaggatattgtgtatgtgtgttcggggcagggtggtaagtgatgagagggagaaactatctagaaatatgctggaacctagccatactctctgatgtggttaggctttgtgtctgcacccagatctcatcttgaattgcaatcctcacaatccccacaatccccacgtgtcaagggagagaccaggtggaggtagttgaatcatgagggtggttcccccatgctgttctcctgatagtgagtgagttctcacgagatgtgattgttttataaggggctcttacccctttgctcagcacttctccttcctgccaacttaagaagaaggtgtcttgcttcctcttcgccttctgccatgattgtaagtttcttgaggccttcccagccatgctgaactaaactgtgagtcaattaaacctctttcttttataaattaccctttcttgggcagttcttaatagcagtatgaaaatgcagtaatacagctttcctagaggtttatagaggagcctcaaatagatgcattattttccaggatcactcagtgacttttaatttgagtcttgagatgtctgtggcttgacctggtgtacagtttatctgttaagacaaagaagtggatacatgtaaaacttgaaagctggtcttttgcgaacctttaccctgcatcaccttggaaacaagtggtctaattatatgaagatttattctgtatcctaggagttcccaatgtgtgtccagtggctactcgttgatctcttgcttccttggttgataatatacccagcatctgctggagatagtagagtattaatttcataatgagcccattaccccagtgatactatatccagaaatcaattaaaatgtgagaattttgtatgttgtttgaattatattagcttttgaacatcagtggtgatttttggaattgtttttctgaatctggtattcttattttgagggtattattgtaaattttacttcaagacagagtaaagatgtctagattaagttttcttatgagtaatttgcattattggatactgaatccagtcccaattattttggcaataaaaggagttgacaaacacttctttcctggcatagtttaaataagattttaagcatgtttacggtgttagttactatgtgaatacttaaatatgtctttaatggattgtggggattttagtcttttcagattttttctttcctttatatgagaattatttagaggaagttaaacttatatgaagaggaagaatacttgtaactatatatttctcagaagaaattattgggcacttttggctgttttgatggtattgggagaagggaagattattctattaagttttcatataaaatctctttatttttgtttttcaaagtttctcagctgtccttaatacttatgatccaaagctgcaacctttcagaaatgccatgtccatattttaaaaaactaaaatgctttaaggatttaatcagatcctcgagtcttatatcacaggacttatttggaaatgtggccatcccgagatagctaatgatgatgagtctggtttgggtgttttctttttgcatatttagcatcaacccagcaccatcggttctgtgtttttggtgtgtatctggatgatgtatttgagaatctgctgaagacagctgttcggttagtgcacaaggaacagtcaattttagttactttatcatatgctggagattgatattcataaagcagtgggaatataccgtaactagggtcattgatgaacaaagggatagaaatggggttgatgaagcagtattattctttatctcacgaattatcctaacctttgctaccagcacaaagaagagacagataggattaatataatcgaatttttacaaactcattttaacttgcttgtttcgtaaatgtttgattcctaagtataatcaatgaatagcaaattatacagtattttaaaaaatatatcatattttaagcttttaaaaattggttgactatctgaaattgacataaattttgcttatagtcagtaactgctattatgacatcagtgaaactgtatgttgtgattgttgcggctggttaaccaaaacatgtatttcacaaatgacatgtaatgggtgaagatgaaatgtaatggaaaatgaatgtgtagaaagaaattcttgtttatttcatgtttaaagaaccttgattttgtcttttaaaaaattattttatactttttaaaaattacacaagtaatttacattgaggaaaaataaaaaaatgtaagaaaataaaattcacctagaatcctacctagaggtaatcactttgagtgacgtatttaattggcatatatctttccaagtctgtccattgtaaactagttgtctttccccataaagcattatattgtaaacaacatcttttattgtcagtacatgagcttctactcagcaacatcattttaaatgactacataggattctgttgtttgtatgttccatttcttatttctttttttggtaaatataatttatttattcaaatagtccttcagcagtacatttgcctttaaagccatatttaaaatactatatactaacatgttgactaaagtgatcaagaagattttagaaattctattcatgtaaattctgttggaattctagtaattgctaaaatattagatttttattgctgagagacttcctttttcagggattaacatgtttagacatatagtttagaatgtcttttaaaactatatgtgtgtttgttaattcatgaggtttctaaaccatgagattttgctccttccctttcttcctctctttctctttccccctcttggcttcttctttatgatagagtagatacgaagtttctttcagacataaagaagttctaccctatccattataaaggggtaattttacccatatttaatgtgctgctacctccttggtgagagcagtaccataaatatcccaggataacacctttgttgttgtcaacagtaaaatgaccagaattgtctaggtacaacttcatttatggaatcagcaaaggctggtggaattttctagccgaaagggatcttaagtggatttgtcaatggattcttttttttttcttttctgacaatggattcttaatatgacaccaaaagcatgagcaatcaaagagaaaagataaattgaacttcattaaaattgaaaacttttgtgtatcaaagaacattgtcaagaaattgaaaggacaacctgaagaatgggagaacacattttaaaattacatatattatgggatttgtatttgtttttttgtattttattattattatactttaagttttaagttttagggtacatgtgcacaatgcgcaggttagttacatatgtatacatgtgccatgctgatgtgttgcacccaataactcatcatgtagcattaggtatatctcctaaagctatccctcccccctccccccaccccacagcagtccccagagtgtgatattccccttcctgtgtccatgtgttctcattgttcaattcccacctatgacatagtgagaatatgcggtgtttggttttttgttcttgcgatagtttactgagaatgatgatatccaatttcatccatgtccctacaaaggacatgaactcatcattttttatggctgcgtagtattccatggtatatatgtgacacattttcttaatccagtctatcattgttggacatttgggttggttctaagtctttgctattgtgaatagtgccgcaataaacatacgtgtgtgtgtgtctttatagtagcatgatttatagtcctttgggtatataccgagtagtgggatggctgggtcaaatggtatttctagttctagatccctgaggaatcgccacacagacttccacaatggttgaactagtttacagtcccaccaacagtgtaaaagtgttcctatttctccacatgctctccagcacctgttgtttcctgactttttaatgattgccattctaaccggtgtgagatggtatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtcgttgcccatgcctatgtcctgaatggtattgcctaggttttcttctaaggtttttatggttttaggtctaacgtttaagtctttaatccatcttgaattaatttttgtataaggtgtaaggaagggatccattttcagctttctacatatggctagccagtttccccagcaccatttattaaatagggaatactttccccatttcttgtttttgtcaggtttgtcaaagatcagatagttgtagctatgcagtgttacttctgagggctctgttctgttccattgatctatatctctgttttggtaccagtaccatgctgttttggttactgtagccttgtagtatagtttgaagtcaggtagtgtgatgcctccagcttttttctttttgcttaggattgacttggcaatgcgggctcttttttggttccatatgaactttaaagtagttttttccaattctgtgaagaaagtcactggtagcttgatggggatggcattgaatgtataaattaccttgggaagtatggctattttcatgatattgattcttcctacccatgagcatggaatgttcttccatttgtttgtatcctcttttatttcgttgagcagtggtttgtagttctccttgaagaggtccttcacatcccttgtaagttgcattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcaggtatgatattggctgtgggtttgtcatagatagctcttattattttgaaatacgtcccatcaatacctaatttattgagagtttttggcatgaagcgttgttgaattttgtcaaaggccttttctgcatctattgagataatcatgtggtttttgtttttgcttctgtttatatgctggattacatttattgatttgcgtatattgaaccagccttgcatcccagggatgaagcccacttgttcatggtggataagctttttgatgtgctgctggatttggtttgccagtattttattgaggatttttgcatcaatgttcatcaagcatattggtctaaaattctcttttttggttgtgtctctgcccagctttggtatcaggatgatgctggcctcataaaatgagttagggaggattccctctttttctattgattggaatagtttcagaaggagtggtaccagttcctcctcgtacctctggtagaattcggctgtgaatccatctggtcctggactctttggttggtaagctattgattattgccacaatttcagagcctgttattggtctattcagagagtcaacttcttcctggtttaatcttgggagtgtatatgtgtcgaggaatttatccatttcttttacattttctagtttatttgcatagaggtgttcgtagtattctctgatggtactttgtatttctgtgggatcggtggtgatatcccctttatcatttttgttgtgtctatttgattcttctctcttttcttctttattagtcttgctaatggtctatcaattttgttgatcctttcaaaaaaccagttcctggattcattaattttttgaagggttttttgtgtctgtatttccttcagttctgctctgattttagttatttcttgccttctgctagctttggaatatgtttgctcttgcttttctagttgttttaattgtgatgttagggtgtcagtttttgatctttcctgctttctcttgtgggtatttagtgctataaatttccctctacacactgctttgaatgtgtcccagagattctggtatgttgtgtctttgttctcattggttcaaaagaacatctttatttctgccttcattttgttatgtacccagtagtcattcaggagcaagttgttcagtttccatgtagttgagtggttttgagtgagtttcttaatcctgagttctagtttgattgcactgtggtctgagagacagtttgttataatttgtgttcttttacatttgctgaggagagctttacttaaatgaatatagaagaagaataccacttccttaattactaatattctattgtaggctacttgaactctctccctgtgggattttttttcacagtgacctttcagagagtatgagctgtgaaagaagaaatccacagggatagtatggcagtgtgccaactgtaaatgtagataaaaaatctggctactatatcatcatcctcaattttaatactttgtatttacttagtagctttcagctataggactcaaaagtctacaaatagcctcaaaacaccccattgaggcaagcatagagtaatcattattttttgttaaaagaggaagtgaatggtgttatttaattgtcagttttagaataagagaataaaacatcttttaaaaatatgctgctagttacagcatggtctttttttaaaatgagaaaccagaagtttttctccttcatgttaagggatggtccaattttcatccccattttcctttggttatttttgccacttttttactgattgtaattatgtgttgacctcatttgattctaaagtataagaaaatatgagaattataagcataaactttaagtagtttcattgacctattttaatttgtgaaatctttttttgctataaacagatgagtacaataatttataggtagctttgtgagtgggtattttgtttccagctatacagaagttgcataatagctacccactcaggtattttagattggcatggtagtaactgtttaataataagactgctactacataatagcatatttgtgcatcttttcgacactacacatgaatgacctttatgaataaaatagtgctacctaattctatatattttggctatatgtttcctaaaagtgataatctttggagatggacagatcttacataggttaagatacaggataagtttaaaaatacaaattaaaatggagtctaattaatagtcgttcctgaaaaaatataagcctttcccatgaggacattttctgtcaagaggtaagtgtgggtcaggctcatttggaggctgagggggcatctgatttcttcataatattatataaaatttgtgagtggctaagctacctcattgtttcttctgtggataagggcctgctgccttgaattctagtcagcctggatgggtggggctgatctaagctgagggtcttgatagctgcagagcacacagtaatcatcatacctgataacaccatattgaaatgatcaagacaataatgataatagatagcatttattgaccaattaatatgtgccaggtattgttctgtgggcttttatgtttttttctcattggagctttgcaattaataagcagtgagttacttcttttattggcccagagggctgaaaataatttgcagcttaataaagtagctactttgcttctatagtgattggtttgccacctgttttaagtgtgggccatggcttctctaataaaccctattctttatcttgctcttaaacattttgttttgatagccatgaaaccctcctcagggtaggtgatttatttccatttgccaaatgtgaagagtgagagaatgaccttgataaagggttgggttgagaattgttcctgtttttttcctggtggggctttacgggtgatggagcacttagaatactagagaattagagaatttaggggcataaaatagaatccatactggattttattagagcttagccactcaaccacaataaaagtaggcaagaggtcagctgagatactgattgacttcatatgcccttggaacagacaggcagtgtctgaggggacctgagttcccagccacccagcctcaagctgcgttattacttaactgctttgtagagtgtaaacattatcattttctgtcagtgccagaatgtgagttaggcttgggaagcataatttcactcagaaatggaaagaagaagaaatgttattttgttacttttatttttaaactagttctctctcctattgtttaattgatgatgagatatataaatattcatattggatttaaaacttgaaatttgtactgggtagtttattgttagtgatgtcaaaagttatagcataaaagttacttgcataaaagtgtaaacatttcctgagcaatgcaatatgtggccaccagtcagttgtgttagttgacaaagggcaaacatgacctgttttctgagagtgctgttcacctgggttcttttcattttcagtactccttttggagaagtttggtttactagtagtttcaggtaatctttggagctctgatataaaaattctttcagatagtttaggtaagacttatacattaagtgatttatatggcaagttggcccaaagtcgtatacataggccacctttattcatcacacagttttccttaatcctcatctctgccagccttgaccacagaacttacttttctttttctttttctttttgcacatacattttaaagtgagtgatagcccttcatttttttttttttaatatacagtgggacctcgtttagggagggatggaatttagggtctcactttagtgcaaaaggtaataatctcagagacaaggctgttcttgagagggagcgggagtgctttgggaaagtaccacattggatcccagtataacatttctaaataagtccatgatagctatgctatttttctttagcagttttgttggaactgttgctgtttctttagttaagcactcagaatacatttatgtatcttttaacattggtatcatctttagcacacatgagatcctggaaacatatgagaccttggcatacattgactgagtaaacagcagattcaccttttccatctcacagtcactctagggcttacactttttcaggggaattgtggacttaattgtctgcattatttagttattctatttctggttgcagagtttatagttgaattaatacaagtgaatcatagttaaattcacataaatatgaagtttctattaactgatgacttgggttgtttgtgcattgtccttatgttttatttatatatgccatcagaatcttcagattctcatttctttgaatttaaaaacgctactattttcattaagaaagtctcctgtctgtttccattttctactgattttagcatcagaggctgttaggggagataaaagattcttaaatatatattctatatttgttagataaatgtatttttgtaaaaattttgtagataaacagacatcctgtgtattctggtaagaaaaagagaggatagtatagatgattgctgctaatttttaaattgacaaagtgaggaatgtgactatattggtttaatgagtgcctaatttgaagaattctaacatagttgttttttcccctccatatgtgttgattgtgattctattgctttcagccaaattattttaattagatttagattcaggaatgactgcctcccacagtttctactcttgtaggctttacttacactgctttaaacaataggggtttacctttatattaggagcattaattatctattaattttcctcatttagaaccattaaatttaatatatcacatttattaatataagagaaaattatagaagtcaattatcttaacaaattgaggtcctacaatttttgagaagtgttaagtttattatatttaaaaaagtctagctgaggattactatttgtggtttcttttttcttcatgttaataataatgtagagagtgcttagactttgttactaaatagctgtgtgccctgagaccaaaacatttcacctccctggccttcctgcatttatgtacaaaataaagggttaagctgtcctactatccagttccaaaataactctgtattatatttttgacaaataatagagaataaggtgaaggaccagtggtggcactggtatgtagtaaaaacagtacagggtttgttatcacactgtcttgacacttaggaagttgctagaggatgtcaagcagattacttaactgattgaggctcaaattctgatctgaaaattggaacaatagtaggtgcctcacaaggtttttctggaaattaaatatgacagcaaatataaaagcatctattacagtacagtttcattcattgatatcttcatttccttgaagaggtctttccagattggggctggagaattaaaatgctcaggttcttacaacaccattatttgagctggaaaatatgccctttaagcaacattttcgttctacttcatatctatagaaagttgggggcctgaaggccttttgaattttgaatactttccatctcttttagtctaggtggtatcactttggccagtacaactcttagaatttttgtaggcattctttaatctaattccataaccccctcaagttagaagaagttctttataattcttttagagacattaacaaagggttttgtagttactcttctgctttgatctgtcccagactatattgtatttggagactattttgccagcttatacactggagatgagaagagttgtattttccaaccctgcacagtccttgccccctttattttttctaaattctccttgtaactgatcagttgtttgtttagctcatctctttgttgccatattgccttatggtgtacagttaggaacaaccagttgattttcagttttctgcctagagatctcaggcaaatccaaatgtttattaagtaaatatttcatcctctgagttttatagggaacacaattttgccgattttttgttgctacatatcagaagttcctattttttcagccaccaataacaattttttaatgaatttctagtttttcctaatagattgctcactgtttttcaagctgaaggccactgtttaactccaaaaccaatactacatattttatttttatttttttaaattgtggcaggaccttacctttggtaacatcagttagctattgctaataacataccatttcaaaatgtagtggtttaaaacaataaccatttattattgttcacaagtctgtaggtgggcaaggcagttggctggctgggcttggctgatccaaggctgacttgctcatgtttcagcagtttgccgggtctagtttgggatgattttaatcagtgggatgagtggactttatgtcggttatcatttagcaggttaccctgggctgttcacttggttcagagacagcagaaaagatgtaggataggtctttggagatctggtacagaacaggcacaccgttattttcatcatattctgttggccaaaggaatttgaaagaataggccagatttaaggaatagggaagtagattctaattgttgatggaacatgctgcaaagtcacacttcaaaggttatgtttatagtgagaggtgaagaattggagtcatttttgcaatttaccaaaatatatgtgtttaattttaaagtagttgtacagtttatactcccaccagcagtgtatataagttgtgattgttctacatcatgtccagaactgctagtaacagtctttttagttttagctattttggtgggtgtctagtggtattttattgtggttttaatagtctcaattgctaagatggctttcctttactttttttttttttttagtcaaccatttgaatatctacttttgtgaaagggaaggggaggtgtgcctccaaagtctgtgttaccttttgggctgccatttcttctagatcctggcctgtaaatcatgacttgttaactctccaaggccttcaagcagatgcctgcctgcctgcagattccttcctccctccctcccttcccctccctcccttcccctccctccctcctctccctccgtctcccctctctccgtctcccctctctccgtctcccctctctccgtctcccctctctccgtctcccctctctccgtctcccctctctccgtctcccctctctccgtctcccctctcctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcctctctccccctcccccccctttctccctcaggctgaagtgcaatggcgtgatcatagctaacggcagccttgatctcttaggttcaagcgatcctctggcttaagcctctcaaagtgctgggattataggaatgggccgccatgcttggacagcaaaacttttaaaattttcattttaaattatgttttcttaagtgtttttacttaatccttagtgtgaaagtctcctattactgaaagactaattcattcctgtctttgtagttttgactttcattaatctaatggatttgaggatccacatctaaaactttaagaattaatgtacattatgtaatgtcatttgccttgcaaacagttgtttttttttttccccccctgaggtcagactaatttattgacagttttgttgtgcttgacaagtaacaggtgctaacatctttttcagtcttgtcacagggactagagggtctaggtcaccatgttcattaatgtagtccaggaaattttatttctcctgtggctaatcatttacatttgacatgaatctgtcatctgtgcctctagtctctctgcttccacctttgtcttctatagtgtgttgttctcataatagtcatacttttaaaatataattcagattatttctttgctctgtatattttacaggctttccttataactcaaagtgaaacccaaaggcctgtaagaacccacatgatctaaactcatgctgcctatttgatttcacctcttaccttgtttcccagcccctccactctgttatgaccatagaagttgccttgtttttcctgacactccaaaatgctcttgcctcatggcatttgcacttttcatttcctcctctagaatgcttcttccctagatatacacatggattgctgtttcccttctgttaggtctctactcaagtatcattggagagaggcctttcctgaacatacattgcaaatacttgcagtgtccctcctgtcactctttatccaagttctgagctaggtgctgagcagataaaaaggatattaaggttcctgctctggacaaagtcagtgatgtgagagaaaaaggcttgtatgcagtgcagttaattgggaaatgtgttaagcccctaaagtggtgccccaaacactagatgcttgtacatgataatgaactgtggaggtttattccaagtacaggctgagtgcagagatgcatggggttgatattgtctagatccatagagaagactccacagaggaaaacatctttgaattaggccttaaaaagtaagtgaaaaaaggaatgcatggtctgggtaaaaggaagagtatacacaatgactaaatttattaagattgaaacttaaatgtattgcctggaaaaatgcttaattctcctccctagtggcttaaaaaaatagttagaaaacatgtcatttacaatatgaatagattgttccaataacattgtattatgacttttcaggatggaatagttatggaccaggaattggaggcagtaaattacctaatgtgatgttgatatgcgagacacttataaatggtagtgaattatagaggtccatttcaagtgcagtgggatagcaaacaagaggttgttttctgcccatttgcctcctttactagacccttgaacctattttctgcctaaagagtaaatgaaactagaaatagagatatgggagagactgtaatgagtatttagatatacgtgttacagaattgttacaacttttgctgcaggttactgttttgaggacaaactatgagtttttaaaaaatataaatttactctgaaaatttagctcaaattcatttgttaatgaatttgttcctgcatttggcaatgagctaaatccattgtattctgaccttctcatagtaacttagcatcctaatatcaggtgctgtattaaaatgtgaagaagacaagatgctctttttaattaaatgtgattgataaagctagaaagacaggaatgcaactgaagttggatgagtctcttaggtacaaggtaatagatttatactctttaacagctggtttgattgcatcagatctaaagattttatttgaagaaaaagcctaaggaagaactgctatctgtgaaagtacaaagtaatgcctgtattgaaaatgaacaatctgctgatactagaaacttctttatttttaaagcctgtataattttcttggtcatcagaaccttggcatataaaaatttcagaaatctcatggctttaattaaggcaacatgcattctctgtaatgaaagtaggaagaggatgtaggagaatgtttcaggttctgttttctgcctctctgttacgggaagcagtgtgattcagtacaattgttctcccttgccagttggtgaacctgtgctattctgtgttgaaaatattggtatgaggcttttttccccagaaggcttttttcttaatttcaggtatttttttcatgttaatatcatttttaaaaaaataatactgatggtaaatagtagggctttgaaaaaatatctcatttcttgggaaataaaatatttatgggcccatgaagcctgccggttggttggtttgtttttggtatatgtgtatgtgcatgtgtatctgtgtatcgtactgatctgtgaaatctaaatgtctgaaaactactgattatgtagaaggatcatgggctttggattcagcaaacctggtttaaattctttctctgctttgttcttatcttcgtcatctttaaaatggggatgtgaatgcttatctcctagggtggttgtgagaattgactaagataatggatatataatggtttagtgccggctgtataatagaagctgaataaatgtatttcttcctttttcttataagttgttggggatagagagaatttcaggtgaagttacaagtgcagttgacccttgaacaataccgggtctaggggtaccagcccctgtgcagtgacaaatcagcatatgacttttgactccccgagacctttattactagttgcctactgttacccagaagccttaccaataacagtcaacacatattttatatattatatgcattatgtactatattttagcaatagagtaagttagagaaaagaaaatgttattaagaaaatcataaggaagagaaaatatattatttcttcataaagtgaaagtagaagcagatcttcataaagatcttcatcctcatcatcttcatgttgaataggaggaagaagagaaagggttgctcttgccatctcaggggtggcagagggagaatagacggaggaggtggaaggagaggcaggtgcacttcatataacttttatggaaaaaataaactcacgtataaatggacccctgcagtgcacacctatgttctgtgggcttttaaatcatcttctgaaaatatgctgctagttacagcatggtcttttttaaaatgagaaaccagaagtttttctccctcatgttaatgatggtccaattttcatcccatttaaattggttattttcgccactttttgactgattgtaatatatgttgacctcatttgattttaaagtacaagaaaatatgaaaattataagcatgccccttaagtagattcattgacctatttaaatttgtgaaatcttttttgctataaatagataagtacaataatttatagatagctttatgagtgtgggtattttgtttccagttatacagaagttgcataatagctacccactcaggtattttggattggcatggtaatgactgtttaataagactgcagtacaagaaaatatgaaaattacaagcatgcaccttaagtagtttcattgacctatttaaatttatgaaatcttttttgctataaacagatgagtacaataatttatagatagctttgtgagtgtgggtattttgtttccagttacacagaagttgcataatagctgcccactcaggtattttagattggcatggcagtgactgtttaataagactgctactacatagtagcacatatagataagtgatatatctatatatgtacataaatagattttctctttttatcatttatcattctctataactgagcttaccaatttagaaataatttggttgaaaacgttaaattgtagaaaacactataattagcaacaaaggtgtgtacttttctatccagagggacagtttgtatactgtttggtcaattttgtgagattaagttgagaaacctaagtgttttagagacatagtggtaaatgtctccatcagtgttgggttatcgcacagaacaccttctagggtctacttcagagtagtagttttggaactattttagatacaacacctttttaaaaaattatcagatattcagagccctaatatgtatctgacaaaaatggagcaactcttgttgggtgaatgggagtgaaggagccaggcattgttaagaatttgtcctgcttatactcctctctcagtttctagaaacctctctgccacctgtggggctccttaccacttctttagaggttcagataagaagagtcttgacttaaagactaagctaaaggaaatactaattattttaccagagtgagtaatttttagataattcagcattagatatatacaaataacttttaatatcaaaagatagaatgtatttcttagtgtctagtagctggatcttagatttttaaaagcatctttgtaattaaaaaaagtattggcgttttcttcttgaaaatgtcttataatttaaaaaaagataaaccagggccaggcatggtagctcactcctgtacttccagcactttgggaggccgaggcaggtggatcacccgaggtcaggagttggagactagcctggccaacatggtgaaaccccacctctacttaaaaaaaaaaaaaaaaaaaagccaggcttggtggcggatgcctgtaatcccagctactcaggaggctgaggcagggaatcacttgcacccgggaagtagaggtttcggtgagccaagattgcaccatcgcgctccagcctgggcaacaatagcaacactctgtctccaaaaaaataaaaataaaataaaataaaccaaaaactcaacacaaggaaactatcttgatgattttgtgaatagtttatagtatatagggttaattttatggtatggcattattgaattagtcagagattattcttttattataaagcactaagttatgtcttcttaaaccactttttgtttagaatactttctatgcttttgagtaaagatgaaattatatgtcttttttaattttttaaattgaatgatgttcaagggaaaagctacccagtttccatttgtgtgaaatttatgtatatttttggttttgtcttgtatatgagtaaataaacgtagtttctaccctttttctaccctttcccattgaagttacaggtttatctacaaaggggtgatggaaatactttgtgtaactattttccttagtcaatataacactctgaggccaggcctggtggctcacgtctgtaatcccagcattttgggaagctaaggagggcggatcacctgacgtcaggagttctggactagctctgcaaacatggtaaaaccctgcctctactaagaatacaaaagaaaattagctgggtatggtggcgcacgcctataatcccagctacccaggaggctgaggcaggagaactgcttgaacccaggaggaggagtttgcagtgagccgagattgggccactgcactccagcctgggcaacacagtgaaactcggtctcaaaaaaaataaaaataaaataaaaaaccactctggattaatttctattttgtatttctggttaatttttcccctacctccaaataagtgggggtaattgacagttgttcacacaaaggttaggtaattctataattaatttttcattggtttagagaagtcttctcagtgagcatgcctttgttgtcaaatgttcatgccattactgctaatgaaataaaaatgttaagcaagaacagtaactgtctattttagtaactgtctattttcagttactttttaaaaccctaattataaaagccaacttgtagtttacaaatgaccacatgtatctttatttcaaggaaattctggattacttcatgtatttactcataataatatctgaaatagtaaaaagagtgtggatctgggtatcaccacttaactaagagttagttgcaaaattttgggggaaaaatttataatgttcttaggggggttgtgttgcacagctcaaatatgatattttatgtactgccacttaataagctataatgtgcccttggcaaggaggatgaagaggaggtatagcctgagccctggaatttgtctgaagtccttgcagactaaagtacccatgaagacttggatttacacagaatgaatcatggccaagacatgaaaagtcagtgataaagtcagtattgatctcagtctgtagcttacagcttttctaattttttaaacttatttaagtaaagtgtatatccctctcaagtttctgacatatccttatgctgttgaggcctgaagagaatctctgagactaagatgagaattgtcattgagcaatgaaaaggaattaaaatgagaaaagtctgaattatctggttccattgatgagggagtgcctatggtgaaaagcatacctcaggctatttaaaatatccccttaatcgagttctcctggctttcatgctttgcttgaaacacagctctgataatgcatatttttggtaattgtatttaaggagtatttttggtaattgtaatttcttattacaaattaatagccactcacatacatcttatgtacttggtgtattagtctgctagggctgccaaaacaaaatatcacagggtgggtagtttgaaaaacagacatttatttctcacagttctggaagaaagtttaaaatcaaggtcttggcaaatttggtttctggtgagggctgtctttctagcttgtagatgcctgtctgccttgtcttcacatgatctttcctaagggtgtgtgtgtgtgtgggtgtatctgtgtgtgtgtttgtgcgcacacacacgcgtgtgcacagggctggtagagagtgagctctctggtgtctcttattgtttctttttcttttttcttaccttgttattttctaatctagtcttcagagagatggtgtctcttcttataaaggcactcatcctaacagatcagtgctgtacccttgtgacctaatttaaccttaaatacttccttagaggccccatctccaaatgcaactacactgctgtttagggctataacatgaattttggggtatacaagaattcagttaataatacttgattaccctttatctgcccctgagagggtggttcatcttacccttttttagtcaaatcacatttggtaacatgaattgaggtgggtcagctatggtggcagactcactaagagtgtcatcctcaactatcctgtattgcttgtggcatacctagacattctatggccgaaagagcttgcatgtttaaatatttctatagttttagtccttggcacatggacttgagtccatttctctgtcaaatggcgatagttgttcctcagagttgttactggtcataatttaagggaaaatatattttgaaccataagatgcaaagattgttttttataaaaatgtacaatgttcctttttctattatttgtagagcttaaggacttgaatccagatcttctaattacaagtataagactctaagtagccagacatacccatttttttcaggataattggaattctccatagacaagcactctaggggaagttctggcaagttttatttgcaccatgtaatgcattgaaataaattgtaccatctaataaattgaaatgctgtgcgtttagccctcaagctctgttaagggacagactgcctcctcaagtgggtccccggcccccgtgcctcctgatggggtgacacctcccagcaggggttgacaggcatctcatacaggagagctccagctgacatctggcgggtgctcctctgagacgaaacttccagaggaaggaacaggcagcaatctttgctgttttgcagcctcctctggtgatacccaggcaaacagggtctggagtggacctccagcaaactccagcagacttgcagcagaggggcctgactgttagaaagaaaactaacaaacagagaaaggaatagaatcaacatcaacaaaacggacatccacacaaaaaccccatccgaaggtcaccaacatcaaagaccaaaggtagataaatccatgaagatgaggaaaaaaaccaatgcagaaaggctgaaaattccctaaaccagaatgcccattctcctccaaaggatcacagttcctcaccagcaagggaacataactggttggagaatgagtttgacgaattgacagaagtgggcttcagaaaatgggttataacaaacttctccgagctaaaggagcatgttctaatccaatgcagggaagctaagaaccttgaaaaaaggttgcaggaattgctaattaaaataaccagtttagagaagaacataaatgagctgatggagctgaaaaacacagcacaagaacttcatgcagcctacacaagtgtcaatagctgaatcaagcagaagtaaggatatcagattgaatatcaacttaatgaagtaaagcatgaaggcaagaatagagaaaaaagaatgaaaaggaatgaacaaagcctccaggaaatatgggactatgtgaaaagaccaaacctgtgtttgattggtgtacctgaaagtgatggggagaatggaaccaagttggaaaacactcttcaggatgttatccagaaggacttccccaacctagcaagacaggacaacattcaaattcaggaaatacagagaacaccacaaagatactcctcgagaagagcaaccccaagacacataatcatcagattcaccaaggtggacatgacggaaaaaatgttaagggcagccagagagacaggtcagggaagcccatcagactaacagcggatctctcggcagaaaccctacaagccagaagagagtgggggccaatattcaacactcttaaagaaaagaattttcaacccagaatttcctatccaacctagctaaattccataagtgaaggagaaataaaatcctttacagacaaccagatactaagggattttgttaccaccagggctgccttacaagagctcctgaaggaaacactaaatatggaaaggaaaaactggtaccagccactgcaaaaacatacaaaattgtaaagaccatcgacactatgaagaaactgcatcaactaacaggcaaaataaccagctactgtcataataacaggatcaaattcacatgaaacaataattaaacttaaatgtaaatggactaaatgccccaattaaaagacacacactggtaaattggatagagtcaagacccattggtgtgctgtattcaggagacccatctcgtgtgcaaagacacacataggctcaaaacaaatggatggaggaatatttacaaagaaaatggaaagcaaaaaaaaaaaaaaaagggattgcagtcctagtgtcagataaaacagactttaaagcaacaaagatcaaaaaagacaaagaagggcattacataatgataaagggatcagtgcaacaagaagagctaactttcttaaatatatatgcacgcaatacaggagcacccagattcataaagcaagttcttagagacctatgaagagacttagactcacacacaataatagtgggagactttaacaccacactttcgatattagatcaatgggacaaaaaattaataaggatacttaggacttgaactcagcgctggaccaagcagacctaatagacatctacagaactctccaccccaatcaacagagtatatattcttctcagcactgcatcccgcacttattctaaaattgaccacataattggaagtaaaacagtcctcagcaaatgcaaaagaatggaaatcataacagactctcagaccacagtgcaatcaaattagaactcaagattaagaaactcactcaaaaccacacaaatacatggaaactgaacaacctgctgctgaatgactactgggtaaataacgaaatgaaggcagaaataaaaagttctttgaaaccaatgagaacaaagacacaatgtaccagaatctctgggacacagctaaagcagtgtgtagagggaaatttatagcactaactgcccacaggagaaagcgggaaagatctaaaattgacaccttaccatcacagttaaaagaaccagagaagcaggagcaaacaaattcaaaagctagcagaagacaagaaataactaagatcagagtagaacgaaaggagatagagacatgaaaaaccaattcaaaaaataaattcattcaaaaaaaaatcaatgaatccaggagctgtttttctgaaaagaattaacaaaatagacctctagccacactaataaagaagaaaagagagaagaattaaatagacacaataaaaaatgataaaggggatatcaccactgatcccacagaaatacaaactaccatcagagaatactataaacacctctatacaaataaactagaaaatctggaagaaatggatacattcctgtacacatacacctcccaagactaaaccaggaataagatgaatctctgaatagaccaataacaagttctgaaattgagtcaataattaatgggctaccaaccaaaaaaaagcccaggaccacacagattcatagctgaattctaccagagatacaaagaggagtttccttcggaaactattctgaacaatagaaaaagagggactcctccctaattcatttaagaggccagcattatcctgataccaaaacctggcagagacacaacaaaaaaagaaaatgtcaggccaacatccctgatgaacattgatgtgaaaatcccaataaaatactggcaaactgaatccagcagcatatcaaatagcttatccaccatgatcaagtcagcttcatccctgggatgcaaggctggttcaacatatgcaaatgaataaacgtgatccattgcgtaaacagaaccaatgacaaaaaccacattattatctcaatagatgtagaaaaggccttcgataaaattcagcacctcttcatgctaaaaacactcaataaactaggtactgatgggacgtatctcaaaataataagagctatttatgacatacccacagccaatatcatactgaatgggcaaaagctggaagtattttctttgaaaaccggcagaagacagcgatgccctctctcaccacccctattcatcatagtatgggaagccctggccagggcaatcagggaagagaaaaaaataaagggtattcaaataggaagagaggaagtaaaattgtctctttttgcagatgacatgattgtatatttagaaaccacattgtctcagcccaaaatctccttaagctgataagcaacttcagcaaagtctcaggatacaaaatcagtgtgcacaaatcacaagcattcctatacaccaataatagacaaactgagagccaaatcatgagcaaactcccattcacaattgctacagagagaacaaaatatctagaaatacaacttacaagggatgtgaaagacctcttcaaggggaactgcaaacaacttctcaaggaaatgagaggacagaaacaaatgaaaaacattctatgctcatgcataggaagaatcaatatcgtgaaaatgaaaatactgcccaaagtaatttgtagattcagtgccatccccatcaagctaccattgaacttcttcacagaattagaggaaactactttaaatttcatgtggaaccaaaaaagaacccgtatagccaagacaatcctaagcaaaaagaacaaagctggaggcatcacactacctaacttaaaactatactacaaggctacagtaaccaaaacagcatggtactggtaccaaaacagatatatataccagtggaacagaacagaggcctcagaaataatgccacacatctacaaccatctgatctttgacaaacctgacaaaaacaaggaatggggaaagggtattctatttaataaattatgttaggaaaactggctagccatgtgcagaaaactgaaactggaccccttccttacaccttatataaaaattaactcaagatggattaaagacttaaacataagacctaaaaccataaaaaccctaggaaaaaatcttggcaatgccattcaagacataggcatgggccaagatttcatggctaaaacaccaaaagcaatggcaacaaaggccaaaattgacaaatgggatctaattaaactaaagagcttctgcacagcaaaagaaactatcatcagagtgaaaagactagctacagaatgagaaaaattttgcaatctgtccatctgagaaaggtctaatatccagaatctacaaataacttaaataaatttacatgaagaaaactgcatcaaaaaatgggcaaaggataggaacagacacttcttaaaagaagacatttatgcagccagcagacatacgaaaaaaagctcatcatcagtggtcattagagaaatgcaaatcaacatcacaatgagataccatctcacgccagttggaatggcgatcattaaaaagtcaggaaacaccagatgctggagagggtgtggagaaatagaaatgcttttacactgttggtgggagtgtaaattagttcaaccattgtggaagacagtgtggcgattcctcagggatctagaaccagaaataccatttgatacagcaatccccttactgggtatatacccagatgattataaatcattctactataaagacacatgcacgtgtatgtttattgcagcacaatttacaatagcaaagacttggaaccaacccaaatgcccatcaatgatatactggataaagaaaatgtggcacatatacaccatggaatactattcagccataaaaaagggtgagtttatgtcctttgcagcatcatggatgaagctggaaaccatcattctgagcaaagtaacacaggaacagaaaaccaaagactgcatgctctcactcataagggggagttgaacagtgagaacacatggacacagggaggggaacatcacacactggggcctgtcacgggtgtggggctaggggagggataacattaggagaaatacctaatgtagatgacgggttgatggtgcaacaaaccaccatggcacgtgtatacctatgtaacaaatctgcatgttctgcacatgtatcctagaacttaaattataataaaaaaatctgtccgttgttttgtgaattatcatatttaaactcagtttctggtggttgatgtccaaaataagattttgcttagtggtatgtccagagcttacagaagaataaccaaaggctggaaaaatatatctttcagcccagcaactttattatagtacatatggtaaactgtgtagaatgttaaggaaacatcccatattggcttaccagctgctatttttatggcaagattttatttaatatgtaaggctggagggaggtgtgagaggaaagtaaagaaaagctttggattattaaaggtgtgggaaagctatttacactgcttcagggataaataggagggaaggagtactcagacagagggagcgagtgattatatgaagaaaaatactatgatgatactaattgtgttttgtaggaatatggatgctgcctctttgtctctaaatgtgctaccctgaattacaagttacctttggctttttgattctacaaaatcataggagctccctgaaatctggagcatttgctcagactattgctttctgttatctaccctaggtcggaaatatttaagtgttttttcttcagtcctacagagttttagtctgatactttagaaaacagaactgagttcctattcgaaaagatttactcacagtgttttgtgttataaagtcatactccagggtatcttttagagcaacagccctgaaccaggctaagaggcatggagaagagcagcacagggcttctgaatcctggctgtgcatagatgtgggttaaaattaaaatattactaacctttcctcatctgagatagtaagattttggagcttgaattcttcatgctttttaattacaaaaaatacgatgaaatttcagtgttcttgcaaaaatttgactaatacaagaattgacaatatgagaggatgtctttaataattttatgtaacacaatcagatctttaacttttgctcatgtaaagtttataaaatttaaactgcttaaaataatggcagtattagaatactgagattcataataatgtaaattaacacatataacccttttttctgtttgtatattatcttttaatatataatgaaaatgtttaggtagtaaatactaaggttaaggtaaagtcatataatcttaattcatctaacagctgcctgttgtttcatatttattccatttttgaagtagtttacaaatgaaaaaaattgtatgaatgccttggcattaaacagcagttcttggaaatcaggaaattcctaagttatacttcctctagcagtgatatatcagcgttatttctatgagtttagttatattcaattttccagttatatatacacctttaaagtgttatataagccaatttaagcaagttagtattagagtagaagtgtaaactttggaatttcctgatttttaacattttactttctatgttattttggtgaactggatcatgcaacttaatttatacagttagtatgaatatacttacaaagagctagattttattttcagccatcacattatgaatagctttttttaaaaaagactatttcatcctctataatgaagtacttagtgtttgccattcacttttggtagcttttaatttttacctcttcagctatgatctgaagtcattccaaaagttatggtctgttctatgtcttcagtagagagttatagtttcataaattatccacctgctctagatgcgttgtagagatacaaatagaattgcacatactaactgcagaagccaaagcattgggtatcaccttccttgttaatccattttttttccaactgtttttgggtttttgttttgttttgttttgtttttgtttttttttttttggaacaaggacagtcataatatagtaatatgaattcattccttaattctttattcaacaaacatctattgaaaatatgccatgtgccatatacttccaggtattgaagatacagcagtaaccaaagcaaagtccttctctcttagagcattcattctaataagtggaaaaagaacatagattgaataagtgtatactctatcaggttgtgattaacactatgaagaaaaattaagtaggatatggagatggagagcaataacggtactattttagggaaggcttttcttcctgataatacctaactggatacctgaaaaagatgtgcatgtcttaaggaaaaacaatccagtaagtaagaacaccaattgcaaaggccctgagatggaagtgtgcttgctaaattcccagaaggaggccagtgtggcaggagtagagtatgtgggaagagaggttcagatgataaggtgagagtaataatgggtatgggaggacatggaattctgtattgccttataggacttggtaaagactttgaattttcctcaaaatggaggatgttgagcagaaacatacatgttctgaattatagtctacaaggatcactatagctactgcacagaaaacagattgcaagggagcaatgatataactgatggataatcaattagtagaataaccattcagtcacgagatggtagtggtttagaccagaatgatgatggtggaggtagtgaaaggggaattccaaaatactttgaagggaatatggtaggatttgttggttagatacaaagtgtgagataaagtgagtcattaaagataaccccaaaatttacctggataacttgtgtctctcttacttgcctatagttgtctttacagaaatcctttcctaaccatgttggatcttctctaggtagtagccactcttactcaatttttaatcaaagctaacagttgtccttgaagtctattaatgtgtcctattttaacttctctataaagaaatggtcagtttctaaatgtttaccaaagtttgaaactcctttaagcaatttaaaacataagattaacttttcgtttttttaaataattgtaccttatggcagatataatatagcttgctgactaagagatgtggagaaccagtttgctggggaacagagctctttgtgatctttcataactatttcctttacttcctgaatgtctttctaaatgccacattcagagtggacttttctcaccaccacatttaaaacactcccgcattactttctatctccttaccttgttttatttgtctcagttgtatttaatatatgatatatatatttgttttttatttttgtgtctgtatcacctcactaaaatacaaatttcttaagggcagtggctttaaaaaaaaattgctgcagctcagtgggctaggtagttagtaacttactataaatgaattgaatgaatagatggttttaagtagatgtccttatgtcacataatgggtgtttattaaatggcagcatgaaaagaataatgggtatccttgtacattaccggtggcaatgaatgtaaaattgtatagccactctggaaaacaatatggcagttcataaaaaattatacatagaattaccatatgacctagcattgctacttctgagtgtatattcaaaagaatagcaaggactcagatatttatccacccatgtttgtagcagcagaattcacaatagccaaaaggtggaggcaacccaagtatttatttggcagatgcatggataagcaaaatatggtatatatatgcaacgggatattattcggtcataaaaaggaatgaaattctgccatacgttgcaacatggatgaaacttgaagacattcagctaagtaaaataagccagtcacaaaaggacaaatgtggtatgattttattttatgaggtacatagagcggtcaaattcatagagacagaaagtagaatggtagttgctagaggccagggggaatgaggagtagggagttattgtttaatgggtacagagcttcagttaaagaagatgaaaaagtctggagatggatggtggtgatggttgcacaacaatatgaatgtacttgttgccacagaactgtactcaaaatggttaatttggcaaattttatgttatgtatattttaccacaatttagaaaaaaaaatgttctgagcttgaatgtcacattcaccttgttggctttttggacttattcactgtttgtttatttgttgagatagattgtctttgtctcccaggctggagtgcagtggcacgatcttggttctctgcaacctccacctacaagattcaagcaattctcatgcctcagcctcctgagtagctgagattacaggcatgtgccaccacgcctagctgattgtttttctatttttagtagagacagcgtttgccaggctgactaggctggactggaattcctggcatcaagtgatccactctcgtcggcctcccaaagtgttgggattacaggtgtgagccaccgtgctcagcctggacttattcactgttctgctttaggcttttacaaatagaatctaaaacatttaacctaacatctgagatgtgggtttaccactgttattccaagtcctttaattttgtatgtcttcattttaaagtccctaagttcatgttattaatggttattttcctatatgttttactttctcatgtatataaaattcatattttaaagtcttaaattctgttttctgatgttgagggtcctataaggttgtactcttaatgggtggcttactttcattttctcatttaattattatttttaaaaaatttcctagttattgattctcatgttatttcttatgattgttgtcagtatctccctaaatctaataaggagacagaaaccacaaagtaattttaaacaggggaagtttaatataaagaattagaaagctatgatacgtgagtaactataaaagtgtaaagagaactgtaacaaacatactaggcctgaaggaggagagtatttaaggaaaagaacaacttggaagagggtccttccccaaagttagagttcagaccttgttagagaaggtacaatctgctaaggccagagttggtctgtagttgctgggcaagcaggaaacaatcttttgggggtgcagtcaagctgaggctcctggatgggcttgcaaaggtagtcacagtgccactgataggtagcatgttctagatcacgtactattgtgttggaagagcctcagagtggtgattaagacagggatccagtggacaaagtgtcttaatggagatgggaaacttgggaggggttgattgtattgggtggaccagaaataagctgggacatttggaatgggttttgagaaaggaaagaaagagacagctttctctctcatcttcatatgtttaaaatacatgtaaatgtaaatgctctttgcattaatatcttttcatcttcattgcttcaactgaagcttttattatctccatcctaagggactgcattattctcctaatttatcttcctgccttcagaatcttcctcttccaacctagtgtcatttttctaaaacaaagttctgatatgatactttcctgcttaaaatgtctaagtgaccccccccaccccactgcagaataatgtgactttgtaggatcagatctctgcctactctgttagtttcttttcatcccactttcccatagtcatcctaggaactttctgtattcaatttttcaaagattttcaagcatcattttcttctcctttgcatattttgtcccttctcttctcccttacctttgcgtctggaaaaatctatcaatcctttaaaacttatatgctaccttgtttgcccaaacctttctcagtactaagtggccatttcactttgaacatgctttcatttgtatatgtatctctcatcccacttcatactgagttttgtttccttattcatatttttccttttggaatttacacagcacatagtgggtgcttaataaacgtttattatctgaacaaataaacctgcatacttggctttaatattcttttactcagataatatgagcatgtaccttaacttaaaaagatagggttcagaatggtacacactatacttgagagttatttgggctcttttgtgttttctgcctgtaaaagaaataaatacttcattttcctaatgtttaggtatttagctgtatgatagataaagcaagttagagataaggaaagtaaggtgaaaatgagccaactgcttaaatgaatgatggagttgagatagaaaccacttcattttggattgtcttcttttattctcattagtattataagattgcttagataagtatttatttattgagcctctactatgtaacaaacattgtgttagacctgtgattctaggttctttcccacttcttaagattctgcgattaattagtaagattaaagccttaaacaaaacttactttataaaattgttctaaagtatatgattacattacatatttggagttattataaagttactatcaaattaacggataataaagtacaataaaatccctgaaggcaccaaaaatgtatcttgggtatgcaaatgtaaatgtgtaaatatttataattttaaaaatgtgtgcataactataataacggggatgatgccccctatttgagttcctgtccctaaaaacattcactattctaattcctaagaagcacttaatattatagcatcaggagatatatcatctcaggccaagtttactttctagcctagatgggccttttgcagttagttgactctgcttttcttagcagcattaaggaaagttggtttataataaggttttagcacaaaagttaatgccctgatttattctcagaagtggttagctgtagttgatgcagatggccactagaatgtattcatataaacatcttccattccaaaatgttaagaaaatataacattgtataccttaattattcaattacattagatacatgttatttaataatatacctgaaccagaggcttagggatttcagacgctctgtgttaaaggaatacaaaataagcttgttttaaaatgtaatacatcatgcttctgtccccatgtttacctatgtaattttatgattccataggtaaaatagctgaaagagaaccattatgttatcaaacactgtgtcatgcttgctgagtttgcaaaaatgtaaaacgtacaatgtgtaacttttatcttcaggaagtttataacctaataaataagattcaatacacataaaacctttaatgtacgattaagtgataaagtattaagactataagtgttgtgggagttaaataattttaaaacagattttaggaataatctaatatctcattttattgacgaggaaacaaaagtctggactagctgtttaactcaaaaatctgcccagagttacactactggataatgtcagaaccagactaagaacgcaggtttcctgactttggcctggtactctttccattcgtaaatacccacgagcctgtgtggaatgggcttgattcaaagcatgtagaagaaatgagacattgaaggttatgggtaggtggtggggagaagagctgttccacaatggaaggaacaagaaggaagcttaaaagacctggcacagagcataaggaatggcctaatgagagtagaaggtatacaataggaattaatttcagttagtaacctgggcctggattgaagcagtccttgcaaaccaggtagtttttatgggataggcaccagaatgcttttatagatttcttgagcaggatgacttgataaaaattatatcagttttatcaactggaaggtcagtgtgatggtaaccatgaaagattgaagtaatattgaggcaggaaaaggtagtagtagtaggaatgaagtagaaaactcaaatctacaagacatttcttgggggaaaatgattggacgagatggcagttttctatagaaaataaaggtaagaagagtgtagcaagcagaatgctatttccatggacagaaataaaataacttggaaggagggctgggatgaattgaggttttttgttgttactcttgatattaaaaagattattactcagtattaaagcttactgtaaaatataggattttaggtttttgagagctttccatatctttggacagtcaatactgaaatttttgaatttagggttaattgattatatctgttgtatacacttagagacgcttgggttacctctgtacattttcagttatatgtataaaacatttttgaatggaataatacgtacattcaggtttatagaaaccttgatggatatgatttaatacaaattagcaatagtatatctaaatttgtaattgtcactgatccattgcttaggatatattttaaaatatgttcactaaattctgttttcagttaagttattcatttatcttttgtttaggtcctaggccactgaaatggagtacaagagaagtgggtattttttctaatttgatttttttcctgtattagtgttgggataatggatttgtatttcatacataattttaagtgcctcatatttttaataatagttgcctagacaatacaatttattgtgaaattttctattagcagttcattctaaatgtttaagaaattatacgtttttctctttttgtgaccttcaatcttaaaagtttatttgaaaaacgaatttagtgaaaccaaaattaaaaaaaaataaactccctaactaaaaaaatatattcttaaaactatttttataaaatcaatttttttgacttgggatcatttagggggatcgcatatattgtagtatatcagctattgacgacattttaattcttatcattttaatgagttttttgttgtaatttttaggagaaaatgatgaaatgcttatttaaaaagtctttattaggctcatgtctctcatcccagcactttgggaggctgaggcgggcagattgcctgagcttagtagttcgagaccagcctggacaacatggtgaaaccctgtttctacaaaaattacctgggcatgatgacacacacctgtagttccagctacttggtgggctaaggtgggaggatcacttgagcctgggaggttgaagctgcagtgagctgagattgtgccactgtacttcagcctgggcgacagagtgagaccctgtctccaaaaattataaaataaaaaagtctttattattattgctgtactttcattttaattagaaatctgtttctgtagtgtacttctctgttggattacattgagatctctggaagtagtatgtgaatgtatggtcagttgataatatgtgaattctaaatgctgaaatttatgcttttggggtgtttgtttatcagtgttcttattattgaccaagattatgctttatatcttctatcttctgaagttgtgtgaaatagtgatacaatacaaattaaagctgagctggtgttttacatctagtatgaaagaaattagcagaaatcagagcagtttaaacctatctacattattgctactgagttttgagtcatagatttttttaaaaagtatgaaacatggttaatcataaaaatccacataaagaaggaaataataataggaagtctgttttgtcgaattctagaaatatttttagagaactattattttgaaatgtgcaggatgcttctggtccaaggaccatactttgagaatcattgttataaatcatggtggaaccgtttgacctaatcaaaattaaaatgagaaggaaggttttttaatttaagaaagttatctttaacttctggcaacatgatcttgcttatcacagtagtaggatattataaaattggccaacatctcagcatttctttaaacttgctactatattcatttattcagtaaatatttactaaacatctaatatgtgccaggcatatttcgagctggagataaagagtaggatagacatagctcctgcccccatggagtttatattctcttaggggacatatatatgaacaaaaacaggtaaacagacaaattatgtagttgccagttgaaatatgtcatgtgaaggacaagaacaaggagatgattgatactattagcaaactattttaggtgtagtgatctctgaggagatgacattgaaattgagacccacagaagagaaacaactaggtctgttaagaggagggaggcgcattattcaagcagacaattgaatgtatacaggctttgaggcaacaacaacaacaaaaagtttctttactctaagaactgatagtagtttagctctaggctactatttaatattaagattatggatggaaggcagggagggaggtgaaagagaaagaggagagaaattaagaacaataggtttccgatttatgtaaattaattaatggtagtattgtttactgaaatggggaagaggtgtggggggtgggtgtcagtgagctcagctgttttgagagagtttgagcaaaaaaaaagtcagttgaggtgattaaaaattgatacattaaagtgagaaatcaaagaagaaactttgttgctgagacatttagactatttctcagatattaataaaatttagagaacaaaacagtattctagagaaacactaaggttattaattaagaggaaagcaatctatttggggaggtttaagggaatgttgacatatacaaatactaaaaaattagaaagccaagtaaaaagggattaaaattctatctccaagtggaaaaaatcaggttgtccagaaaataataaatacatgattgatatggtttggctgtgtctcctcacccaaaatctcatctttaattgtaatccccataatcctcaagggcaggaccaagtagatgtaattggatcatgggggcagtttcccccatgctgtccttatgatagtgagtctcaagagatctgatggttttttaagcatgtggcatttcccctgcttgcactcactccatcctgccaccctgtgaagaaggtgcctgcttctcctttgccttctgccatgattgtaagtttcctgaggcctctccagcaatgcagaaatgtgagtcagtgaaaccgcttttctttgcaaattacccagtcttcggtatttcttcatagcaatgtgagaacagactaatataatgatcataaagagattgttggtgagagaggccattgactcaccagagaacctagaaataaattaccatgggcatataatatctaacattatattgagttagtcaaaatatgaaatgttaatatttataggggagactaaggatgatgccagaactgaaagaaaaatgtttctagaagacctaaaacctaaagaacttagcagactccttgagaaaaatgtaaatgcctgaagtagttttgaaaatctgggtttagctagctcatgccctagaatttcagtgactacatagactcattaaaatgaaattcaatcttgtttttattttaaacatatttttcaggtatccaagggactgttaggaggacttaaataacccatatccttatgaaagtgaattataggcctccttgaaattaataaaaatcttcaaagtagtatttaatttaaacttgtaactttctttgtgttctgagagagtgctgtttctttatattttaaagaaatagaccatttctgttttgttcaccaatatattcactgcacttagcacactgacacagagtaaccatttaataaatactttctgaatgaatgtataaatataaattttacatttagttttgggttacctggatagctgataattaatgaagcagttcctttgtggcccttaggaaatgtctctactgtgaccatattcaggtatatatggtggcaggctatacgtgaatagaattagtgcttattagaaatgaggtaggatgtttttgagattatatgtttccatgcactgcagagcatactggtgttattttaaacaaaatataaataacttttggattttgtgtggattttaattattttaatcagtcatccgttaagggttaataatccagttaactatgttgttctcaaattccaaatactaaattactgaggtcatgatgctttggggaacaaatactattaatgactagtgaaagaagttttatagatctcacattgtttctggaagaccaatagatgtatttattaccataataacacgtagaaaaaggacagacatttctatgtggttcttagttctgtctctctttttttttttaatccaggatgtcaatccttttgtgttcactccctaattatgtatttacattttctttatttttcttaactatatatctgacctttttttttttttctcaaggtcttgattaaaatcagctttactctacaataagttgaattgatttgggcttctttttctcatgatcctattatttagtgactgttttcttcaaatatttgtttccatgacttttgttacttctttatagacatatttttagtagttgcaatttcacctccaccccgcctttctgggttgataatattggttaacactgactcctagggtacagtctcatcaatgttggtgtagaaataagatataatgaacaccaaacctaaaaaagcagcgtcaacttttactccagcagcagtggagttgttatttaccaaaagaaaacagattcagcagagatctgttagaatgcctatgttatgccctattaatctaaaacagttccatgataattctctagggttgaactgtttttaatggtatgtatgagaaaacgttttatgggcttttagccagaagattttatatataaatggtagtagaggaacattgttaaattcatgaatcttggaggcaatgtaatataatcgattttggggcttttaaatcagctttgaatcctgaccccttcacttattaactttgtgactttaggcaagttacttgactcctctgggccttaacttcctattttgcaaaatgagaataatatgacttcctgacaagaattttgaaagaatagaaggcagttatacaaaatgtgtgataaaagttttggcacatacaggtttcttcccaaagatgaacaagtcctactgctaagtatagaaagggagatataagtacaagttcctcgttatttcttagagctttgcgcccatagatctttatattgtcttaacctatgtgatccacaatgacccaaactacaatgtatgtcttaagaaagcatagaatttttacttttttttcagtttgaacaaaaatggtcagttgtgctctgagtcctaggtgtcttctagatataaatatgtgggaaggacaaaggcaaggggcatttaacagaacctcaggtcctacttctagcagagcagctatacttttctgttttaccatttgtatttctgtgcaagatattgattgaacaaaggggtctgtgtattacaaaaaagcttgaaaaaacaaaagcagggtcaagcagtctatttcttggctttcctttttctccgatgccaccctgctttctccttggcgttttaaagtttgtgggaatgggtgggagttagggtggggaagtagggaggaattccattctgtcttattgcatggagttctctgagaacaaaacatagcaaaaggacaagggtcctatgtaaagagggcatttctggtggaaaaattccttgacctccttagctcttgcgttgaactctatcaacaaagagctatgttttgagccttgattacaaattttaaaactggtaaataacaaatacatcttgcctctgattgcttcctcctctgactacattgagatatctttattagacccttaatattttcattatcttcttatcttagactctaatcactttactctcatttcagtgtctgcaagttcttttcccattagtcttctctgtaccaaccagcaagaactctgaccctggatgaatgttacctgactttactgccatcaagcatttttggagaaaataacacattgggctaatggttacctatgatttcctgaggtctgggttcgaccccttttaatcatctgaggaatttttctttcctccatcttcattatctttctccctgtagactttttactgtcaacgtttaaacatgttcaaataaatccaagcatcgaatgaaggtaacaaattaatcaacttattggttcagctgcaactctgtttctcaccccgcagtcaaactttttaaacaaattgtttattttcattgtctttagcccattccaatacagcttctgctcccataaccccaaactgcttttgtaaatttgtttcatttccgcacttaacagctttcccattaccttctgatagtctcatatccctaacattatatttgcacaattctacctctcctttctagctctaagcacttttttcatttcatgaaatacagttaatattctccttctctgggtttttgcaggttctatcctttaactgggaaacactctctgccttcctcaactcctcccacctaactgttcagttatcagatgtgatcttctgaaggaggtttaccttgacctgaactggctgagttctcctacttcataccttctcttcacagcacttgtcacatttgtaataatgtatttgtcattctccctgtgccttttaatgttggcttctagagattagggatcccactggttataggactggagaggggagctcaagaaatatttgttgaagaaatgactgaataaattaacaactgtagcttttcccagttcagtgcatcagttgtgtccttggccttattggagtttctcttccttagcagcataatgaattttaagtggaggaaaaactattagtgattccactagagttattaagcactgtagcccgtaatgcatcataggcgcacaacatatatacttttccattattgtcctctcctttttgctttaaaaataactagaaatatgtaataatttcaaatactaggaagctgagtattttgtttcttatggcacttttaatcaaatcacattatttattgagtactactcagtgtatatcctaaagtaaaaaataataataaacaaatgaatcaagtttctaaaaatcaaaacaaaaaactttaaaaacagtatgggaatacatgtgttcaaaagagaccccagaaagtgttttcttcctgaatatattagacccttttcagctcctaatgctgtagaataaatgaagtgttatgaaacttataattaggaactatctgaaagccaaatgtttagctaaaatgtgtgataaattaatgaacatacaaatgaatagatagcagtggcagtgtatttgttttgtgaattttatttatatgcaaaataataattgtatatgcatttaaatataattgaatggtatacatatgtatagagattgctaccatatttgatggattggtaaatagtattagaggtaatttctgaagatattttagtgtaaagatattgatgtaaaaaaaaattcagcaacctatctatatatggctgtaacaaagaagagtgatttggactactgctacaaagtaggttaaatgatctctacattacttcatgcattaacattctctaaattacttcatatattaacatttacatgtaatatatttgtagtatattctaatttaaatatccaacggaaatttggaaatgaatatagtttgtgtttaactgagttgagaaagcatagtatggtaattaaattctttttttaaccaaacattattataaataaaattgctgaattccaagtatttatacttaaataactttatgttgtaaacagtgtttttttaaagtactttctttataccttacactttattttagttaagttatagccatgtgtcttgggtagaattctgagagaataataagggactttaccctgtaatcacagaagcagtttggtaatataggaaccaagtgacagcttttctttttcaagtatatagattcagatctggacaggaatctttaagggtgacctaaaacatcattacgtcagtttacaacagaaggtttactctgttagtttccagtaactataatggaaactaacctagatgaacattggtacctactttgcagttagtgactgattttatttgaccaattagtactcatgatggagaggaaaataacttgtctgtgacctgtcatgatcaactcctaagggacaagctttgattacctcttaggtttattgtttttgccttatcaagtccacttgacttaaagtatgttctacaggcggaatacactgggggtggcgggcatggaatttttttttgctagaattagagctaataagtttgatttagagtaatcagtttttgcctctgttctcccaacaattgtgtgatattaggaatatctttcttgtgtttctttttaatagtttttattttatttaaaaaaaatggaacacttcacaaatttgtgcaggggccatgctaatcttccctttgtctttccaattttagcatatatgctactgaagtaagtgagcacatggtttttctctttctttcttctttctttctttctttcttttcttctttttccttccttccttccttctttctttctctctctctcttttttttttttgacaaggtctggctctatcatcctccaggttggagtgcagtggcacgatcttggctcagcttccacctcccggctcaagcaatcctcccacctcagcctcccaagtagctgagactacaggtgcacaccaccacacttgactaatctttgtatttttttgtagagagggggtttctccatgttgcccaggctagtcgtgaacttgtgagttcaagcagttcacccaccttggccttccatagttctgggattataggcgtaagccactgcacccagcccatatgtttgttattaatgaaggttgtgctatcagacacataatatcactgtgaaaacaacatttgccacctaattccttaaacagtgttctacaagaataaaaaatttattgatggctcattgtatgttagggtttattctgagtgccttaggttccacttccctctgtggaagccaaagtggggcagatagttcctctcataactcctgtgacagctagagtttggggcatatgacctcctgtgacagctagagtttccatcaactagttggaaatcgctgcatgagacttcacatctaggaaaagtgatgcaaagacatagcaacagtttagaatttattcttctagtggtttccaactcccaggctcaagcagtcctcccacctcagcctctagtggctagagcagcatccagtgtctcataccagtggagatactggtaccagcagtggtggtggtgccacattctcagcagaggcttcctaggctgtcttttttccagcatgattttggttgcagttctggcttcctaaccttctttagtgccatcttgtttcccaagtctgtttcttcagcttcatcattttgtgtgccatccgaattgtttcctacttaacttaaccagaaatcacttccattctttgtgaccaagaactggactagtacaattctcttggaaaaattggccttaatccctagctgtttggcaatatcttattatgattaattttttatagccacagctgccagaaccctaaatttcagttaacactgtaaagagaatttaagaaagaggaaataagtttatttaagtcatgacatcagaagaaaacagtaatgaaaatctaatgaacagtactattttcaagaaattgttcatgtattttagcaaaatgaaaaccacttaaagcatattttcagttgttgctgtttattaatattatctttattatgaaaggaggtaatttgtactaggcatgtactcctgaccttctgaaaaacctcccttcatttttctttgaagaatctttccctttcctgctcttagagtagggctacctccaccaattcagaggtgatgtatgtgacctatgcctaagcaatcagcacgctttatctccttcaacacagtgattggttgagattggatgagtatatatcagggtacctccactgaaagatagctattgcagcttcaagcaccacagcctcacacatcacatggagctgagaagaccaaaatatcagaaagtaggactgagaggatggagggaaagaaactgagtcctgatggtgtattttgaggcctatatatatatatctagtagaaaatgttatgaaacttttataattaggaactgtttgaaagttaaatatgcagctaaaatatatgattaattaatgaatgtacagaggaacagatagcagtgacagtgtatgttgtggaattctacttacatacaaaataattgtatgtgcatttaaatgcaactaagtggtacacatatgtacagaaattgctaccatattttatagtttgataaatacccagctattttaaaaactatttctaatcctacagtttcagttccataacccattacactgcttttttgcctatgccagtttgggttagattttctgtcactggcaaccaagagttctctgtttctttggaatataaatgctaaatcatcttgagttgggattgtaaagtcttgctaccatgttttgaggaatacctcttatttatgttttagttacatataacttttgtacctaaaatattaacaaggaaagcaactaacaactttaagctgaaatactaatcctgaaagataagaatgaaaactcaaaccttaagttctataaaactttgagatagctacatgtttactttcagaataatttaaattggtagagtacaagttgggaaacaaacactttaagtgaatatttaagtcatgtaaaatatgtatttttaaaagtcaaattaaacatattaccaaatttgctggaactatatattttatttataataagcacttttctacattttacaccctgttgccttacataactttccacagttttgacattataacattgtgattttctgtcaaacatgaatgaaaatacgagtttatggatgatagactcatgctatttccagatttcagaggggtagaggaagcagcagaaaggccctggagctcgctggatcccctagcaggccattcctgcatgacaccacagggatccatcaggagggtggccagaggagcagggggcaaaactccacagagagaagtaaatctctagctgaactttgtaacaatttgaatggggtgagaagcctcctggccagaactcgggtgaggacacaaatctggagggcacactcaacaggtgggggaagaatgaagccctattcttttgcaactgggtggcggatagcctggggcaagttttcaagcctgtgtcacccaccacctggaaacagacttggggctcttgtggggctcggtgggagtgagactggccctttggtttgcataagagctgggtgacgcctgtgactgccagctttcccccacttccctgacaacctgcatgactcagcagaggcagccataatcctcctaggtacacagctctagtgacctgggaatctcaccccaacccccaacagcagccacagcaagacccacccaaggagagtctgagctcagacatacctagccctgcccccacttgatggtccttccctacccaccctagtagcggaagacagagtgcatataatcttgggagttctaagcccctgcccattgctggtccctctctgcactactacagctgatgctctctggaaagcaccacctcctggcaggaggccaaccagcactaaaatagagcattaaaccaccaaagctaagaaccctcatggagtccgttgcacaaccccccatcctcccaccccccactaactccactggaacaggtgctggtatctacggagaagagacacatagatggttcacatcacaggatgtgatattgtgcagacaacccccagtaccagcctggagccgggtagactcggtggctagacccagaagagagacagtaatcactgcacacagtaatcacaggaagccacgtccataggaaaatggagagagtactacatcaagggaacaccccatgggacaaaagaatctgaacaacagccttcagccctagaccttccctctgacagagcctacctaaatgagaaggaaccaaaaaaccaactctggtaatatgacaaaagaaggctctttaacaacccccccccccaaaaataacactagttcacaagcagtggatccaaaccaagaagaaatccctgatttacctgaaaaagagttcaggaggtgagttatttaggtaatcagggaggcaccagagaaaggtgaagcccaatgcaaggaaatccaaaaaacaatacaagaagtgaagggggaaatattcaaggaaatagatactttaaagaaaaaacaataaaaaattcaggaaactttggacaaacttatagaaatgtgaaatgctctggaaagtctcaacaatagaattgaacaattataagaaagaaattcagagctcaaagataaggtcttcaaattaatccaatccaacaaagacaaaaaagaataagaaaatatgaacaaagtttccaagaagtctgggattatgttaaacaacaaacctaagaataatcagtattactgaggaagaagagatttctacaagcttggaaaacatatttgatggaatcatccaggaaaacttcgccagccttgctaggaacctagacatccaaatacaagaagcacagagaacacttgggaaatttatcacaaagagatcatggcacactgactgtcatcaggttatccaaagttaagacgaaagaatcttaagagctgtgagacagaagcaccaggtaactaacttataaaggaaagcctattggattaacagcagatttctcagcagaaaccctataagctagaagggattagccttatcttcagcctcctcacacaaaacaattatcagccaagaattttgtatccagcgaagctaagcatcatatataaaggaaagatagtctttttcggaaaaacaaatgctgcgtgaattcaccattaccaagccaccactacaggaactgctaaaaggaggtctaaatcttgaaacaaatcctggaaacacattaaaacagaacctcttcaaagaataaatagcacaggacctataaaacaaaaatacaccttaaaaagcaaaaacaaagtacgcaggcaacaaagagccggatgaatgcagtggtacctcacatatcaatactgacattgaatgtaaatggcctaaatgttccacttaaaagatacagagtggcataatggataagaatttaccaacaaactatctgctgccttcaggagactcacctaacacctaacacataaggactcacataaactgaaagtaaaggggtggaaaaaggcatttcatgcaaatggacaccaaaagcaaatagggaaagctactcttatgtcagacaaaacaaactttaaagcaacagcagttaaaacaaagagggacattatgtaatggtaaaaggccttgtccaacaggaaaatgtcacaatcctaaacatatgcacctaacactggagctcccaaatatataaaacaattactaatagacctaagaaatgagatagacagcaacatgataatagtggaggacttcagtactccactgacggtactagacaggtcatcaagacaaagtcaacaaagaaacaatgaatttgtaccttggaacaaatggacttagcagatacatgcagaacattttatccaacaaccacagaatatgcattctattcaacagtgcatgcaactttttccaagatagaccatataattgaggccataaaatgagcctcaataaatttaagaaaactgaaatgatatcaagccactctctcagaccacagtggaataaaactggaaatcaactccaaaaggaaccttcaaaaccatgcaaatacatggaaattaaataacttgctcctgaatgagcattgggtcaaaaacaaaatcaagatggaaatttaaaaattctttgaactgaacaacaataatgacacaacctaccaaaacctctgggatacagcaaaggtagtgctaagaggaaagttcatagccctaaatgcctaaatccctaaaaagactgaaggagcacaaactgacattccaaggtcacacttcaaggaactagagaaacaagaacaaaccaaacccaaacccagcaaaagaaaggaaataaccaagatcagagcagaactaaatgaaatggaaacaaaaacaatgaaaaagataaatgaaacaaaaagctgattctttgaaaagataaaaaaattgatagaccattagcaagtttaaccaagaaaagaagggagaaaatccaaatgacctcactaagaaacaaaacaggagatattacaactgacactcctgaactacaaaagatcattcaaggctactgtgaacaactttatgcacataaactagaaaaccaagaagagatggataaattcctggaaagatgcaactctcttagctgcttacatcaggaagaattggattccttgaacagaccaataacaagcagtgagattgaaatggtaagttaaaaaattaccaacaagagaagtccaggaccagacagattcacagcagaattctaccagacattcaaagaattggtaccaatccttttgatactattccacaagataaagaaggagcccttcctaattaattatgtgaagctagcattaccctaataccaaaatcaggaaaggacataaccaaaaaaagaaaactacagaccaatacccttgatgaacatagatgctaaaatccttaacaaaatactagctaaccaaatccaacaacatatcaaaaagataatccactatgatcaagtgggtttcacaccagggatgcaggtatagcttaacatatacaagtcaataaatgtgattcaccacataaagagaattaaaaacaaaaatcacatgattatctcaatcgatgcagaaaaagcattcaacaaaatccagcattctttatgattaaaactctcaacaaaatcggcatacaagggacgtaccataatgtaataaaagccatcaatgacaaacccacagccaacataatactgaatgaggaaaagttgaaagcatttcctctgagaactggaacaagataaggatacctactctccctactcctcttcagtatagtactgggagtcctagccagagcagtcagacaagagaaagaaataaagagcatccaaattggtaaagagaaagactgtcagtgtttgacaatatgatcgtttaccttgaaaaccctaaggactcctccagaaagctcctagaactggtaaaagaattcagcaaagtttccggatacaagattaatgtacacaaatcagtagctgttctatacaccaacagcgaccaaacagagaatcaagtcaagaactcaaccccttttacaatagcaaaaaataaataagtaagatacgtaggaatataactaactgaggagtcaaagacctctacaagaaaaactacaaaagactactgaaagaaatcatagatgacccaaacaaatggaagcacatcccatgctcatgaatgggtagaatcagtattgtttaatattactcaaatcagtaagaaaaaaacaatcccatcaaaaagtgggctaaagacatgaatagacaattctcaaaagaaaatataacaaatggccaacaaacatatgaaaaaatgctcagcatcactaatgaccagggaaatacaaatcaaaaccacaatgcaataccaccttactcctgcaagaacagccataatcagaaaatcaataaacagaagatgttggcatggatgcagtgatcaggaaacacgtctacactgctggtgggaatgtaaactagtacagccattatggaagacagtgtggagatttcttaaggaactaaaagcagaactaccatttgatccagcaatcccactactgggtatctacccagaggaaaagaagtcattatttgaaaaagacacttgcaaacacgcatgtttataacagcacaattcacaaatacaaagtcatggaaccaacccaaataaatgcccatcaaccaacgagtggagactattattctaagtgaagtaactcaagaatggaaaaccgaccattgtgcgttctcactgttttgtgggagctaagctatgaggacacagaggcattagaatgatacagtggacttcgaggacttggggtgaagagagggagggggtgagggataaaagactacaaatatggtgcagtgtatactgcttgggtgatgggtgcaccaaaatctcacaaatctccactaaagaacttactcatgtaaccgaataccacctgtaccccagtaacttatggaaaaataaatatgttaaaaaaaaaaagtaatagccaaatctgttaactctgtgattcctgctttggttaatgtagattattatcacatgatattaaagagtcaggattatggagttaatgttttactggtgcttttttttttaaaaaaagaaaaatgtttattatttaaggctgtgtgcagtatgtgcttatattcaaacatcccttatgctgttagtcacagaaatactaactatgtgtatatgaatggcttttcacagtctatataatgattggaaaaataactaatatagtatattctaaatgatgaatctttatcttcctatataaaggacatcatattactaattttcaaatttatcagtaagacactgaacaaagcctaaaaattaatggatattgttttaatgtgatgtatgatttactaaattaagcttaggagcatttctgtcgatgtattcctatctttcagtatgtgcttacatacaaataacaactttgtaagtattttctttttacagattttcagtaatttatatcagaagtatataatcaagaaactttagtgtttctgtccgttaaatatttaaaatattttattctaaagtaaacccttttggcattttttaatgtggggttgcctcatcaaattttgcatagcctacattacaatcatagaatcttgagttttggaagagactgtaaagttcatttcattcattcagcatccatttggtggtagtgtgctttgaagacttactaagaaattaacacctaggataacattttttactttgcaaaatgtcattgtattaatattttacgcaaacaatacatgaaattacagtactttttttctgtttcttgccaaattgtaagtagagttgaaaacagaattattttttggagatatgatcttgccctgttgcccaggctggaatgcagtggtgtgatcttggctcactgcaacctctacctcctgggctcaagtgattcacccacctcagcttcctgagtagctgggacttgagtgccaccaagcctggctaatttttattttattttattttttgtagagacaggttctcactatgttgcccaggctggtctcaaactgagcacaagtgatccatccccctcggcctccctacgttctgggattacaggtgtgagccaccgtgcctggccccagatttttattgtctttgaaacagaaaattcatgaaaggattctgccattttattcacctttctgacactgcagtaaagtgcagattaaagtatagttccctgtgaaatagccagttaccctttgagtagactccagttcacataaagaagtacagggagattacatgacttgcctaggttatatattgagtcagtaggagaagtagaaatactaagtgcagattcacagttcagtttagcccagaactatggatgctttccttatggttattacctggaaggctttacaatcactgatgtaccctccctgctgtctcctctcacttacacatatgcagtcttgattattttgataatttttctacatttatacacacttcacacataatttttgtttttttaaacctcagtttatagccttaagttatactcaggaatgtacattgtactcttaagcagaaagaccttaatattagttacagctgaagagtgagcttaatttctaagtacattttggtttttccctttttgtatgccttttataggtgttcacctttagcagccagtctcttgactttgcctaatactataaagaatagcaaacattgtattgacataattggttgttatggaagtcatttttaatagaatgaccataccttatttattaaaaaataataaactttatttttcagagcagtgttaggttcacagtaaaactgataggaaggtatagagatcccccgtatattcccttcccctatgcatgcatagcctatccaattatcagtatcccctattagagtgatatgtttgtcacaatagatgaacctatatgattatcactcaagaccctagttaatattagggttcacttttggtgtcatacatttcatggatttggacaagtgtataatgacagtacatccaccactgtagtatcatataccataatttctactacacggaaaatcctctacagtcctgttttacattttcagaagtgtcatatacctggaatcatacagtatgaagtcttctcaggttttcttctttcacttattagtatgcatttaaattctccatgtcttttcatgcatcgatagctcatttatttttagtactaaataatctcttgtctgaaggtaccacagtttatttattcatttacctactgaaagacatcttgattgctttccagttttgctaagtataaataaagctgctgtaccatccatgtgcaaatttttgtatgcacgtaagtcttcaactcctttggataaataccaaggaacatgtttggtggattgtatggtaacagcatgtttagttttgtgagaaattgccaaactgtctttcatggtggttgtatctttttgcatttccactaacaatgaaatgagggttcttgttgctccttatcctcaccatcatttggtggtgtcagtgttctagattttggccattttagtaagtgtgtagtagtttctcatttttgttttaatttggatttctctactgacatacggtgtggagcatctttttatatatttatttggcatctgtgtaacttctttgatgaggtttctgtttaggtttttggctcacttttaagctgtgttttcttattgttgagttttaagagttcttcatatattttggataacattcctttatatcagacatgtgatttgcagatattctctcccagtcatctttagcttgtctttttattctcttaacagtgtcttccccagtatagattttttgtttttaatttaatgaagtccagcttgtcacttctttcttttatggactgtagctttgatattgtatctaaaaagtctgtttgttcaaaatagtaatgatttggatctgttagatcaattaagaatgaaacaaagttattttaccattatgtattctttccctaatgctccctctttatgtagatctgagtttctgacctgtctcctttaacatcttttaaagaactttaaaaaacatttcttgtgaggcaggtccactagcctaaaattttcttgatttttatttgcctgagaagatatttatttctccttcagttttaaaataaacagggtctcgctatgttgcccaggttggtcttcaactcctgggctcaagcaatcctccagagtatctgggattacaggtatgtagcaccatgcctggctttcttcttcacttttaaagggtgatttcaaagggcacagaattttaggttgttgggttttttcctcaacactaaatattttactctactctttttgtattttcaatttttgtggatacatactaggtgtatatattaatggggtacttgtgatgttttgatacaggcatacaatgtgtaataatcacatcatgaagaatggggtatccatcccctcaagcatttatcccttgtgttacaaataaattatattattttagttattttaaaatgcacaattaaattattattaactgtggtctccttgtgccatcaaacagtaggtcttattcgttttttctactatatatacttttttgtacccatcactccaccctttttgcttgtactgtttctgaggaaaaattggatgtaattatctttgctcctctgtaagtaaggtgtttttttcaccactttggcatctttcaggatttgtctttatcttcgattttctgtaatttgaagatggtatccttaagtgtagtttctttggcatttatctcttttggtgctctgtgagcttcctggatctatggtttcgtatctgacattaatctgaggacatttttagtcactattgctttacatttttttcctgttcttttctctttcttcttctacaatttttatcacacatacgttataccttttgtagttgtgccacatttcctcctgggttttttgttttgttttgttttgtttttgtctttgcttttcagttttgaagttttctgttgagatattttcaagctcagaggttctttcctgagttttgtccattcaacggcattcttgatttctgttacagtggtttttttggtctctagcatttcttttggttatttcttagatctctcttcttgtacttcccatctgttattgctgtcttcttatcccttagagcccttagcatattaatcacagttgttttaaattcctgatcttatgattccaacatccctgccatagctgtgtttggttctgatgcttgttctgtcctcttcaaactctgtgtttttatgttgggagaagagaagtgttctgttgtcctatgattaggtatcacttttttagtaagcctgtgcctcttgactgtgaatttcacaagtgcttctcagtttttttatccttctccagttggacagatggctagagtgagctggagttgggtattttctttctcccacctggaaggctagtgccaactggagttggatattttccttcctgtaagtcagttaggctctgatagaactccaacaggttaagctctgtttaaatagtttcctctatgggcagaccttggtaagaagcacagagtgatccggcatattttaaaaatggcgtgtcctttcctttgctggaagcatgagtggatttttctccagtattcactgtgagaaccagatcaagtttctggaggttaaactcaacagaagtgaggagcctccttatggctgggtgcccctgcatttttcagtttttacagttgtccacactgactccagcaattaattgctgtttaagttttcttacactggcactagctcccatggaggtttctacttctgggtttctactccaataagttacaattctctgtatttacatctgtctctccaatctggggggcaatggtttaccctatgacttgacttctcttatggatccgagaagaatcgttgatttttcagtttgttgagatttgtatttgttgttaggatgaaatggtgacttccaagcttcttacatgccagaccagaaaccagaaatcccagcttaatgtcacagactgacatggactgcactgcagcattaaagagaataagaagttgtcgttgggtttcaagtctgtgaaacaaagtaaggtttttaatttatccaaagttacacaccctgcaagtgacacaggtgggaatagaatctaaatatttggactcccaattaaattatctttctttttattttattttattattattatactttaagttttagggtacatgtgcacaatgtgcaggttagttacatatgtatacatgtgccatgctggtgtgctgcacccattaactcgtcatctagcattaggtatatctcctaatgctatctctccccctccccccaccccacaacagtccccagagtgtgatgttccccttcctgtgtccatgtgttctcattgttcaattcccacctatgaatgagaacatgcagtgtttgtttttttgtcctcgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatggaatggctgggtcaaatggtatttctagttctagatccctgaggaatcgccacacagacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttgtctgatggccagtgatgatgagcattttttcatgtgtcttttggctgcatcagtgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggtttcctgttcactccgatggtagtttcttttgctgtgcagaagctctttggtttaattaaatcccatttgtcaattttggcttttgttgccattgcttttggtgttttagacatgaaggccttgcccatgcctatgtcctgaatggtattgcctaggttttcttctagggtttttatggttttaggtctaacatttaagtcttgaatccatcttgaattgatttttgtataaggtgtaaggaagggatccagtttcagctttctacatatggctagccagttttcccagcaccatttattaaatagggaatcctttccctatgaatgaaatgaagcgagaaggaaagtttagagaaaaaagaataaaaagaaacgcagaaaacctccaagaaatatgggactatgtgaaaagaccaaatctacgtctgattagtgtacctgaaagtgacagggagaatggaaccaagttggaaaacactctgcaggatattgtccaggagaacttccccaatctagcaaggcaggccaacattcagattcaggaaatacagagaacgccacaaagatactccttgagaagagcaactccgagacacataattgtcacattcaccaaagttgcaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccaaccaaactaagcttcatgagtgaaggagaaataaaatactttacagacaagcaaatgctgagagattttgtcaccaccaggcctgccctaaaagagctcctgaaggaagcactaaacatggaaaggcacaactggtaccagccacagcaaaatcatgccaaaatgtaaagaccatcgagactaggaagaaactgcatcaactaaggagcacaataaccagctaacatcataatgacaggatcaaattcacacataacaatattaactttaaatgtaaatggactaaatgctccaattaaaagacacaggctggcaaattggataaagagtcaagacccatcagtgtgctgtattcaggaaacccatctcacgtgcagagacacacataggctcaaaataaaaggatggaggaagatctcccaagcaaatggaaaacaaaaaaaggcaggggttgcatcctagtctctgataaaacagactttaaaccaacaaagatcaaaagagacaaagaaggccattacatcatggtaaagggatcaattcaacaagaagagctatctatcctaaatatatatgcacccaatacaggagcacccggattcataaagcaagtcctaagtgacctacaaggagacttagactcccacacaataataatggaagactttaaattatctttctatttcactaaattccacttttctgaaaggtgatatgaatggttcatatagggaaatattacagtgaggcttgttattgtttgtaataccatattcatttagatgttttctccatcctcctttttttttctttttttaccttctttataattttccttttagttctggttcctgatggtactgaatattaagaagattatctgccatttttgaggaggaaatatctaatagtataatctttttcctctatgttacaggcagaagtataactgcagcagcaatctgcctttcccctttatttgaatttacagaatatgttaaaatcaataataagatgcaaataaaaaatcactcattgacacttaatatgctgaatacaaattcagcaccataattaaattgcaaagtttaacattatactccattttgatattaatatttgatcttgcaatgaatgtctgcttgtcaaccttttatttactgtggaggtcgtggtatacggtattaaagaagacattcaactagagctcaatttttctgatgagctcccaggttcccatcgcaattttagacaacacatgctgttttactggaagagtatctaaaggatatagtctgatcactctctacctcccatggtaaaccttctgtttgttttttgaatttggtagttaaaggtgcatgataaaacttgccatctctgttagatgctgctaaatgagactagtaaaatgactgccaagctccagccgctctttattttattgctttaaacatagatttcctagatggtcatgatctggtttgtccaaatccaccttaactcttaaagcaataataaatataaattttaaattctaaatgaaagagaggaaggggtctcttcataagtgaaaacattccttaaacaaatgaaagcaaacagaatttttttcatggacctgtattttcatttttctgaccattatacgattttcctagcaatataaaagaattctgcagtccctccctatttagttgttggaagagaaaaatacattaaatcttaattagtatactacctatagtagcatctggtgttactgaatttttaccatcttctgaaagcagtaatcattctttacctggaggaaaagattccagtaatctgttttattaggaaacttttctagccttcctttcagttacgggatttattgaaaactacctcatatacatatgcacatatacccatatatgcatatgtatatatacatgtgtgaatacatatatggctatagatctgtgtgtatgtacacatatagacacgtgtgtatgtttttgtgtgtatatgtttttatgtgtatctgtatgttcctttctaaatagcattctatttcataccttggaaaaatataaaattaaaaaatgaggtcaagatggcgccttttaagaaataagttgttataacagttcctttcagcttcacatcataagtgttaagaacacttgagtatttttaatgtaaacatattttagcatctatttgatttttactttattttcttgatactttcagatatatatttgctttacattattctcagggtttcttatttcccgaaaacactttgaatcatttccactgattctttttcctcccttgttagtttacatgtatcatttgtatgatagtgtctggaagtaaaagggcacttgagaaacaaagttgaataaaatttcatcatacttaattctgaaaattgttttctgaaattattagctcactgctgaaatatcttcagatcaaacgttcagaacatcagctcccaaggagcttcatatttagtttatggtggggtatgattgtgtatttcacaaaattcatgaaggaaatttgtacaaatttattatggattttaggccagcggaactgtttaaacttcctactctatttgttccattgagtagccttagagttgaaacagcagtttccatttttctcatgggtagatcaacccatatgcacatttatcattgatttctagcactggaaaagcatagacattggagacggtggtcgggcacggtggctcatgcttgtaatcccagcactttgggaggccaaggtgggcagatcacctgaggtcaggagttcaagaccagcctggctaacatggtgaaacccagtttccactaaaaatacaaaaaattaactgggtgtggtggtgcacgcctgtaatcccagctacttgggaggctgaggcaggagaattgcttgaatccgggaggcagagattgcagagagccaagatagtgccattgtactccagcttgggcaacaagagtgaaactccatctcaaaaaaagaaaaaaagaaaagaaaaaaattggagacagctgttcacgtatttaaaggagggagaatattcttggagaatataattggtgaaataaaaatacaattcatatgtactctatggaagataaactgcaataagcaaacctctttggcagattttaaaatcagaaatatattccagccagtgtgggatattcaatctaatttcctttgagaacctgattctgttggattggtaggcattaggaagcaacagctcttctctctccatctcctcaaaaaattgtaaacggaaatgttgtatgaaaaaaacttcaaagatacattctaatttttttcttttgctattttaataggcttttttattttttaagaactgaggttagtgaacatgtgagagaatctgaagtacttttcatatgtttttgtccttgaactgagttatttgaatctggcaaatttctctattaataattacaattattatatcactatgtcagtatgtgtgttatattcaatctagaatatttgctctttttactcccatggttttgaaataagcatataggcatttaatttttaggagttataaatgtccaatagctatgttttatatcaatatgaactgcattgtgttttattactaatagtttagataaatctgtatatccaaattgtgaaccactgaaatgaataattccctttcttagagaaggacatgaatatagtgagagatctgttactttctggattcttctttttggtccttcaagaagttgtacaaagataatatcgatgttctcttttattcatcagtttctctcaactggtttcagaacattgcagtatcagagaggggaaaaaaataagtatttcagatttttttttcttgagacaaagtctcactctgtcacccaagctggagtgcagtggcatgatctgggctcactgcagcctccgcctcctgggttcaagcgattcttatgcctcagcctcccaagtagctgggaccccaggcatgcatcaccacacccagctaatttctgtgtttttagtagagatgaggtttcaccacgttggccaggctagtctctaactcccagtgatccacctgcctcagccccacaaagtgctgggattacaggtgtgagccaccatgccctgccaaaaatcagtattttctctgtatcacactcccaacctttaacattgcctcccattctttcttttggctgttatttaatgagagactactatgggtaggacattgtgttaatctctgggaataagagaccttcatattcctgctattatggagttgcggtttagtagagatggtaggtaagaacatgggctcctgaattgcaatgcctgggttctgttcttggttgtggttgtactgcttactagaaaagttgaagaaatcacttcattatttgtttgagtttccttcttgctgaaataaatataactctatcttaaataagataatgtatgggttaaacaatgcatgtaaaacatttggcactgatgttagaaaagggaacatacaggttagtatctctaaccatgttgtaaaagtgatttgaccagctgtattcagttataaacattttattgcacttttggagccttttccaagtcctgtgtaacctttggaataccctctgttcacctccccccaccaaaaaggctcctgtaagtccatcacttcttggaagcttcctcatttaacatcccctgtctagccattcctatacatgaagcagacacgactccttggtatgcactgtgcagtaatgaacagttattccctccttgtacatgttgctaatgtggattatttatttgaattctgactctttgggatccctttgtttataattttaagttcttagaaggatagggaccacagtaatctaccttggtctatgtgacacttgcacctttagtattcaataattgaaacacataaaagtgatttcagtggaggtgagcacaagcttccttttttcactgtgtgaatagacatagaggtgaccacacgtttttttcttgtcttgctttttcactaagctttctctgtgattgagaacaaacagggaagtctgaacggttccctgttattttatcttttggatgtagaggcatacatacaaatttctgttgaatgctttgtaagggttacctcatttattcttaaacttttacacagttactgctgtgtatttatgggatgcaggtactgtttatccattgtaattatagttcgtttgttagaccaaacattgggaaaatcttttgttgtgaatggtgattttctaaatttttacttttgttttttatttgccagattctgtctctcttttctttgttcttggtgtactaatctgattcctcttccatggctattccactttttccaagtcttaccctaaagccttttaaagcgatacgtttagatcaactttttttttctttttgtttgtagtttgcacattatatgctgtactttgactaatttaataattttttcttataattccatgtggaaattttaattttagttttgttttcccctgacctttataaaaacaagagattaagtgtaatattttctacttactgcttcaggctttgtaaatttggcacttaatggtttcattgttttagaacagaaaagattatcttaactgaccactaacaacatagttgccagtttggcgcaccaaatctgtagttaatactgatttcaaaatagtgtttcttggcaaatcacaaccaaaagcttagaatattctgtatgacttttagttctaaagtaccttgcaagtattactgttaatctcattttgtagcagaaataatagaccaggagcattaaaaggacgtatttgtttattcatatggctagtatgtgtggtactactgaactgaacccatgcttctgcctagttaaatggtctcaaaacactaagaaaaaaagccaacgtataaaattcaatagcggttagtagcaaggaatgagtgttatctgaagtcatagcgtgcttgttaaagtattttcaattaactttctccacgcgtctcttaaatatatgtttttgtatatatttacagtttttttggacagatctatttggcagtcttctttaagatattgtcagctactcattcacaagaatggtgacatcttaattttaaaaaacattttatatagttactctctttattctggtgcaataataatactacacactgggtaaattgtaaagaatagagatttatttgacccatagttctgaaggctgagaaatctgagagcaggatgctggcatctggtaagggccttcttgctgcatcattatgtggcagaaggcatcacatgaagaggagttgtgcttagaagacagagaaaaaatcggggccaaacttattctttttataactacctacttccttgataactaactcactcctgcaataacagtcttaatccattcacaagggtggtatccacctgacctaatcacctcctaaaggtctgacctctcaatacatttgcaatggcaattaaatttcaatgtgagtttttgaggagacaaaccatagcagttatgtattttgttaaacttaagcattttattctgttaaattatgtatgtatttatatatatatatacatatatatacacgcaagcacacatatacaggcatacttatgtgtttatatgtgtgtttatagatctttttcttaggaagataattatattttaaaagtcattgatggtagggatgatagcagaggaagttgtgaaatacaatctaagtaatattatagagcatacgttcagtattttgaaaactgctcaataagggtatatttgttgacaagtaatagatcacattacaaacttactattagacattgtttatctagtcagcatttatgaatagtctgtggtgatctgtgtgtttatattccacatacagtctatcaacaaatcctgtcatttctactttcagaatatatgctaaatgcaaccacttcttactacctttatcactgccaccttatttcaaaaccaggttttacttatttactatacgatcttgtccaagtgtttatagtgttaggatttttcttttcacaatcattcgtcataggtaaagaacttatttttctctcacatggtacattaaaaatagaagcaagcaagtaattgtctttaaaaattttttgctttgcctattattattcctctagaaaagataataataatacatagttacaagaacatttacattgaagaaggtgacttaatatttgaaattattgtgtttaatattatttcggtttttattaatgcttggtatattttgttaataatttaaatattgctaaattttggaaaaaattataatggaatcattatattagagttcttcagagaaattcaaccaataagggatggttatatctctatataattatgtttatgtgtgtgtttatgtatatgtatgtatatttgtatgtatatgcagtcatgcatcacttaatgacagggatacattctaagaaatgtgttgttaggcaatctgatccctgtgcaaacatcatagagtatacttacacaaacctagatggtatagcctactacacagctatgctatatcatatagcctgttactctaagactgtaaacctatacagcatgttactgtgctgaatactataggcaattgtaaaacagtggtaagtatttgtatatttaaacatagaaaaggtaatgggttgcactaccacattatgatggctacagcatcactaggccataggaaattttggttctattttaatcttatggggccaccattgtatgtgcagttcatcattgaccaaaacatcattattcagtgcatgactatatatatatttgtcacttattagcacattaatatggatttgtataaataaatttctagtaacgctcaaataacatacatggatgcattttcaattgcttctcaaatatatggagtattttaaataagtagattccaaaaagcaaaacaagtttaataaatgtctatttgcagctacattacacactcatacacacacatgcacacgcacactctctcacagaggcagtcaactgttcatgaaatattaagattatattttacaatgatatttaaaacttgaaacatacatacaaaacaatgaagtgtgatagctaacagcacagacttggatcagatagaatgacatttgacttccagctctgactttctgagccttggttttcttatgtgtcaagtaatgataatacctgcttctttgtgttgattaaatgagaatatatgtaaactacttgccatggtgccctgtacacatcatacacagtaaactattaccatctgtattttaattcttaattccttcccctgaacacaacttgataaatattctttaggtttctgttcctcctttcaaaagttgatttaattcataatgtaacttagcgtaatataaataataccatagaaataaccatctgtagcagtggtttgatgggaaaatacagtcacagctacaatttgataagccaggaactgtatttttccctcctgaagttataaaagtagaagtagtaatcctctctccaggcatccttttatcttttgaagaatagaagtaaatatatctacatatccaagccagtggtagtccttctgtattggggctttttgcagaggattggggctttttgcagagcaggcctgcaaggggaatgaatatcagaaatgaggttccagtgacagaaggtactgaaatgctgtgtgtgtgtgtgtgtgtgtgtgtgtagaatgtgaggggggttggataggttcatgtgggtgtaaagtgaagagataggccagggtgatagatgtatagaacttctgattttaaaataagcatgtaagctgtatactatttaatgaaattactattgacattttattgaaattaaataatgaattcatcacattttatgagaccaactttaagaaaactagctggatttttaatggtttgcttcaacttaatagtggtatataacttagtacaaacatcgaaggctatcagaaaatgtatgttagaattttaatgattatagaaactgtggaatattctgtatatatctgacacttaaaattacttgttctggggtatccataataaaatttatgtcatgtggttttttgggtcagtattttcaggtataagcctggtgtgtaacagtgaatgctcttagaagattgggtctgtatcttttgtctctgtaaattacacaatgataggaagttaatatgttagggatttaataagtatgttaatgattatctataaagataatatgctttattttttgattggtttgtcatattttattggcctgctttctgctagaataccattatgatataacttgccaaggagccctagggtatgaaaaaacagtcttccctttttaattatgagaagttcagagaccttctgaatatattaatgattactactaaagcaattcttaataatttttccactaataggagttgtaaagatgccagactcaaacagatgtgaatactaggctcccttgctagttgagttcttgttacttcacatcagtcttacagctttctgttagtgtgagtcacatgtgggtctcagcaaaatgataaattagcatagaccctggacctctgggtcatggtaaaaataatcactgaatattaaggatctgtgtaaagattcttaacctgtatagggtctgtgttcagaagatctgtgaaactcctgaaattgtctgccacattttgtgtatacgtgcatacacattttttctgtgaaggatatatgagtattttcaagtctgtaacccatgaaaggttaaggaccaacggatttataacctgttcagaagtcttttacattgagttaccatttgccatctcatttcctcactaattgcatattagtgaggaaaaacttagataccatatatttttttattagtcttattttaattttccagaaaatttgtgaccttttcataatacagtgttatttcttctttatgtgattcgtattttagtacaaataccatgttaaggtgcttgataaaatgtgaatgatttatgaaattttacttatatacccaaatttgttgttaaaagggacaaaaaggaatttttttgtattttacattcagtccttttcatggaatagaatattttaaaacaactttggcttgaatttttaattatcatatttagaaatcctgcttttatgaaaatacagaaccctcactctgtggcttacagacaatagtagtatattatgtagggtagcctaaacaatggttgattattgtgtttgtgtatatttcattctctctgaattggacttgagaggcaaactttgtctttaaacctttagctgttgctttctggacctttgtattgcctaagggatgcaaacttcttggaaagtagaaccataaagttgtaaatgaacaagggaagaaatagaaaatataatttttgtcttcattaatgtttctaaagtagacagtaatttcacaattacagtatccactctcatgaaatttactaactacattaatgagcaaatgtgaagctgttttgctaatgtggaaattaaattttttaaaacaaaacttttttattctgtcaccaaagaaagaagcacattggttatgttaataaaaataatagaataaacagtcattcattggatgtttaattgttacaggcacttttacatattaccttactggatcttaaccactgtaagcattaaatggtattgccattttgatgaggaaactaaaacatgtagaagtttcttcaaggtgttctatgtgaccttcaaaaccaggcaattaatgggtgcttaatatttgttaaattgaattgcattgaaatctctttttactctgatcttttcattagtattatcattttttcatttatctgcggttaaattatggcctcaattttgggactccaggcctcagtatacattaacataggaaatatacccatttaaatgtctgctacattgtttcctgcagtgattcttctttttataatcaaagcagtgtgtagcaagcttttatcataatattttggaaaaatacgatctcttttataatcctaactgttagctaagtgaagcagattttctatactttcattcccacttattagtcacaaattatggggctggagatgagttgagatattggaggtcttttctccccagccttctatgcaaatagaggattttcattttttcttaatagtttgtggtgtttttcctaaaaagtaatccttaatatagtttttacccatattggtttagtttcttttgagagaaaatatattttattgatatataataattatacttttggtatctctcattttaaggtattagcctcatttttaaatagtgtttgaatcggcaaatgggtaaaaaatttgggtgttatggaatataagaaaaagaaatgaatagttgtatagtcaacattttatacagatgtaagtatataaagtttatatcaaagaaaatacttcaaaatattttaagtattatagctagtattgatgcagtatggtcaaattcatttagtgagggagtcattactgctacatctagcttttataaaatttgaaaaattcatgaatattatattaaatattttaccactttgggaggccaaggctggtggatcatgaggccaggagatcaagaccatcctcgccaacaaggtgaaaccctgtctctactaaaaatacaaaaatgagccaggcgtggtggcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttgctctgtcaccaggctggagttcagtggcgcgatctcggctcactgcaacctgtgcctcccggaggttcaagcagttcccctgcctcagcctcccgagtagctgggactacaggtgtgcgccaccacgcccagcttatttttgcatttttagtagagatggggaatttcaccatgttggccaggatggtctcgatctcttgacctcatgatctgcctgccttaggctcccaaagtgctgggattacaggcgtgagccactgcaccgggccctagcatagaaatttctaaagtggatataaattaatcatatcaattctaaattacagtttagttaacattttttaacctgttcttcagttattacactgtatttttagtccaaaaaaagatgaaaggatttatcaggatgttttgaggggatagatttttaaataggtcattttgaagatacttttgagtagacatagtcattacatagtcattaaaaaaccagagctttacatatttttataaaataatttttaaattctaaaagtaataaatgaccttagggaagatttggaaaatacaaacaagtatgaagaagaaaaaaaaaagtccccgcaatcccactgtgcaaatcaaccactcttttttttttttccaagccaaactgtatccagctttattaaagatactttccataaacagtcgtggtatttcaggcagaacatgggcagacagtcattaacagtacacaacaactttcaaacttaactaccttcttcaatggactaccgaaaatcagaaagccactataaaacccaatgaagtcttcatctgatgctctgaacaggcaaagtttagagtgagggttgacatgtcacatttagcatgttgtttaacaacttttcacaagctgaccctgactatcaggaagtgaaatgaaaacggcagaatttatctgaagatccacaatctagaaacggaaccactgctcttttgacaggtgccatctcagtggcatcccggaaaagtccagattgcctgacacactggtaaccaatgactggaggtcaggtcccaacagatgtctgggcttaagggagttaagtctgtgctgatagatgggaagggagaagagagataaaaatgattttgtttttccataccacaaggcttttgtgccaaggtggccatatgtgtcaaagtcgcggaatccctcctgggagccaagagtaagtctctcaaaactagaagggaaaagtgttttccccacatcaatccagcttcgaagacaccctattagtgacatatgccccttccccacaaaacaacaatgaagtgttctgtgtgctaacagcatagctcaaaaaaaaaaagtaaaacaaaattttgcatttttataaaacttggtaaaaatagtatttcaaactgttcagtcaccagaagtacacagttatcaaaaatgcacacacttctcttggcacctccagcaccttcagctttctgtgcctgatctgttttgacatctccattttctgcagggttattcccctccttgccagcatcagcttttccctttctccctttgggtaccttctctcccttctttgcaggggcctttttaggcctgggctctggctttggagaagcaggtttagcggacaaccttgcagatcttctctgtggttcgtcctttaccttggctttatctcctttagcatccccttcagcctttctcttgggcatggtggtggcagtgatggtggtgggacataggcactgggcgtaggatgcagaggcatgtgggctttggtgagtccaggggtcgttcttgcctcttgttcatactgctccaaatcaaccactcttaatagtaaattctttataaatattgactattgtgtacatttaagttgtttattacttttcactgttaaaaatagtttttcctcacacaatttctaaggatgcttcttaatgacagcaaaatgcaattttctaaagaaatttatccaacttgataaaaccaagagtcctttacttaggacaggtatatggggtagtggtaagagcttccctattccctgtttgacacaaattttcttggaagcaaggaaagtagaaccatattcccaagaagcattctcttggtgaggcagaatagaagaaagaataaatactatgagaacattttagggacagtcctgaatagtagtcgagtagtaagggctccaaaagaacttacattccttcctttgtcactggaaaatcccagttagctttgaatagggcgttgactctacccccatattaatatttttagacagtgttatagattgaattgtgcttcctcaaaatttgtatgttgaagctgtcactcccaatgtgtctgtatttggagatagggcctttaatgatgtaattaaggttaaatgagatcataaggatagggctattatccagtatgactggtgtctttgtaagaaaaagactagctaccaggtgtctgctttaatagagaaaacctatgagacaagaccatctaaaagccaaggagggaagccacaggagaaaccagccctgcggacaacttgatcttggactttcagcttccagaactgaaagtctggaggctgttgttgaaaatctggaggctattgttggtggctgttgtttaagccacccagtctgtggcatttcgttaatggcagccctagcaaaccgatacatacagttttctccctttcccttccccttccccttcccattttagtagtagtgcagtaggcggaataacagctcctcacagatagaaactgctactctgtggactgtgtaagcattaccttaaaaggaaaaaagattgggagactatcccgggttatctaggtaggccataagcacaataataaatgtccttataagagagaggcagagggagatttgacacagacatacataagagaaggtggtacgatcactaaggtagagactgggataatggccacaagtcaagaaatgctggcagctagaaggaggaagaggcaaaaagcagatttccaagagggaatatagccctgctgactccttgttttctgcccagtgaaactattttggactttgtgagggaatatatttctttttgtttaagctattgagtttgtagtaatttgttttcagcagccataggtaactaatgcaaatagctgctgaaaataccaaatacttttctgtgtctaatgatgtaatcttatggttttgaatcatatgatgtttgctttctaatttgtgaaaaaatcatatcgattactttgctatttttttgtaaactgcctctttctggtatttttttcaaacactgatggatttgataatattttgatagagttttttattaaggaattaaatagtctctactttttcttttttatactgtctttgtcaggtttgggtcataaggttatatgttaaattgttttggatacatagtcggagcccaggttattctaaccttgaaagtcagttatcaaagctgaagctttctatgatagacaattgggagataattttggttcttaagtagaagaaaccatattaaagtgtgttttttaagataataagacataacagtacatccaaaaattgtttgtaggtacctagggagcaaaatcaggcataaagtctcagataacaatctaggtactgagtttctcaaacacattctgtctcattcatgttcttcaggagtgaagactacgtgaattgagttttgggggatttaatcaggaagtaaaggaattctaagcccctagagaatgtcacagtagatgactgagaggtgatcatgtttatcttttccctgtaattctttcattccattttttttttctttggaagaggtgaacatcgtagataataaactttgggagtgttaggggatggaagggaacatgtctgtataggtcagagtttctgaggttggtagccttggactttttgtgagagaaagaagagtagagttataaggatccagggatacatatgcaacccaagcattgtataaacactggaaaaataatataactcacacgtctgttattccacattttcaaatgtacttaattactttgtaaatctaaatcatcaactgaaaaattatgtttctaaatttgtggcacctgtagttaatgctttcaaacaacaaataataacagcttatacctattaccctatgggaatctgtagagtgggtttaaaaaattattttaaagggaccatcttttaaatgaaaccctccctataaacttataaaattaatcagggaagaagggatggggagaaacaaaaaccaagcttgcagcacattcagcgttaatcactaggtgaggcttgctctctggtctgcttcttcatagttgtttggtgcctattgtcctacaatcacaaagaccttagattataattctccttaactgctccatagaaaacaacttgaacattatgaaacattaagttttccctttgagatactctttttttttttttttttaactgttccaaaggcacattggcacctttgagatacactttcaggtcctgcataccagtgaaactacaggcaccagctggtctgacggtgagctgtctcagcaaatgcactcggtatcttcatgatttcatctcccttattccaaccaatcaatgaccccaaatttccagccccttgccctctactatctccttaaaatccccagcccagaactcctctgggagatggatttgagggtctcctcccatctcctttctcagccaccctgtggttattaaattctttctgtgttacaaaccctgctatctcagtatattggtccgttactgtagatcaggcgtacaaatttgttggtcttgaatctaaacaccagtcccttaatcttattactgaggatactcttggctatgtagttactcatggttacattgctagttagttacagaaccctggtgagagcctgtgttttcaagatctcttagaaatgctgtgaagaaaaggtcttaggtttaggtcttagtagtaattatttggtttgactttggaaaagtgtagatacctgcatctcctcactgtgggctatgcacagatgaaatgtagcattattacgttttgaaaggtgcaggatagcttctgtttttcaacattatgctttagttgttctagccaccattctttatttaaatgagtaggaagccaagagcaaagtaaagatggatttttggagtcctttgcttattttcccacattttttcttaccagagaacacataacatagacaggtagataggaagggagggaggtagataggcaggcagttcaaccagaaaaaaatcaagcctgttttagcaggttgtgaaaagatgaactgaatctgtcaatgtccgcatcttctttagttaccaggagtggatgtgggtaagccttggtgcagcagataatactgataagtgtatatgttccaaatagagatgtggtcataggaggaaaaagaatgttaatgccatctgggatgttaagaagttagggaaggacacagagcataattgagatgaaattgtaacttcttactctcttcagtgatagtcaaatctaatttaagtctgttactctattctcatgaaaacattctcaagagttgaagaaaataaatagtaaggcagtctgtatggaccttaacaaaacttagttttgactattggaattaaattttaatattttaatttggaaatctcatcctgaaatctcttttggtaaaaacatggaatctttttagtatgaattagaattattctggtcaacaattatagtttctgtacccattagggtatcaaagtcttatattcaaattatattaaattgactcattgactcatctagttcagtgggaatatgattttagaagtagaataaagtctacttgtatttgtaaagttgacactatgttttatgagggaatttaatgttcttttcaggaacatgaggctggacagaaagataatcttacaagaaattatctcagtttttcattttggccttttgttcacaaaagagctagaattcaaaagaaaacaacatttagcctatttatttatttgtttattattttttgagagggagtcttgctctgttgcccaggctggaatgcagtggtgccatctcggctcactgcaacctctgcctcccaggtttaagcgattctcctgcctcagcctcccaagtagctgggactacagttacatgccaccacgcctggctaattttttgtatttttggtagggacagggtttcaccatgttgatcaggcttgtcttgaacacctgaccttgtgatccacccacctcagcctccaaagtgctgggattacaagtgtgagccactgcgctcagccgccctttttaatactatggttattttagttgatatcttcagattgctcttgattggagtatataaaatatgtcatagattgtgttattttaattttacttgtctatgttcttatttctttgaagttgctatttttcactatattttgctgtcacctataaattataaatattagtcttaacagaagtcagatattttctatattggatttttttttgaaaaaaaggagataggataaaatgtaaggaaatcaaatctaggaactaatttagaaaagtcagaggatttttatttagtattgagaagtataagataagttaaatgtatacaccagagaaaaaaagttcttattacaatgtaatatgtggaacaaaaaaaaatagtaaggatatggctatctatattttattttaatgtttatttaacaaatatttactcagctccaaattaggtactagaaactgtctcagactctgggaatatatttccacacatcctggtcaatgaaacattaaatttctaattagaaattttagaagttctaagaaagcaaaaagctcatggtgcttttggaacatagtccagggagatttaacctaatccagagaagctcgggaaaaatttgtgccagactataaggtgagaccgtaaggttgagtcagagagggacagaaggggtttggagagaatgttattggagtgtaggaatagtatgttcaaaaactctgaagcgactataatgtattgtaagataccctgaaagaagttcatgatcgtaggagtggaggcagtgagaagaggtgaagccagactggaatggttcaaaggcaacacttgaaattacctgattaaaataaggcactcaacatagccttaagaatgaaggttattccatttggtattctttgctgaactgcttaacagtatttttatgtttccatgtgctgaattcattttataaatttttttaaaagtaatgcatgtgtttggagcagcattataagaccatggaaatggttttactgtttgtctcttttacgttttttaagaacaaagcttccattttccacttccatctcttggactattcatttaacggtgatctttctgtttcttaatccaggttctaaggattctggggttggtagtttaactcttaatccttttaaaaaattgaaccaatgtatcttttcaatgagaaatagttcataaatcttgctactcaaataaatcatgagtctatatgaggacttcagttgggaattcgtttattcctgttcactagaattaggaaactctatgtagataggagccatctctgtgtttacttactgtctctacagttcccagccattgcctagtatattaatccatttttgttggtataaaggaatatctgagactgggtaatttacaaaggaatgatatttattttggctcatgtttctgcagactgtacaggaagtgtagtgctctcatctgcttctggtaaggcctcaggaagcttacaatcatggtggaaggcaaaaggggagttggcatatcacatggtgagaggagggaacaagggtccggggccgcggtgccgcactcttttaaacaaccagatctcatatgaactcagagcgagaactcatttattgtgaggacagcaccaagccattcatgagggatcttcccccaagccccaaacacctccctctaggcccacctccagcattagacatcctatttcaacatgaggtttggaggggacaaaacattcaaaccgtatcacccgggatattgttgatgaagtatttgttgattgaattaatactaaattttgttggcattacattttattttgactttaaatgctgatgagtatttgatagttcatggttctgtgataacatttaggcttgtagtgaataaaacattacaatattgtttaaatcttttcttttacatttaaataaaagatggataagaatgttactttaacattttatataatatcctttaacaatctgtaggctaatctttagtttatggggcttctaacccataatgcagttgtactgattcttttgccatttccaatttgttgctgtgaccatttggtgaatattttatttcacttattatactttttagatctagagttttctgtttttgttgtttctttttttctcttgagatttattctgtgttcactcactgatagcatatttttcttcagttctttgaatatatttataatagcttttttgaattactttacttgctaaattcaatgtctgagcccagttagagtcatttgtattgagtgtattttttcttaagtaatttcctgaagactttcctgtttgtttttttggggatttttttttttttttttgcatatgtagaaatttctggttgaaaactagacattgggaaacatatggtgaaatgactctgggttctgtcatattcttttgaggaccttggttttttgttctagtaggcaattaacttccttgggttgaaaccacaaactgtctcctgtgaggtattcagcttacacctttcctctgctgctttgttagcctgaacacctataggtcccccttgtatatgcacagtgtggtagcccaaagattttggcagatgctcatcttctttgttgtttctttgtgtctcagaatttcctcctaattgacagtagccatgccagctttgggccctatactctgacacatcaagcctgtctagattcatctttctaccactcaagctgtaaatgattgaaaaatgttctcagttaataaaagaatcacagattctaaaatcttgtttttttttttttctcttcctgctttttcactaggcttcataggcctcccttgctcatgtgtaaattttgttgtcagctaggaatttgtgtagcttgtgctctgaatttgagtctcgtgccttctgtgattagcttggtgctaacatttttcctttaaattttcagctctttttccagctctccactccaagttctagcatctttagccagtgcgatgccatttttttcttctccttttttgtagctgtagctatggagtttggtcagtgccttgcagccagtatgaactctcaattcttaccccttctagttttcaaaataaaactctcttcagccttatgtctgcatttgaaagtttgaagtatcttcaagtagtttgtttgctttaatctagtatcttattattggtatctctggggttttgtatgaccacgtcagtttttcagcatgatcagaagttaaactacttcatccctattgatttcaaatagtacatttaaaacaagggcttctaaacattcaatgaaattcaaatgatgttttagacattaacttacacctcaactcttccaaatttgtaagttcatgtttgcactttgtacttcccttttttttttttttttgagaacagcaaattatatttcagctgatggactttcctcagtttctgttaattacatgtgtgtctctatttagtagtgcatttagagtcactatttttcactgctgcagatatctagacatttgattggaaaatagttcggcattgaacttagtagcaatattgggggacttgggactaaaaagcaccaatcaacttagaaaaccaagccctgtagtaacacaagggaaaaaaaaaattcctgaagccaataccttgggaaataaagataatagaaatgaaatcatctaagtagatggccttaatatttctggacatgttccataaccctcacaggtaacagtggactggcatctgggagacaggacaaaacataaatgtggaatttcaaggatattcctattttctgttaaagttgcaggaagtatgaattactaaagactttacatatggtcagattgctgagtttcagtttcaaatattaaacactctttttcagacgttctcccatttcactctcatttcatatgagttcatattattttatgccccaggcccgaagtgtagataagtttactgctccattgtatactgtttatctgattcactctccccctcttttgccttctggtgttacagagtggtaagcaggaaagcagggtctgtatctatctgtgctataggttcactatccttgccataaattaagttgatcgcttaaaaagtatcactactttagcactagatttagctcgcttttaacagaaatttcatggtgatcttttctcatttcaaggcccttgaaataagggccttgttttctcgttaatggagcatctcattctccttcaacagggcttgatttcctttgaacaaacattattcttaccaataattctgataactttctggtaatttaattgtggttatccagcctctttattctccatcagttcattttagatattcttctgatttccttttgtctttcacaagatctttgaaatcccattttctctacatctttaatatgacctgaaaaaaatgtttgttcaatttatacatcctgccacaaaatagtactctgcttcaaattccacatttatgttttgtctcctctgccacaggtaataacccgtccactattacctgtgggggttatggaacatgtccagaaatactaaggctgcccacttaggtgattttattcttattatcttcattttccaaggcattggcttcaggatgttttttctccttgtgttttctgacttgattggtgatgccgagcattcacacagcttttcagtttctcagcttagaagcaaggaatgttaaaaagttactatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaaaaaggatctagtcattgcttccttataatattgaaaattagtttaaccgtaggtggacatttctttgaaatggtttctaccactaaaaataaaactgaaggtagaggattaggttagaccctggagcaaaatcaaaacagcttatttcagcctaagaacttttttaaagtaaatggcaagccccaaatacctacatatctgtaattttctgagccaccataaaatctgcatactctgtaccaaagtaaaaaacttcacttactgacacaacctttactaaaaagtgccacagactgtacgtaagaatacttttatttagagaagaataaaatacaagctgtctagttcttaatatggtaaaactctctatcctcttacactctgctttcttatttatttatttatttatttatttatttatttatttatttattttgagatggagtctcgctctgtcgcccaggctggagtgcagtggcgcaatctcagctcactgaatgctccgcctcccgggttctcgccattcttctgccttagccttctgagtagctgggactacaggcgcccgccaccacgcccagctaattttttgtattttctttttagtagagacgggatttcaccatgttagccaggatggtctctatctcctgacctcgtgatccacccacctcggcctcccaaagtgctgggattacaggcgtgagccaccacgcccagccaatttgtcttttagttagcctgaataaatttaacctctcagaggatccctcaactcatgtgaaaaaatccttaatagtttctgtcttacattaaacaaaaaggcagacctatgtcacctggagtcataggaccctgagttatctcctaaggtaactctaatgtacattccttaactctgaagctaacagctatgaaggtgaatgccgatagctgctgtaggtttcacagagagactcaatgattatgaagattctgaccgtatctaataacagacaacagataattgtacagtaagatttaggaaaaaaaagtcatttcagttttgaaagttttgttaaggtatataaatgcatatctgttgcctattagtatgatgatatggtagacaaattgcctttgtcaggttttagttttggctctgccattaattagctatgtggtttttgagaatttcagtcactttaacacatgtttatagatggttacataccaggcaccgtgcaagtcattttaacagttatcttaggaaatcctctcagcaaccctgagggtttgacattattattatcatcatcttacaggaaagagaactggggtttagattgagttttttctcaaggttcagtagctagtggcctgcttccaaagcttgtattattttgaaaagcagccagtttctggaactatgtccttaacaagtacttttgacccagtgggaatgaaaggggagtgcagaaagaggtatataggattccagccctcctacttctgcttcagccagagcaattgcctgttcattgttttaatatattgagcttttcaggtaagattttagaggggagagggttctgtagcattaaatgcctgatctcacagtattatgcttcactagaatgaaggggtaaaagtggtattaagctaatataagaaaagtaaataataatcgttggataggcttcaaaaaagaaatgcatttgagatggaccttgacaagcagataaaatcttgatttagttgaaggactccatctggggaaacattaatgaaagtgcttaaattttcaatgctaattaaaatgtttatttttaaaatgtttcctttgatcctgtttttctttattaaataataccctggacaggaattaagagcacagcctgaagtgattgtgatgtccaagaagtactactcatggaacaaatagacaacttgtcatatttcaaaattaaatgctgactgcactatgaatatagaaaagtacagttgtaaacactatattctgtaccatgtaacatcttatgtatgatttcagttctttttaagaccaccagactacagttacaagaaagccaagatcagactgactcaatttgcattacatacatgttcagggaaagcctaattagggaaaacagaaacttcaaatttcactcttttaaactgaataggagagtatcttacatccactgccagaaaatatcaccccagaagtgaaaatttacatgttttaatttctgaaataatgactttgaggaaaacagttagaaattataaaacatacaaattcctatttgtcacactatggagactttggagaatatgattctccaagtatcttggtgtttaaacaaataaaaatatagttcagccaaaaataaactagctcacatgaaaaagctgtagtattaaaaactgctacatcagaaagtcgaagtgagtattcagtaaatttattaacaagatatccctggattaatgattctatctcaagtcaaaaacattttgccaaagtgacagcactaacacctaccaccagtagtatgtagaatcagcttgaccttatttcagaacatctgagaggcactaaaagctggcaaaaccatcttaagagtatggagtgataggcagtaaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgatttttccattatgttcttaccttcagtttattgttcattaagtatttgttccccattacacagatttttcaaaaattaaagcagactcttttctttttatttatttatttatttatttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccttccccccaccacacaacagtccccagagtgtgatgttccccttcttgtgtccatgtgatctcattgttcaattcccacctatgagtgagaatatgcggtgtttggtttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgccacaataaacatacgtgtgcatgtgtctttatagcagcatgatttatagtcccttgggtatatacccagtaatgggatggctggatcacatggtatttctagttctagatccctgaggattcgccacactgacttccacaagggttgaactagttgacagtcccaccaacaatgtaaaagtgttcctatttctccacatcctctccagcacctgttgtttcctgactttttaatgattgccattctaagtggtgtgagaaggtggcaaatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcctgtgcctatgtcctgaatggtattgcctaggttttcttctagggtttttatggttttaggtctaacatttaagtcctgaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagctatgtggcattatttctgagggctctgttctgttccattgatctatatctctgttttggtaccagtaccatgctgttttggttactgtagccttgtagtatagtttgaagtcaggtagtgtgatgcctccagctttgtccttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcagtatgatattggctgtggatttgtcatagatagctcttattattttgaaatatgtcccatcaatacctaatttattgagagtttttagcatgaagcgttgttgaattttgtcaaaggccttttctgcatctgttgagataatcatgtggtttttgtctttggctctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctttgcccggctttggtatcagaatgatgctggcctcataaaatgagttagggaggattccctctttttctattgattggaatagtttcagaaggaatggtactagttcctccttgtacctctggtagaattcggctgtgaatccatctggtcctggactcttcttggttggtaagctattgattattgccacaatttcagatcctgttattggtcttttcagagattgaacttcttcctggtttattcttgggagagtatatgtgtcaaggactttatccatttcttctagattttctagtttatttgcatagaggtgtttgtagtattctctgatggtagtttgtatttctgtgggatcggtggtgatatcccctttatcattttttattgcgtctatttgattcttctctctttttttctttatcattcttgctagcggtctatcaattttgttgatcctttcaaaaaaccagttcctggattcattaattttttgaaggtttttttgtgtctgtatttccttcagttctgctctgatcttagttatttcttgccttctgctagcttttgaatgtgtttgcccttgcttttctagttcttttaattgtgatgttagggtgttaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggtggttcagtttccatgtagttgagtggttttgagtgagattcttaatcctgagttctagtttgattgcactgtggtctgagagatagtttgttataatttctgatcttttacatttgctgaggagatctttacttccaagtatgtggtcagttttggaataggtgtggtgtggtgctgacaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttagcaggatgtaatggccttctttgtctcttttgatctttgttggtttaaagtctgttttatccaagactaggattgcaacccctgcctttttttgttttccatttgcttggtagatcttcctccatccttttattttgagcctatgtgtgtctctgcccgtgagatgggtttcctgaacacagcacactgatgggtcttgactctttatccaatttgccagtctgtgtcttttagttggagcatttagtccatttacatttaaagttaatagtgttatgtgtgaatttgatcctgtcattatgatgttagctggttattttgctcgttagttgatgcagtttcttcctagtcttgatggtcgttacattttggcatgattttgcagcggctggtactggttgttcctttccgtgtttagtgcttccttcaggagctcttttagggcaggcctggtggtgacaaaatctctcagcatttgcttgagcagactctattttcaagagaagtagttgagtcttaggagtctgcagaaactacttttacctctgaagacatttgctaatatgttgatgggatataatttaggaacaattagtgtttacattttatcattttagtttgaatttaataatagcataagctaacactgttatttaatagtgtacgtaaatgctaactgaatatatatgtattcagttacttattctttatatcttacaggcaaaaaagatacaacccatgagtgcttactttttcgggttgtaccttttttgcctgtaagccataaagagtattttattaaaacattaagaaatgttagtctcattaagtagaagagaagaacataattcttatttttaagccatttagtagtgggaattgaatgtagtgttcagaaacgttgcagttagatccactcttaatttttctcatttccttaaatttcatggatatgcatattgagctattttcgtattcaatctcagctaaataaagtagcgcaaatatgcatgactgaaattaccttctataaaaagttccaaaagcatttgaaaaatatcccacgggtgataagtctgtaatattttactttattaaaatgctgtacctggcttctgagtggttatctaagaagaagaaaagaatctacagtataatgagagttaaccatgttttgtccaaaatgattttgaatcaccgttcggacagatcttgaagactagtggaaacttcaaatggcagtatcgaacttctgttccttttggggttgttgagtatatgaagaatattatttttctgtgtctgacagtcggtagctttgacatgattatagtgaagtataatttagatgttagttttaactataatagactgtaactccttgtattttgggtgctgtagaaattacctttccctttgcatgtacgtgacagttaagatctgaagaatcttgattaatggttcttggatttatgtttaaagaaatcaaggatgggcatttttctcatctccgtctttggcatttgaaacagtatacaggttgagtattccttatccaaaatggttggaaccagaaatgtttcagattttggattttttcatattttgtaatgttttcatacacgtaatgagatatgttgggatgggacccaagtcttaacgtgaattcatttattttttatgtatatcataaacatataggttgaaggtaatttaatgtaatattttgaataattttgtgcattaaacaaagtttgcatacattgaatcatcagaaagcaaaggtatccctgtctcagccagccacgtggatactctgtggtgtttggcatcactgtcattcctgactctgaatttgtatgctactgataaacaactcttttattagacttactcacacatatgtacttaacagtgaaaaaaatgagttcagagtaactaagcagcataatagcatcaaacaatggcaggctttcatactttacctacagtgctgtttttgttaaaaggttactctactctgtattttattttttttaggtaagaagaaatattggaaacatttgagagatcaagaaatgggtcctctagggatgaggagaccttctgaataaactatgtcctgtgttcctgcattttgacagcaacccatcacataaggccacttacggaattttctacttgtagtgtcatgtcagtgctcaaaaactttcagatgttggagcatttcagatttcagattttcagattagggatgcacaacctttacaaagggcctttatagagattttaaatatataacttgttgtctactgagtaaaagatgggctgcttctgtttttctcctaacagtattttcagcttctgtactaaccagttccagatgttccacgataaagaaatatttaattttcatatgaaatttatgaaaggaaaatgcataggagggcattttagcaaaacaataagacaaaacagcttttgacagttggtttgctattaataagtacataggagtacacagtaaatggaaggctcatttagacccttagaatttttcttagcagggggccctttacctgaaatcatggtactagttttaaacttcatgttcttttttgtaaagacatttaaggcgatcagctcttttcaaaattaggttaatttttcagaaagaaataatatatcaaataaaaggaatattatggtgggttcagatgaattttaattgaaacataagcaacagaaaattttaagattcttatatgtggaccactttgtataatgtgcctacaaggtaaagattttgtggtcatctgaattttgggagaagtaattttccaagaattaatacttaagctttttgaatcacagttttgtatacccaatttcattatttggttctgtgcgatatagaatgttcaaggctaactataatcatttttgtccaatttgttttaaagagggttcagcagctccaggaatggtataatggtgaatgatgtttccatatcaatacagatctacaaatatgagtatatttgaagaaaagcaaattcatattgaatttaaaggcatataaattggatttcttttccattcatggacatctacttgtataaagaataaaaattacagtttgaatacatccaaaaccttttctcttaccgaatttcaatactcttttctaacaatgtcttagaattttgtagtatatctattcctcccctagataagatctgtagcacacttactctcttcctccctgttactatcctagaatgcttttgtattttaattttagattatttccttttaaaattatgcataaataattatttaaatttagcttcctactttttggacactactattggacaccaccacatctttttttctctggattgatttttttttgttttactggagttgatcatttaataattcttagattgtatctgaaggtattaaactagcctgtttttgcatgactgaaaatgtatatttattctcacttgattgctgattagacttgacatagagtcctatgtttaagtcattttatcttagatctttgaaaatactattctattgacttttctgatattgctaaaaagatttctgatatcaatataatttttgtaccactgtagatgaccctttttcatcccttcgtcctctttctttctctttggaagattttggaatttttatccttggggtttgatactacgctaggatgccatattattaatgctttgcctcatctgcctctccctgcacctctgcttttgtctgaaacccgaatctacctttagctaagggaaattttcttctttcatttctgtgattgctttttctactcagttccgttttattctttttttcagtagctactagaacttctagatctatcctccttttctcttactttatatttcctcattttgcaggggattctgaataatcttttgtctttgtcttctatctcaataattttatctttagctacgtcctttaatttttttttttttttttttcctgagagtctcgctttctcacccaggctgggatgcagtgatgcaatcttggctcactgcaacctctgcttcctgggttcaagtgattctcccacctcagcctccagagtacctgggattacaggtgcacgccaccatgcctggccaatttttgtatttttagtacagacaggatctcaccatgttggccaggctggtcttaaaggtcctttaatttttcattttcttttttaaggctttgtattgtcattattttgttagtcatgtttttaattttgtagcagtcttttccataattgtttttttttgtctgtgtgctatcttttcaaatctcactgagaattacaattatatttaacgttttcctctgtttcttttactctgctgagtgttatttcttcaatatgttaagtttggtgactttcttgctaatttttcctcaagtgtttggtgatttttggttgtttgttgtttgttgaatagttgagagcctaggctgaacagtcttggtggctggagggtatttatttcatcagcccaaatgagaatccctttttacttcttgtactatgtagattctcattacagaagccttcatccaataactgcagggcaaaagaagtgggtgtggctgggcagggtattcccggttgtagaagtttttcacctgggtttcggactacatttccataaattggctgctaccttgttctgtttctctaatctgggactctccatagtcagaaattgcatttgggagaatgtactcctgcttttgttatttattgaccatgagctttgagtttctctgagcctctatagcagactcacactttcttgttttagctgcaggtttctccaatgtgattttgcctttaaactaatcacatctcctctgatttgtgtttgtttacagagcttcttcaaaatttttggtctgcagtggtattattttcctgcactatcattctttcttctttttagtaatatattttatatggaatttgaggggaaaggaaagaggtaaatgtgtcctcattggccatccattcttttttaaagtaaaatggaaaaatacagattttgaaattaagagaactaagagatgatgaaaccatttcaatggagacttatcaacatattatgaagggaggaaaatgtgctgaatattgctgatgtttaatgaatttagaaaggacatttatttagcattagcctctgtcaccaatttattatttttccctgtggaaactaatgactttggagaaatttcttgggtaatgtttattgttagtcatcctgtttaagaacaacttgcttaaggtgatatttttatttcatggtagcaaatggattgttttgacatattcagtgtggacccatttaaagtaggcatgttattttcaaaagtgccatggcatgtcagtatcttgtaaattctaacttaaccaatattaaagaagtaaaccttcatgtactttaatggagatcacaaaaggacttcactgtcttgttctatgcaagatttagtaaaaacagagtattaggtgttatagtaatggtcatgcaaagcagtagctcatctgtacaagaaaattaatggtcttctaaaatggccagagatttgtttataacttcattttaattaattacatttttggaaaatgagttgaatttaagattagaccccaggcttgaatttgtcatattttttataatggtattttgaaacaaagtttgctaatagatgtttaaaagagagtaagaaaatatttacatagggtttatttgtggagtaagtattgtgtctttgtcattattcaaaaatagaaaaaagttgtgaagcaacatgttctctttgtgaatgttgaaaattactaacagatctgtgcgattggttttgtatgccttgtgaagacttgccaaatttgattttatttttctcttttacttttttctagtaaagccaagtcctacttgagagacatcagtagcctatggaaatttgttgcttttctttgaaaagtgcacctgcatccaaaactgagtaaaaacatatttcaggaagaaaactataactaattaaatttctcagtactacctaatttgccaatataactagttttggttaaaaagaagttgattataatgttcataactgtatattgaacagaaaaactggatgcaatcagaaatcataggtgtagtcaaggagatgaaaattgtagatgtgaccgttgctatttgcttttaaggtttcctaatcttgcctagcgtaatgactgagttttatgggtatttggaggattttcttgttccaggtggtggtcgtcctccttattttattttttggtaaggctaggagtaatgtagatgtgtattcttctcataacttagtaaaactcttttatcaaattggtcagtgcagcctgcagctggggacttctaaaaacatgttaccatgactagaaatttttatttcagtgcacttacttgacatctttctggttattattgaccaaaacacttgactcctgcctcttctttctttttatccattttgttgtccttattttgcatatttttgcatatgtacagatttctggcttcctcattcctatcaacaaccagaataacttttagtggtctaacttgtatcttcacttatcaacttaaactgttctttttgaaatgttaccagtgggttcagtgctcctgtctctgttctctgtctctggatctctcttcaacctttggttccactggccagccattcttaactgtttcggtttcagaaatattttttccctttagttttataataataattagctaatttttcttgagcacttactttgtatctttgactattctaagcactttacatgtcatatgatctttaacacaatccttagagatctaagtttgtattattttttccactttcagataaagaaggtaaggcacagagaggttaattactttgtttgaggccacactaataagtggtagaatcaggattcagacacaggcagtctgactaaagagctggtacttttcctctttagatgctatactattctgatgagtgtctcctctcatctttttctgtttggatctagttgtgtatattttcatttgccctacacttacctggttaggttaaaatttctacatccctcaaaactgctgaagtatcagttaaaaatatagttttcaacagaatagaagtttaatacatgttgtgaaccaatttcttcgtgttgccttttgaaattaaatttaaagagagcagtcattaatggctcaaagttagacctaagaggatttataggtgatgtgtatatgtgtttttgttttatccatcattcttcagtttcttaattaccaatactataccaagacaaatgcctgcatttcatcattaaccattaaaatatgattttcttagagttgaagattgaatttagggccagttttttcaagtacattaattatgtttaaatgtgtaagtctactcattataaaagtgaattattttgtaagtgttggttattaagtctgtgtattcccaagattttcagtctgaagtgagctgcagatacaatgcctaagcattttgtcctttgtattttgtaccagcaaaatgaaaatcattttttatagcctcattactcattcccaaaatgacctgaggtaccagttaggtccatttgcacaatatctggcaatatttctatgtcaaatatgttacaatctggtatttaaaatggccactgtaagtattatcaggcactattgttcctttttaaaaaacagtataaaatttgaaaacagtgctttggaaattatgtctttagtggctgtaatataaatggttaaccttacaaagggaaaacatgaaattgtttgaaattggtttatattggttgtcatgctaaacatattttttaatagtttgcttatttggtttgatattggttgtcatgatttaaaatgctatggttgtgtagaagttcttcacgaatatataagccgtttttacttacacatatattttagaaaatgaatagtttatatttttgctgttggaggactttttaaaaacatctatgaaacactaagatacgtctgaattggagctgaggactaagctctcatttatcttgcccaaattcctacataagggatctagagagtcatgccctacaaaccataaattctcatcagatgggttttatttgaccctatgtatcatgacttacttttcaatctgactctggcataacattacgagacaaggaaaaaatatttaaccccaaaatatatttccttgccataccttgaaattgccctgcaaagtctcttgtgggaaaaatccacatcttatagagaatcccctttcctctttgttttccttcctttctttccagatccaggcgataatcaactaagagccaggcacccttttaggtccgataagaaacattttacagcctgctctctctctgaagtctgctctctgagagattcctctgcccaataaaacttggtctccacaatcgtttttcttaacttgaacattcctttccattgatcccaggtcttgagataaactcgaccaattgtcaactagaaaatatttaaatttacctatagcctggaagctccccgcgcccctactttttgttctcctgcctttctgaaccaaaccagtgtatttcttaaatctatttgattgatatctcatgcctccctaaaaatatataaaaccaaaatgtaccccgaccaccttgggcacatgttctcaggacctcctgagggctgtgtcacaagccatggtcgctcatatttggctcagaataaatctcttcaaatgttttacggagtttgactcttttcgtcgacagagcaaaccgtacttcctgaaaagattaagagttagacagctagactttattcagagtgtgaacctatgtacctactatgtaaaatgcaagagctttagagcctttaactaaaggagtggcccctaaatcaagtcaaactcttctgtttcccaactacctcttgctgtataggagccatctggctctgctttctcaggtgtacattcttagaggaattttagtgattaaagtacaggccttggtgctgggggaagaaagagggttttcttctgcaggtttgttaaactgtaattcaggtcaaatttcgaatatacgtatgaaggcacaaaagtgtttaatattttagtttattccctttagtagttacaaaaattactgcttagtgaaaacttagcatcaggatatcccttcactaaaatctaggtctgtaatttgacaattcatttcacagcacctgacattactgttacattcactgtagcacttagcatgcaaagattatattttctacaactctcagtctcctctgttattggatgatgcgagcgcattaactacaaagtcacgtaaaggtcaagtcaaggcttaatttgaaaacagaagcctgagacccatccgtttacataacagacacagcactgtggtctcctgtgtgactgttaggtctgagcactgccccatattgctaatttctcacattgcttttcttaacattttttttctttaggagcttgatggagagatataccatttctgtcaggttttgcaaaatgtcttgagctccttgaaaaatagatgtcatgtaaatgcaaagtacggtcagttcttttagcctaagacattatttgatttttatagcaagtctattccatgtaaatgacatgcagtcatatagcttaccatgaatacgttcatgtcctaaaaatctcagatactgcctatattcagagtagctaacatttaattttgttttcatgtgttctttgaaaagagtagggaaaatgttttttatattattatggcttaatctctggatttggtcaccagtgaaatgaatttcatagcctcattctattacagacattttgtctgcttcgcaaaataacacaattttgcattattggtggtctgtgttcaagagacattacatctaaagagagctagaaattgcaatttaatactaagcaatgtgatgtgggaaaggaggccaactctccacatgctctttctgctagagcataatattctgcatattgacttttttttcactatccccaaaagtcaggatttttcattaagttctgataatactgttgaaattgaccttgattattcatgtaaagggcctctcagacaacctataggtatgagaatagctttcagaattgtaatcatatttaggttatatttaagcagtgatgttacacacttcccaaaaagtaatttattgggacatttacataactctgtgtacttaaatttatctacttattgcttatttaaaacattacatatgagagtttgtgttttccttactcaccattttccatacggctttattttcctcttagtttgaaaacttaaaaaaaattcaagttaacaagcatttattaaacatctgttgtattcaaggccctgggctacgtacatgtggaacataaaaaatgatgatgatgacagtgattgcaaacacttgcaataagtcctcatattgctgtcaagtaggtgctgttgttatgccatattacaaatgaagcagatgagccatagaatatttcataatttgctcaaggtcacacagccagtgatttgagaagactggcttaaaacacatgcagttcgacaccagagatgacactcttaaccactgtgctatactaaaatgaagacaagatcctacccttaagaacctttcatcctactagaaaagtggtaatacatattcagagaaaaaaacaaaaagaaaacagtaagtcagtatgtgttaggtgctgcattactggctcaaatatggaagacattggtgctcagaaagagatgtatttcttttgggaggtggggaaggcctcctggaagaagtgttttagctgacccttaaaaaagcggcaggattttgtcaagtgaagttaattagaggaagaccttctccttaagggggcaatgagaacaaaggcattgttttcaggaaaatgcagtgcccaaagttaatttgactatatgaaaaagaaaaatatttatacctatgcagacctttgaatgtaatgcatgttttcatttaaaattagaaatttatataatttttgaggtattatggatccaaattgtagattttttaaaggttaagctgttatatttttctttttaactaaaggggtatatttcaatggaaaggagttgcccaaactgaaatccgcagcgatgctaaggaataacatttatttcatatgaaaatattgtaaaatattttatggatattgttttttacatctaatcttaacattatctgtaagctgaactttgatgcagtagtagtaaacctactttctacaggaactacttctattacactctttaatttaaatctctttccataacctgtcaatatttaaagtacaacaaaagatagttgcactcagaataaaaatttgttttcacagagaattttagcccattatccctgatgaacatcgatgcaaaaatcctcaataaaacactggcaaactgaatccagcagcacatcaaaaagcttaaccaccatgatcaagtgggcttcatccctgggatgcaaggctggttcaacatacgcaaatcaatgaatgtaatccatcatataaacagaaccaaagacaaaaacgacaagattatctcaatagatgcagaaaaggcctttgacaaaattcaacagccgttcatgctaaacactctcaataaattaggtattgatgggatatatctcaaaataataagagctatttatgacagacccacagccaatatcatactgaatggacaaaaactggaagcattccctttgaaaagtggcacaagacaaggatgccctctctcaccactcctattcaacatagtattggaaattctggccagggcaatcagacaggagaaagaaataaagggtagtcaattaggaaaagaggaagtcaaatggtccctgtttgcagatgacatgattgtgtatttagaaaacctcattgtctccagcccaaaatctccttaagctgataagcaacttcagcaaagtctcaggacacaaaatcaatgtgcaaaaatcacaagcattcctatacaccaataacagacaaacagagagtgaaatcatgagtgaactcccattcacaatggcttcaaagagaataaaatacctaggaatccaatttacaagggatgtgaaggacctcttcaaggagaactacaaaccactgctcaacgaaataaaagaggacacaaacaaatggaagaacattctatgttcatggataggaagaatcaatatcatgaaaatggccatactgcccaaggtaatttacagattcaatgccatccccatcaagctaccactgactttcttcacagaattggaaaaaactactttaaagttcatatggaaccaaaaaagagcctgcattgccaagacaatcataagccaaaagaacaaagctggaggcatcacattacctgacttcagactatactacaaggctacagtaaccaaaacagcatggtactggtaccaaaacagagatatagctcaatggaacagaacagagtcctcagacataataccacacatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcgagatggattaaagacttacatgttagacctaaaaccataaaaaccctagaagaaaacctaggcaataccattcaggacataggcatgggcaaggacttcatgtctaaaacaccaaaagcaatggtaacaaaagccaaaattgacaaatgggatctaattaaactaaagagcttctgcacagcaaaagaaactaccattagaatgaacaggcaacctacagaatggaagaaaatgtttgcaatctacccatctgacaaagggctaatatccagaatctacaaagaacttaaacaaatttacaagaaaaaaatcaaacaactccatcaaaaagtgggtgaaggatatgaacagacacttctcaaaagaagacatttatgcagccaaaaaacacatgaaaaaatgctcatcatcactggccatcagacaaatgcaaatcaaaaccacaatgagataccatctcataccagttagaatggcaatcattaaaaagtcaggaaacaacaggtgctggagaggatgtggagaaataggaacacttttacactattggtgagactgtaaactagttcaaccattgtggaagacagtgtggcgattcctcaaggatctagaactagaaataccatttgacccagccatcccattactgggtatatacccaaaggaatataaatcatgctgctataaagacacacacatatgtttattgcggcactattcacaatagcaaagacttggaaccaacccaaatgcccatcagtgatagactggattaagaaaatgtgacacacatgcaccatggaatactgtgcagccataaaaaaggatgagtttatgtcctttgtacggacatggatgaagctggaaaccatcattctcaggaaactattgcaaggacagaaaaccaaacaccgcatattctcactcataggtgggaattgaacaatgagaacacttggacacagagagaggaacatcacaaaccggagcctgttgtggggtggggggaagggaaagggatagcattaggagatatacctaatgtaaatgacgagttaatgggtgcagcacaccaacatggcacgtgtatacatatgtaacaaacctgcatgttgtgcacatgtaccctagagcttaaagtataataataataatttaaaaagataaaaatgcttaaacagaaaaaaaattggtttttactgtcatgaatttttcccacgtttatgtttattaacaactgacacaaacaaaacctgtacagaaagtactctttattatacactttatttcaaagtactgaaatagtgttttatgatcatagtatttctagaggaaagattttctcccaagcctttaaggggaaagctaatccacttggagaaattttgggccacccaccaaacctgtgatttcctgccccaatttatgaaccaagttatactgagatcgttaaatggtgtgatttctccttatgactttcacattttactttataggttatattgacttttagatttcaggtagtaaaataaaaaatcttatgcagttcaagttagaaaaattggattagtccaagtgatattttcacctggtattttttttcaggcatttcaatgttactttttattacatttataaaattatatgttttaaattgtatggttttcccttatctttttgaaaaataccatactgattcatctcaaatattttagcctcttcttaagtttccctttcccctcaacttttccgtaagcgcacaaaagaaagtattgatttttgccaattattttggttgctgaggttgtaagccatcttggtttgcttacatgtaggttattaaagtacccttcctagtctgacttgccagtcttacttctctaccttttgttagaggaataagggatgaggatgagagaattaatatatattttttaccccatttctgcatattttaatcccatctccagaaaccaggttaatttcacctctgtcacaaatttgaaaggaagggaaaagatgtattaattgccatttttattgttattttctgactttcaagccttctaatctaaggttagtaaatggacagcatttaaaaaaatattcttgttatcttgacataatgaagaattatgtttttgagtattttgtccattgtttcttatttcctactttacatttttatttacagcaaggttttatccttttactaaagggaaggagatgggatgaatggcagactttaactggatgctttatttaggcttttcgaaagcaaaaaaagtttatacattgttacagctgggtgttgggttacaggctgtttgttatattcatgtattagttcctgttattttaacattttaaatatttcataattgaaaaaggaaaaattagactgggaccagtttatagaaagctttaacttctaggcaaaaaaggtagaactttacagttggttgtggagaagatattgactgtcttttgtagagagtagcatttcgaaaaactgaatttggcgtctgtatttagaacggtctagagaatggagatactgatgaaaaggaatgttagcaaattcagcattctgatttctgaaaaatgagtgcttagattaggtagtggcatggggactagaaagaacagggatgctgctgctttgtataatcattcccattatataaaggttatatataaattaggacggacacggtggctcacacctgtaatcccagcactttgggaggccgaggtggatggatcagctgaggtcaggagctcacgaccagcctgacgaacatggtgaaaccccatctctactgaatacagaagaattagttgggcttgatggtgcatacctgtaatccgaacactacttgggaggctgagacaggaaaataacttgtacctgggaggtggaggttgcagtcagccgagatcacaccattacactccagcatgggcaacgagcaaaactctgtctcaaaaaataataataaagattatatataaataaataaaatcacaccatttaacaatctcagtataacttggttcataaattggggcaggaaatcacaggtttggtgggtggcccaaaatttctccaagtggattagctttccccttaaaggcttgggagaaaatctttcctctagaaatatatgatcataaaacactatttcagtactttgaaataaagtgtatattaaagagtactctctgtacaggttttgtttatgtcagtttttaataaacataaacatggggaaaattcacatgatagtaaaaacaattttttttcctgtttaagcatttttatctttttaaatttttatatatttaatatataaaatatatataaaatataaatatatatttatatttatgattatataaaattcctatatctttatattatcatttccataaccattttagtaagcatccccaaatagaagttagggtgtattactaattctgcttaatatactttgtatacttttgtttcctatctcaaatctagtttctattatgtaagtataagtaccctccatgaattgggttaacattctaaaccatgaccagactgagagcatgacgactaatgtggtttttactcctaagctaccagtatggaagatcaacatttaagaaggcattagtcatctgtgctgctgaaaataatggtttcacattagtctggaccaattagaaggagcctatgtctacttggaagagtttgatttgcagcatagtccttggctgcttctacaagacttggcaaacttttgtttaagtcagaccctgcttaaatgtctaaaaggaaactcttaggccattatttccccctactttacataatattgctccatacaaacattccacttttacaaaatcatttactttttcccaactctgtgatacaaatgagttatcttttcgtaaccaccaacctctcagttttatatttgttagctcagatctgacatgaaagtaaaaattacttataaccactttgggattacacaaatttaacctgttcccatgttgtattcagtcctctgtgaaatacgagggtacttcaaaaaggtcaaggaaaaattgaattaaaatataaaaataaaagatgcaaattttatttctcaacataggctccattaaggtcgagacacttttctaagcgataataccagccatttagtccatccctcatttcttttggaattgaggaatttagccatgtcagtgcagtctttttgtaccttactaactgaaaaaaatgggtattctttatagatatttttaagatcaggaaataaaaagtcagaggaggcaaatcaggtttgtaagggggatgcttaatggcttcctattgaaactcttgtaaaattgctctgtgtgattagaggaatgagcaggagctttgtcgtagtggaggaggactctagtgaagctttcttaggtgtttttctgccaaagttttggctaatgctctcaaaacactttcataataagcagatgttatcattctttggcctcccagaaagtcagtaggcaaaatgacttgaacatcccagaacactgttgccatagcctttgctcgtgactggaccactttcatctcttggtagccattgttctgactgtgctttgtcttcaggatcatactggtaatgccatattacatatcctgttaccattcttggaagaaatgcttcggaatctttatcccactcatttaaattttcattgaaagctctgttcttgtctgcagttgatctgggtgttgtaagagttttggcatccatctagtggacagtttgctgaacttatttctcaatcacaatcgtgtaagctgaaccaattgagatgtctgtggtgttggctctggtttctgctcttaatttcggttctcttagggcatgaacaagattatttttttcctctcaaatggatgtggatggtctgtcactgtgggcttcatcttcaatgttgtctcgtcccttcttaaaacaagttatccatttggaaactgctcatttcttttgggcattgtctccatcaagtctttataaaacatcaatgatttcaccacatttcacccacaattcatcttaaatgtgatgcttgttcttgcttcacttttagaagaattcagtttgctctgataggggctatttttaaatgaatgtcctatccttcttagtgcctcaaactagatcctgttcagacatactgtaaaaagttagtatattttggtgcaaaagaattttgaaatccatgcatagttttttcataatatgcatttttcatgagctttttgaagaaccctccttgtaatgtatcttaattccctattccattaaatctatgattttgaaccagccatatgtgacctgtaatcaaaaagtgatgtttgatagatgctgtcaccattctgtcatttttcctcatccaagatagaagatgtcttcgaaagctttgtatatgttccagtcctataaaacaattctacaaaacaatttcaagttcaaaattattattgagaacttttaaacaggatatttagaagtttgttttattaacttggcctaggtcacaaaactcattaatattaatgactagactacagaggcatgtagcctgtctaaacattaacagatacaaaacattaaaccaaattgtgaagcttcgttatgctatgagtcatttcaggcaaagaccaatatagcaagcaaaagctgaacagtccagttgaaatgtttctgatctaagcctttgacttctgtttgtagatgaactggagttttgaaactgacactcaaattttttattgacttcatatgaataaatgattcattaaaatataatacttggaactaaagtcatcattcaaaaaaggcatttattattaataaactacagaaaagagaaaatttgagggtacaatttactttttttaaagtatcttaaaattgcatttattttctcttagagaactttagatgatatcagtcattactaatgtcataaaatgtatgtaaatatgagctaagtgatgtattttatttacccaaagatatgatctaacagcctctgcaactgtcaccaacctttcctataaaacagcaatatattaaatgatagtgaagagggtctgaaatttcaaccttgagatgcacttacactgtattcagtacagcagatttatacttctacttatatatcaacaacaggtctttctaactggcaagtcttgtggtaaacatgagaaatatggatgcttattaggtcacttttggtaaatagaactaataatttgagacatttgtctacaatagagtttggcaaactttcttctgtaaaacaccaaatagtaaattctttaaatttgcagactatacagctctgctgttacaacacaaaagtaggcttagacactatataaaagaatgagtgtggctgtgttccaataaacctttatttacaaaaactgaaagtaggtcagatttttcccaaaagctgacagcaggtcacacttggcctgcggactatcaatccctgagctacatttgcttgattttcttactgtatactcattcctctgttcagctgggcttggcttttccccatcactgcaccaaaatacttttgccaatatcagtaacattctcatcattgaattaaaatgaacacttaccagtccttgtctcatttggattcttgggagcagttgacattctaatcaatctgtccttaaaattttttctttctttagtgtccctgacctacctctagtttttaacccacctctcaaggcagtctcttaattattggtgtgccttaaggatttattattgatcttcttgacacatttgccttaagcagtactttgtgttactatagctctaatttctgtctgtttttctccctcctgagcactcttaagtattaatctgtagcccagattcctaatttaaatactgagtttgtacatctaatggcctgctggtattttctacatgcttatccaaagatacttggaaatacctgtcttaaactgaacttgaaattcccaacctctatttcatccccaagattacttccctcaacccccattctatctcaatgaatggccctacccatctttcacttgcccaaggcagatacttgtgcttcatctttgattcctaactcttcatctcacccatgtctttcattgaaagaatcagttttgtggatgtacctccaaaatagctcttaaatctgtatgtgttatagtctgttgcttctatgctagttcaagccaccatcatcacaaatttaaattactagtagactgctctgcttttccctttcatgttctcttttgctggtgggaatatcccccatcctgctttattcccaataatttatctttcaggtatcagattagatatcagttctactaggaatcctttattgactccagaatgtaggtgtagtgtttgttctctgtgccctatactttgcctgttagggcaaagtatgtcattttgtaacctcagtttatttgtctctattggactcgtaagctcaaggaaaacaaagattgtacacattgtcttcatcattgctgtaaccccaacaccctagcgtgttgctcgtaaatctatgttgaaaacaagtgaaattagtctcaatatccataaaatacaccatgttctgtataaatcaaagcaccagaacatatctgatggcttaatttgcactcaaagtaagtatataattagaaagttgaataaattaatgaaataaagatgtcatacttcacaaagttgtatgtagaacatcagatcctaaatcataaggcataaactgctaatggccagatttgcttcaccatatgttaatgagcgtacaagtaatcactgtgcttataagtaatataagtatcccctattcttatttaatcctggctccttttagagggaaagtaaagaaataaactgaaaaaaaaatgtatatatatatatatggtactacccttgaccttaaggaacacactatgttttggaagccttcattgtaaaatgatcgtaagtactaacacaggtattcttactgtgctgtacagcaccaaagcaagcagcaggtggataggagggggagaggaaatcaggcgaggttttgcagaggaggtaacacttcagaagagtcttaaagtatcagtaagacattgccagaaagaaaaataaaaattaatttcaaataaaatatatataagcatgtgaagcatgattgagaaatatcttcttttttttcttcttttttgagatggacttctgcttttgtcacccaggctgtagtgcaatggcactatctcaacttactgtaacctccacctcccaggttcaagcaattctcctgccccagcctcccaagtagttgggattacacctggctaatttttgtatttttagtagagacagggttttaccattttgccaggttggtctcaaattcctgacctcaggtgatccacccacctcagcctcccagagtgctgagattacaggcatgagccaccatgcccagccgtatcttcttaattgtcaaaggaaaatcaaagtgtgttagtagcattatcatatattatgtttttgtgtcatacatgatttttttattctaaattttaaaatctaaccttaattcagttatttaaattaagatacaagccttgctaaacagaatttttactgatacatgctacaacatggatacatctcaaaaatattatattaaatgaatgaaactggtcacaaaagaccacatatatgatcccatttaaaattgataggatttccagagtaagcaaatctgttagaacaaagtagattgctggttacctaggaccgggagaggagggagcagggggtaagacaggagagttggtggataataactaaaggacatagggtatctttttgggatgatgaaaatgttctaaaattaattgtggtgatagttgcacaactgtatgaacattctaaaaaccattgaattatgcactttaagtgggtgaactgtgtgggacatgaatatttccataaagctgttaccaaaaaatataagttaaattctccagtgttgttattttcactaagttatgaaaaaaacccatgttccatcctttatttaggtatcattgtacaaactgaactatcagctgttgctgcattgaattcacagtagtacacaatagacatatttcaaacataaaataaaaccttattagctccagatatactaaggattatagaaatatatcaactcatttaaaccatgtactttttagaatatgcatcatttgttcacttgattccaagaagattttgtgaatcataatcaggtaattaggttagcagagaactaatgtgcatggaaaaatgaactccagtttttatcagtcatatttagttggaagagcctcattagaggttaaaattttcttctggatagttactgccttaaattaaccacatatcttatcaaattagttattgtacctgcctgtctttaggaatttggttccacaagtgttggaggtaaaatagcatgtttcctattattatgctgcagtttacaatggattttcagttgcctgttgtatgataaactcactgcccttcataacttgaggtaaatgctgaacttgccctttttaatttgttgaaacagagcttccattcactgataagaagtgtaaatttaactaaattgtcaaattaacctcatttaggtgcacacattggttctcttttccttgaagacttacgtgacagcacaagatagagaaaaattaagcctgcacatgttttcagttacctttttcttactctgtgaattacattaggttatttcattcaggatgccaaatacatagtagctcctgaaagtacaaatgcatcatttaaatttctgtctatgaatctaatgcagtcattttataaagaaaagagaaacctaaatttgaatgttgagatcataatctttaaaactacacactagaaacaatagaatttcaatttattgtttaaaatttacccagaatccctcagccaagatagtaacacatgtcttgagaagttaaataatgtacctattacaaatgatgtttcagtcatcagatatgtacttatccttagaataaattataaatacttagaaaaatataccattacctatagtattgagtacagaaaaagctccattgtttttagctgtcaatgctcttttcaacctagtttctcactgttaaaaaagcttcaaataatcatattcaaaacctcttaacttgctgattatattcagcaaccatagctaaatatttcagtaccaaagctgaaaaatcataatggcatatcagcacacacataataaattatggttaatgaatactatacaaggtgtgttttgattggctccaagtttgtgatctgctcatggatagcacattgtatttttaagaggaaggaaaatatagtgatgatatgactgccaagcatattgctttacactgaagcaaagtggtattttagccaaactcaaaatgtaacatatagacaacaagtcaagtgacctaatagccaaaatgaatatatctaattaaacatttcatgaaaatatttcatgcgctctcttatacgatttttatactgaataaaggtttctggtcaaagacagtttgttatgttgacagctaaaactgttgtatgttttagctaaacatgtataaaacacaaaagcatttgccttaaccagcttgaggtggggaccttcaagtgtgaggtgctacctttttaagctaactacagaataaatacttagagtgtaattactatttagcccatatattttctgagtaaacaagacttataagacctgtaagactactaccattggggtcaaatactacaatataattagaaaatattgaaatcatttagacaaaatccacttattctgatattttccatatccaatatttttttccttcaggggaaaaatgacttgatgtcaactgaactatactaaaagatctagctaaatgaaatcactggtgtatgcatgtatgccctaggatgtgcatgcatgcaattggaagcactgttgggagaacacaagagacaacatgaaaaaagacccagagagaagtatgtaaaaccctactggtacttccgtactgcctggacatgcagtgcattaagaggatattgagagatgagtccgtaggaatcatgggccagagtttggaagtcttgaatgctatgctaacaagtttagagtttttgctgcttacattcttaaataggtaatcattttgttaaactgtacttttcaaaaattaaaagttattcgattgatttaacactgggaaaatgccttttgttgtgtattccatgtatttgttgcagttgtccttttgtaacttttatcaaactttgatgtaagctcaggagtttccgtttgcccagtgcccttcttaaagaatggggacattcctgtgaggttttggaaactgctggactgcataatattttaatgaagtctttggaatcacagggcttgaggtagcaacagagatcagctgaaattcaggtgaaaatgataattatgtagtatattcactggactaactttttttatttgtttcatattagaattttaacctgaatgaaacctagctttttaacttggcaatggtattgcattgatgtttgtaaaatgctcacagtggctgtgaaaattttgttggtctaattggtgtaacagatacaaagagatttgattacattttttcagaccatttttgagaaattgaagactttaaccttgcattacctcttattattaagacagtgtgacaccccatccgctatatttatcaaaataccctcagcaaagcttttaaatatttctgtatagaatgagttactgaatggaagtaattgtgcaaactgattaggacataggttctatgtattatcttgatatacaggtgaaagtgctatagcgatctgaagttaccacagtaatgcaatggcaagaacaatgacatgtttcacttttatgtattttatgagttatttcaccgttatgggcgccattttcctcatctattaaataagaggattgggcaaggatactgctgaagtgttttgttactgacatttcgtggttctacctacttccattcactagtttaacttgcatacataggtgtacttttcaacattcttgaatcatagaattggaaagaatcttgggtagccaggctgcctcacagaaaagtagaaatttattcattcactctgcctaggatgctttgcttgcactttctcaggctggtgccctttgagccagagctggttgtgacatcaattattatccctttggttgccaagattgatttcatggtttggagagatgggaagagaatcctattctccctcgttgccccacgtacagttcttcccaaatttgggagcttagttataaaaggcaacctgcagacataaagaaggatctttctttggttaaacgtctattccttgccatggtacattcatctttgtatcatgagcacttttctcgggcagcacatgttactcttaaatgtttactgaatgactgaatatagtggatgacaaaaatgactaacagttgtaaatgtaagtagagtttcatggtttatttagcctatggtggagctgaaattatatctctaggtttttgaacaatgatgcttagtaaagattgtcaacaaataataatagagatattggaatatgtttacaatcatctataattatattgttatagagaatatatctgtagacatatttaataaatggtgcctaatgagttttgttttataaactcattcagtaagacttgaaatattatttacattttatctctgccttttatttctgtaactaagaagaaaacttcctctttaagtacctaccaaagtatttttacattcaacttggacaagagtttagtactatttcttttactgaaatattctatctcctgattttctagttgaaaagataattgcatcatttctaattctgatatccaatttaaggtttaaagctaagcaatgtaaatttggtttaattcttacctagtttatatctgtattatttagaggatatttctgcttgggtaatttgtgaagaggttaatgcatttctgtcttgaaaaatgtatatgtgttcctaattcctaactaatgggaaaacagagggtatttttagtgtcagctttcatcaagtcagacctttctgaagaccttactgaattctatttccatgggaattttgctaatgggtatgtgcaacattatctaggtactcatagataggattacaaattaaaaataaaaaggaatgggtggtgaacaaacacatctttcttttcttttaagaaattgacagaatattaatctttgcactttcattttcactttcgtttcactttgcattgtttttagattaggtgcagaaagtccaagtttggtactaatgcatgagatcagcatagacaatataagtaatgcatttattaaggaagttcttagttgtaatcttatatgtacaagcagaagagagaaagtcttccagtttctctatatttagttaacaatattagtgacttcaatgtgttttacaggaaaatggaaaatttaaaaataagccatccagttgtattgcctgtatactcgtttactgatttattttgattcatgtaatgcatgtgcactgtacatgtcaaaatactgtgcagaaaacgttaatgaagctggtgatattcaacatttattgaacacctgcataccctggatattggaatttccttatggctcagcctcaggctacctctgttttcatactactacttttttttggtcccatgtgatctgggaaaataccttcttttcctgggcaatttcatgtactttcatggttttaaatatcatcaatatatcagtgactcccaaattctcttttctggctctccagacatatattgtcaaggaaatcttgcagatatatcaagctaattgtgtctgaaactgtactttggatcctgcccttcttcagatctgcagctcttaagaatttctaatctcactcagttccatccctccagcttctgccagaaacctgagagtcatttttgactcgttttattttttcactacccttcatcccaattcaagtctgtcatcaagtgctgtctcatctacctctaaacattacctcagaatttttcacttttctctgtcattgctgccatcacatttgatcaagccactgtgtcttgcctggactaatgtagtttggagaaactccaaactggtttctccatatacagttcagccagttctaattcatttccaaataaaagccaaagtaagttcttaaatatgtaaacataattatatcactcttatatctaaaactctataatgcttttacattgctcttatgataaagatctcttttatctatcccagaagaggtgtttggtcttaaattagcttcctagggcgaccataacaaagtaacacaaacgaggtagcttaaacaacagaaaattattttatcacaattctgtaggctagaagactaaaatcaatttggtttcttctaaagcatctctccttggcttgtaaatggttgtctttctctggtgtctttgcatggtcttccttttgtattatctgtatccttgtctcttattagggataccattcatttggattaggggccaccctcattgactacattttaccttaattacctccaagctctgtctccaaacaaagtcacctcctgtggtactaggcgttaggacttcaacttaaaaattttgagaacacagaattcagaccataacagagcctaaactcatagttgatagacgaggaataaacatgtacacataggagcagagacttctggtgggttttgtgggaactaagcaagttagattagagaagattctgtagaaccaagaatggaagactaagaaaaatgttatcctgctttattctcccttaagcaggtatcatttgcagtagcctccaaaacatcttacatataaatgcttttatctcaagaggaatcatgcaatactgcagatgactcagtaaaaatccatcacctctcctacaaaaacaaccattctacctacaacaaaaacgatgacagcaataaaacaaaaactctaccttatttactgacttcatctttatgttttaaaacttattcatttgtatggaagggtgtgtatgtatatcaatatcttggcctatctagctatcacaaaataacaactttttttttttttaagacagtgtcttgctctgtcacccaggctggagtgcagaggcacagtcttggctcactgcaacctccacctcccgggttcaagcgattctcctgcctcatcctcctgagcagctggaattacaggcacccaccaccacgcccagctaatttttgtatttttagtagagacagggtttcaccatgttgtccaggctggtctcgaactcctgacctcaggtgatctgcctgccttggcttcccaaagtgctggtattacaggcttaagcctcaaaataagacctgttattttgaggcctggcctcaaaataacaactttttaaccaaatctgatcaatgtttcgtattagtcttactgcataatggcagtatccattgatactgctgttaaacaaccaataaaaaatccttccagaaataatttatattacatatccagttattatattcctttgaaagaattcctgttacaattatcagcaaaggccaggtacagtggctcatgcctgtaatcccaacactttgggaggctaaggtgggaggatcacttgagctcaggggtttgaaaccagcttgggcaatatagtgagaccctgtctctacaaacaataaaaataacttactgggtgtggaagcgcacttctaatcccagctactcacaggctgaggcaggaggttcgtttacacccaggagttagttcgaggctgcagtgagctgtgattataccattgcactccagcctgggcaacagagcaagaccccatctcaaaaataaacaaacaaaaaagaatgatcagcaaatttaatttctttaaaatcttttaacctaaaatccaattttgcattatatgaaaatatccttgtatctggtttctggaagaatggagatgtaatgtcattaacttttatgctaaagacagctatttttaaaaactacgcacagtatcatctaaaggattgtatgtgtgtgtgtatgtatgtgtgtgtgtgtgtatatatatgtatttagatagatatactttggtttaattcaagatagttttggcttatggatgacaagatgtggatgtgttttcataactcacagctgtcgtttatgccataagggtaattctcttcttattcagtatgacataatatgctacattttattatccagactatctttctgactctgaggaaaaaaataggtccaaatagtcaaattccattatctaatgacagtggtaggcaggaagcacatggataattatatatacattgtcagattcagcctatgaaactactttaaccaggagtttctacattttccaccatgaagtctgttgttagagttgctactgataactaagatgacaggtctgaatttcattttattttctctttttcttcccttaacaaagatactaatgaactatgagttgactcataggccagaagtatataaaattaaggacgaaatatgtagagcctagacaatccaaagagaagcacctttaatactagtaattgaactttcattgaacttaatgcatttcatatatctttgttgggtgggggctgcaactggtttgtgttcaaactgaagataaattgtttgaaaatccacttaattgatggataaaaccttctgtacattttatgacaggtaaaaaatgaagttagttgattctggttttataagcaaacttgtgacttcctagttatagtcctaaggaaagctgaatgtgttttcctcctaaaaatgcaatgactccagggtagcttttgatcaaacccactcctaatatttgtaagacctgaaacaagagtaaaaatggagacccatatcatacatgtaaatgtaaaagtcatttaaaaagctaccgaactcttaaatgtgctctatactccttacttgataagataacttcttgatatcttggaaagacagatttaaatttaaaatttttggactccttgggattctatgtcagaacatgataatgtggggagttggcccttggcctgccaccctttcctttttatcctgcacatctaagctccattcttacttccccacaaaacaactgccctgggccaccccttggaagactatggagtatatgctgtctacaaatagacatgaaacacttaccactgctgtattccccatggtcttctctaagtcattatggattgaaagagaaatggcaatgattatgacagacataagtcagatgcttttctgtatcaatttagatgattatgtgtctttccacctttattctgttaatgcagtgtaatacactaatcaattttcatatgctgaaccatgcttgcattgtagaaataaatactacttgtataatgatatgtagtataccatggtgtataaaccctttaatgtgctcttgactttagtttgctagtgttttgttgaggatttttgcgtcaatacttacggatattggtctgtagttttcttgtagtgtctttgtctgactttggaaccaggataatactggcctcattagaataagcttggaagtatctcctcttgttcaagtttttggaagagtttcaggacaatggatgttaattctttaaatgttttgtagaattgtccagtgaagccatctggtcctgggcatttctttgttgaggagtttttaactactgattcaatctctgtattcattattgatctgttcatattttctatttattcatgatttagtcttagtaggttgtttctaggaatttatccatcttgtcttaggttattcaacttgttagcaaacagttgttcatagtggtcttttataacacttttttatttctatggcatctgttataatgtcctctctttcatttttaatgttagttatttgggtcttccttctttttttcttaattagtctagctaaggatttgtcaattttattgatctttttaaaaaactaactcaatttctatgaatttttatattgttttttgatttttctatgtcatttatctctgttgtaatctatattattttcttcttcctgcttactttgaccttagggttttttttttttcctagttccttggatgtaaagttaggttgttaagttgagatatatatgtattttacattatacacttaacagctataaacttaaccctttaacactagtttcactccatcccaaaattttggcatgttgtgttttcactttcatttgtcttaagatatttcccagttccagttccccttattacttatttggcccattgattgtatgagaatgtgtttaatttccacgtatttgtagatttcccagttttccttgtgctactggtttgtagttttattccattgtaatcagaaaagatactttgtatgatttcagtcttctggaatttaagatttgttttgtggcccaatgcatggtcttatcccagagaatgttccatgggtactcaacaatacatgttctgctatttttgattagagtgttccgtatatgtctgttaggtctaattggtctataaggttattcaaatcttgtttccttgttgattttctgaataattctgttcattgttgaaagtggaatattgaagtctcctactattattgtgttgttgtcaaatttcttcaatcctgccaaagtttgttccatatatttagattcatgtaaatacagtaagtcctcatataacattgtgataggttcttggaaattgcatctttaagcaaaacaatgtacagcaggcttttaaataatgtcattttgttcagtgtccttttatcataatgttgagggaaaaaatggctttgttgtttgtactttttcttaaagctgcagttttcaaaaaactgtgacaacattgagaacttactgtatttatgcaccaaagctatgaggtttggtgcataaatatttataattgttttattttcctggtaaattgacccttttgtcattatataatgtctttctttgtgtcttgtaatggttttttatttaaagtatattttgtctgactttaatgtagccacttctgctctcttttgttaccatttacacgggatatctttttccatcctttcactttcagcctatgtgtattgttagatctaaagtatgtctcttgtaaacagggtatagttggattctgttattttatccagttaaccagcctgtatcttttgattggggagtttaatctgtttacatttaaaataattaccgataggcaaggacttattgccgttttgttagttgctgtctatgtcttgttcctttcctctctcattgcctttctttgtgtttcattgatttttttttctagtggtatgctttcattcccttctcacttccttttgtgtgtattctacagatattttctttgtggttaccattgtaaatccataaaacatctcaaagttatagtattctatttcaaactgataacaacctaactctaatcacatatgaaaactttctcctttactgctccacttctccatttgttactgatgttacaaattacatttctatatattacatgtacattaatatagatttatgggttttgttttgttttggggttttttcatttaaatttcacatactaaatttacagtattacgtattactatatttttccatgtatttacctttattgagaaccttatatttttatacagctttgtgtttttgcctgctgtcctttcatttcaacttaaagaacttcctttagcattttgtatagattagctctaggtgatgaactcccatggcttttctttatctgggaaaatgttaatttcttcttcacttttgaagaactgttttgccagatgcagtattcctgattaatagtttttttgtttttgtttttgtttcctttcagcactttgagtatatcatcctactcctttctggccttcaaagtttctgctgagaaatttgctgataatattatggaagctccctcatatgtgataaatcacttttctcttgctgctcttaagtttctgtctttgactttacacagtttgactataatgtttcttagtatggttatctttggattttcctcgttggagttctttgaatttcttgatctgtatgtacatttctgtccacagattggggaagttttcagccattttttcttcagataagctctcttatttttttctctcttactttcccttctggaatacccatcatgcatatatggacctggttgatattgtcctaaatcccttatcatctcttcacatttcttctttcttttttctcctctgctcagtgatttcagataacttgtctgcaagttcactgattcttcattctgcctaaaactgttgttgaatacctctaataagtttttccattccgttactgtatttttcagctccaggatttctgtttggttcttttttatagtttctgtgtttttcttgatgttctcgttttgttcatgtatcattttcctgattgttttcaattgttggtgttctctctctttttttttttttttttttttttttttgtgagacagtctcactttaccacccaggctggagtgcagtggcataatcttggctgactgcaacctctgcctcctgggttcaagtgattctcctgcctcagcctcctgagtagctgggattaaaggtgcatgccaccatgcctggctaatttttgtatttttagtagagatggggtttcaccatgttggccatgctggtctcgaactcctgacctcaggtgatccacccacctcagcctcccaaagtactgggattacagatttgagctaccgctcccagccttcttttagctcattaaacatccctataatagttattttaaattcccagtcaggtagctgatagacctttgtttcttcagggtaagtgtcccgagttttattttgttcctttgattaggccatatttccctattgctttgtatgctttgtgatttttgctgggcattttgaaagacaactacctcccctagtctttgcatactggctttgtgcaggggaagaccttcactaataccccagctgggagttctagggcctctcaaatgttttctgatattttgctccctctggcacctgcccgtggaactgcagctctaatatgcctctcacctctgttttcagtgccttccaaacgctggtgctgggcgtgtgagtgcccttctttaattaatacagaaaccagttccttgggaatcccccagaaagccagaatgttggatgtatggttcattcttttatttctgtcctgagggaggagctctggcatggggggtggtgggttcttcttggttgctccgctattccacatgggagagaggcatgcatgaatacactgaacactgtgaaattcatttcctaccactttcattggaattccttcttggttttataatggtgtgggtgctgtagcatctcaactggtctctcaagttctcacaagggtattctgatccgtatattgttaacttggtaccttagtggtggaaagagggcctctagctttctagtctacccctatagctattgttcttttaagaagtatgttttcgaagttacatttcttctctttcctcaatgtaacattttaggaaacaccaccttaaaacaaagcaaagcaaaatatagaaaacaagaacctggcttgactgccacctttaggggtacatcagatcagttgtttacgtgctgattcagccttcattctctcctatctttttggatggaggtgagagtgatgaacttgtcttgcttttctcagaactttagggtaaacctaggcttatcatccttccttaactgctaggagggcatatactatgtatagatgatgctgattaaatctttggagctttaatgatgtgtgacagccaatgaatttttctaatatagtataaaaacttcatgattttatatcattcttaaaggaagaggctttaaagcagatgtacttcttttttcattttaaagcttaagtacttagatatatgagagaaaatgaagaagtatggaaatttgatcctgtacacttagcttcatgaagagtgagatgcattttctgaacatagccccattgactcttctggaattagttggagataatttggtttgaaatgtcggctttgtaaatagaaatggaaatcattaaaacagataaaagtgaacatagaaactgcgaactagaataaacagtatgttggaaatgaccatgtggctcaattttgcatcagttttctacttctttagttcatgatgcccattttatgtcatgtgattacagcagtgtgatcagagcagttagcatattcttggcattttctcctcattaactttcacttcttcagagggaccttgagtaaaataaacacatttgagcagtcttaagcaaattgtttgaattgtttcctcagtatacagaatcaaccaaaagtaggttggattgagttgagttgggtttagtttaatatcatactttactacagcatcatacatacatatacaatattacctagcatctgtagcacccataaaggattctctaatgcatgtgaagtaaaaggaaagagagtgtttaagtcctgactttgaaactgttgtgttaattgtgaacttttgctgagtctatacattgaagaaggtaacactcagcatgttgagatcacaactgctagattagtgcttggaggcagtagctgtgctgatgtgaggcattaatggctgggtgagttcaatcagatatcctgcctccagtgtctttgtgtaatggtatttactagatttcaaacagactgctgagaaagatgaaatataatctcatgtattatctctgtcttgaaaaaattagataataaagttgttctcttactggcatatgttttattaaccttcgtagagtcaacttaaaggacagatgtctgtagaattgaaaccttttgctagagtgttattaagtgcatttttgagttctaggaatcatggggttgagtagagcaggtaagcattttttaaaaccactcagaggacaatcttatgtcatattctgaggttagctggagagaaaaaatgtgatgtaaattgtgtgcaactacattctttttgttgtttttcttccttacagagcctggagaaagttcttgtggaattcagtcacaaggagttgtttgatttctataacaaggtctgtatttttaaaataattttctaatatgtggagtttttttcataatattttgtttcattttatgaattcttatttttaaatgtcatattatggaactaagttctttaaacttcccttataaaagaccttatgtttcacaggaggaagtatagcagaaatgaagagaatttgaaaaactaaatcaggaagaaaaggaaaatagttttaattaaagcaataggattgttgctttaatataaaacattaagtaatgaactttgtgattcctagccacactgacactttaaatatatataatgtcaaatactttaatttctgggcccaagggtaaagggaaacatgcctttagagatttatctgtgagtatatttcatgtctctttctgaagactgattttgtaatccaggaaaatatactccctccaccccccaactttaaaatattatcaagtaggcagttcttctgccagtgtactgccactggagcatgcgtgtggttatcctgttcagcccaccaccactgtacccactccctcatatgtaagcctccaataaaaccccatgtctcattaaaaaaaaaattatggagtgataatttaaaaggaaacagctgaagacacttaaaacaacagtattaagaaatcttctttctttgaaaatttgaaaacttaaattttcaagcacaaattctaatatcttcacctaaaaagaaaaatattctaagtggtaattttattgctatgtgaatggatttaatattcatagttaccagtgctattttttcctttctatttgcatgtgtctgaataacacttgatatgagtttcgttcccttcactaacgtctttttttttttttgtctttgtaaatagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtc

SEQ ID NO: 1598 - DNA, 183299 bp, Homo sapiens
ttcaaggacaacacctttatttcattatataaaatctattactagagcaaagaattaatttattaaaatagatgcaagatactatacagtgtacatggattaataaaaagctagtgtactgatgatatactcattgcttactaattgtcaaactagaatattctttaactgtcacattttaaatttgacaactagtactgatgagaggaagagtccaacttggaaagactgtggagggtgtcaagagtgaatttcagttatatacaaacttggcgtggattaaagctgtggaaagttatgatgaacacccagctaggtgtccagcctgggaaaggcataacagcacatgcagtggttagcgggtttgcggcatcagctcacctgcacactgctaagttccttcccctgagggcttcttcaggcgggcaatggtgaatcttttctttggcgagttggggtcctctccatcccagagagactcaagcatggttcttcagaaaggcattactttttcttttttgcctttttctctttcttttatttccttttccctttgtcctttgccttttctgtgctgcctcctgttatcgccaaggcacgttttttacccagaggagttttggcataccagttctgaaatacaatagaagtttcggaaaaggtcagaatgacaccaattcaccgcaatactcttaaaaataaagaaaagcctgctaagcaggaaggggcaagcagccattgtactttgggcatttaaggtatgcttgacacaagctctttctcagtgggttttccagactgtttttctgcatgatttgaaacttcaacctgtatttctgcatgatttgttaactcagggagttaacaatttcagagaatctcaggctaaacctaaccagccatccttcccaacaaagttgcctgtttttccggggttgggttttcttggtaacgtgaagggtgctcatggttcatatgtggccatgttcagtaaacaatgggcggccattcaactactctgggggagttgctgttgaaaccacggtagaaataatggagcccaaatactaaccaagaacttagtgattgtaactggccccacaatggcatttttctcaacctttgcgttttatttgaaacctaagagacatttgggtttataaactttatagtagcaatatttcattgcaggattatattacatgttatttatcgattctcctattaatggatatatgacatttgaatttttggttattatgaagaatgctgaagttcacaatttttacaaatctccttgtaactatgtgagagaacctctttagggcacacatttagaaatagaactcctggggttgtagggtttgaacatcttcaattttacttggtattgctaaattgctctctgaagttctgtaagtgggaaactctcttggtctttgtatgtcttttttttttttttctttttttgagactgagtctcactctgtagccgaggctggagtgcagtggtgtgatctcagctcactgcaacctctacctcctggattcaagcaattcccctgcctcagcctccggagtagctgggattacaggcgtgcgccaccacacccagctaatttttgtatttttagtagagacggggtttcaccatgttggccaggctggtcctgaactgctgacctcaagtgatctgcccgtctcggcctccccaagggtagggattacaggtgtgagccacggtgcgtggcttcatatgtcttaaaatgtctcttttctcctgtctcttgtatgccagtttagctggatacaaatattaggcagatagttgtttttccttagtactttgtagatattatttcactatcttctggcacctatggttgttaaagagatgtctgatttcccaattgtttctttgtaggtaatctggtaggttttaagcctggcttttaatcttgttcttaagttcccaacaatatatctaggtatagatttatttgatttgttctgctgattactaggagtttattagttaataaattattttacttggaattgatttttaatccttctttaattcaggaaaattctcagtaataatatctttaaacaattgttcctctgatacttactgtattctttttgtgttctagaacttattgtgttctagaacttccattaatgaaggtcagtgtcttcaacccacctttgatggatctttgtatttttatggattttaccttcttgtttttttgtgctgactatttgggggtactccccaggaccatcttcctgtccacagattgctctttgatcatgtttagtttagagttcatacctctttcatttcctttgtcattttatactgattgccatatttttaatttctaagctttctttctttttctttgcaattcagaccttagcttctgactctctaagctttctttttgtaatattttttcataattatctcttctcatttcatttttttccaaaatgttctgtgcatttctaatggaagtcatgctctcatttattttttgaacatcttaattatattaatttaaacattttgtcagattgtatttagcactagatttcctaaaatgttttggaattttgattttcagatttgttgtgtgtgtgtgtgtgtgtgtgtgtgtgtgtgtgtgtgtgtgtgtgtgtttgagatggagtcttgctcaggcacacatcaccacacctggctaatttttgtatttttagtagaggcggggttttgccatgttgttcaggctggtctcgaactcctgacctcaagtgatccacctgccttggcctcccaaagtgttgggattacaggtgtgagccaccatgcctggccaagattcattttgaatgggaagttttgttttgggctctgtctctctctccttattctttcctccatagcagttctacagctgcttctataagatcctctaaactcaaatacagaaccaggtcttataatgatgtttttgattgatgcttcccttaatgcttcctggtgatattagggatatcaaagatccagtcataaaagaagcaggtattatcattttatctttcacaaactgttctttttgtttttgtttttgagacagagtcttgttctgtcacccaggctggagtgcagtggcacgatcttggctcactgcgacctctatctcccaggttcaagaattctcctgcctcagcccgggactacacacgtgcaccaccatacctggctaatttttgtatttttagtagagacagggttttgccacgttggtcaggctggtctcgaactcctgacttcaagcgatctgcctgccttggcctcccaaagtgctgggcttacaggcatgagccaccgtgttcagccaactcttaaactctctttgatttctatcctttatttttctctatgctgcattctaggcaattttctttgctccctttttcagttcttttgttttctctttagttttgtccagtccacagacaatttattcactgagttatttatttatttattttttgagatggagtttcgctcgttgcccaggctggagtgcaatggcatgatcttggctcactgcaacctccgcctcctgggttcaagcaattctcctgcctcagcctccggagtagctgggattacaggcatgtgccaccacgtccagctaattttgtatttttagtagagacggagtttctccatgttggtcaggctggtctcgaacttccgacctcaggtgatctgcccgccttgattcactgagtttttaattttaatgactatatatttttttcactatcaaaagttctatttggttctttttcaaattttcctgtttttcctccctaatgtttctggtctttaatttaaacatgcttattttgtagtctctttcagaatgtccttttatctcaggttcttggtagtgctattctgttatttgcatttgctgactctccttggggtagattattgcttgtggctcataattttttattatgaactcatctttagcaaggctggtatttcctgtaggaatcctatgtaccctgacttggctaaatttccatacagagtggtttttaattttgcttttgatgtgacttcaggggttttaatgataccattatcattttaaaaattatattaatatttcaactcgagattctgggaccatggaggtagtacagatttggaagtttgacatgcatggtgtaggcttggattttgatttcttatgggccacttttattccccacctagatccctgagaagatcacaagttccttgatgcttccccatggcaacctataaagtgttccaactttgtgcagttccagcattctgtctctcatgggcctctccttgcctttctgtttggatcttatacacccctaggccacccatgtattagctcatatagttgttcctgtctttgagatgtacctctctgttagtggcactgggggattccctcttccttcttttagccttggctctgtttttaatgtaaggtgaggtggccatgtacttaaggcgatgaactcctaatttatcgagaccccgtacagaatatagttaatgaagttcgctttggggaaaggtatgaatttcagctctgctactttctagttgttacttgcctcttgtattgtttattttattgctgctgtggcaaatttccggaaacatggtggctttaagccacacatttatgatttcacagggctgtaggtcagaaacctggaacgggcctcactgggtgacaatcaagatggctgcagtgctgtgtccctttctggagcctccaggtgagaatctttcccttgccttttgcagctctcagaaatcacctgcttttctggcttgtggcccctgctccacctttggatagcaatgctgggctacctggagtaccaacgtgcccttctcagactgctctctctggttttctcttccaactccctcttcggcttttcatgattacattggactcaccaggataattcaggataatctatcttcaggtcagctgactagcaggcttactccatcggcagccttaatccccctgtgccgtgtaacctcacttattttcaggttccagggatgaggatgtagacgtccttgaggggccattatccggcctaccatgcctgtccatatctcagtttcctcatgtgcaaaacagggggttatgagtctaaatgagtcagtacagtggctggcacataataagcagtcaatacgtattagctaacattattagacttactatcatcgttatcatacatattctctccatcatgtctgtggagcagggtagaacgtgtttggagaatctgcaaggtcttcatctgagataacgttgtcggaagcacaattaggtgaaatttctcagggtttgcctcattagaaggaaccatagcaatggtatcacattattcaggagagtgtgagggtgtcactccatctatccatgtgtttaatgaatgtgtccctaaacaaatttattaaacatctacttggggccaggcacagggccaagcactgttgctgtaatggaggcacaaagggattgggtggaaagggtaatgatggcaaaatgatgcagtttcttttgaaaatgaatagagcaaacaaatacaccaagaatggatgtgtgaagcatatgcattctcatcccgggtcataaaagggtagtaattccttttcttgaatagtgtgatcagacctcaagcacctatagatagaaaaacttctagagattacttcggaaagttaaaggctcagccacgagaaaggataggcttccacaccttatcatctaactcctcaaaataaggaggaaaattaatattttagaaaggagaaaaaatggggaatttcagaaaagaatatgatgtatcatttgaagaggataatatcagcaattatgaacaggtttaaacagttaacgagaatattactaataattcaaatgcttggtaaacactcagctagagttacatttttttttcagccttgccagagcgggggtcagcaaaatatggctgatgggccaaatttggcctgttgtctgtttttgcaaataaagttttattggaacccagccatacgcattcatttctgtattgtgtataggtgcttttgtactatgatgcacaactgaatacctgtgatagagactgcatggctctcaaagcctaaaatatttactatctggacctttatgggaaaagattgccaagttctgtgctagaccattacttctgaaatcattattatgactatttttcacctttctaatgcttcactgaagaattaggggcaaaccaggaaggaatcatagttttagatttgatggaaaagtgatgtgttgcagagggaaattttcctgatgttaagcaggctcccagagataggcttggatgggaatttcagtgccccttctggtgactgcacagccaatattgtggtggtcttcagttgcatgcatataatctcttacctttggagttggtcagggaaacttccttcagaaagacaacaccactgtatttatttttgcttaaaggagagcaggcagagtttgaggagtgcctgctggcctgggcactcctataagagagggtgttgggagagataattctcaaagtttccttcagatccaaaaagttctgtgaataggtcagaatgtattcaaacattggaaaactaaattttgatgagttatcttgtggcttcctatcgcaaatgaactgaaactgaaaaacaaagtgttccatgacaattgtgggccccaaacagcattggcttgaactatactatttggggaatgatttctctacgcaaaacttattccataataccaaatatgaagtaaaaacccaaataagtatatgtgtctatgtgaatccaatggtgttgaagctgctactcaattctgcaattgggctgttaatatataaggccacacaccatggttttcctaaaatttggaagatacatgctttactgccaaaaccccaaagattttgtcatccaaaatttcaggtttccaaatttcactgtatatggccgagttccaattcacgaaacccacggaactgcagagggaggaggcagcgtgaggagtgtctgctgctaagacttggtcatcagggtgttcatttaccttaaagctctcttcttcctctttgtacactggattcatgctggttatcgccgtaataaactcaactgcagtgagaggtttatgaatttgccgccggattctctgatctgtgagcacgcctttaaccacttcgactatatgtccttgggtgaagccgtcagtgaccttcgccaggcagctgacattcaaggcactggtgaggactcctccattgcgttcaatgatttgcttccacagaactgttgtatccagaaaagacacagagaacaagggttaccacagagaaatcagtgccagtttccctctcggttgaaagttgcatctcatcaagaaaggaatacacagaagtctactctagcttatttgtaactcaaatgaaccgaagccaagtaactaaatgctttcctctagagaattttcaaccataagccatacatatcaatgaccctgaggtctatagatccacaagtgccctgcaaattaacaaggagaaacacaaaaccaccgtcagtatagttttaatgtggtacctgtaaagatgttgacaatctgtcaacactggaaattttcataaggtgtataatggcatctcttctcatcagaatattgtatttcccaagtaatttgggtaagtagtttaactttttttttagatataaagttaatttctcacattatttttacatctggaatcagaatgcagattccagttttcatcagctactgccagggtcagttccctttcagtggaagacactgtattacacattttattaaatagagcaatttgacccttattctttccccctcagcaactgtaaacacgcattggttgactagagtccttcagatgagtcctgggtgttctctggttcgtgggacctggagtaaatgagatatttcaatctgaacacagggatgctgtgaaaatgaattatgaaataattctggatgcttaactttagagatggaatgaactcctgtacaatccttaaaatcattctgtatttggagaattacctctattctgtaaagggagcacaagggaagtaaaggagacttgctgtaacttatttaattatatcgagacggtggagaagggtgaagggtgtttacaagagcatctgtcagtctcagcactgggataatctggtcaaatatttctaaaccattttgacttttcttgaggaacacttgaaaccattttttaaaaaatgaccatgactacctgatctgagcattgtcaggcctggtaagcggttaattctgagtctgttaaatgactacatcacacaagtatgttgatccaaaaatggctgataaaatgaaaagatctacttactataaaggaataaaatggcctataatgtaactatgaaccaagctggagaatctggcttttgggccacgagctattgcagcagttcactcccactgtcctcttttggggggtccttggccctgtgggtgagctgagctgctgggaaagggtgaactgtaccttggggcctgccaatttctctgagctgtggatgcataggcatccagggtttggagatctgcagtgaaaccaaggagggccacagggaccccaaattggcctaaaggatcatgaaatccctgatctactctgctcctgccttggtgggtttctttgagcttgagccccaaactagtcttatccgtaaaacaggcatagaaggattgacttctcagtgctgctgtgaaaaacaagcccaaaaatgtttgtaaagcgcttggaagtgcagcagcccggcacttggtggggacttgactttctgtggctgtgttactgttgttattacaatgacaatgattgttcttcattctatattgcactgaagtttcctaaccctcattaaaacatcaattacaaaagacaacacaaaataggctacaagagtgtttcaaagcctgtttgtgtagcgatggatggcagccggtgaagattatccttgtctaaatataactgttgcagagttagagatcagaaaacataacccatggtaaaaatgatcatcacaacaacaacaactagcccacatcttcacttgagatctggtgtgtcttccgtccaaatttataacatctaaacaaagtaccaccgggtctgagtggcgactctggaagctgagaagggaacatgatttatgggagagtcacaggtaaggccccaaaagctgaagttgacatcccaggctgggtttcatgcttgcggacttggttctgggcacgcatgagcaaaattcctgccgtggtgcaaaagggaactatcagtgggaaggggtgagggccacgtgctcactggcaaccaataactaactctctccctggcttctctgtgaagccacaacagtcacaatcttggaagttttctgcccaaatcatccaaccttcttgcaggagtaatcactcgatgagtagagattcattagtaacggtgtacagttactgtactgggaaagggtgaactgtaccgtggggcctgccagtttctccgagctgtggacaattaggcatcaaggctttggagacctgcagtgagaccaacaagggccagagggacatgtaaacccgctgctgcccatttaaagtgtaggatacttggtgttcacggagagtttcggtcaagattcctctgaatacatgactcattggttactctccatagatcaccatttttactggagttgcagcaagagagctctgtgagacagtcccagctgtggtgggacctgcccacctgcctgctcatctgaagatccagagaaggggatgcaaaaccaggcttggcttccttcctgcagctgatgaactcgagctgttggtctttcaaagaatcgcttctattgcttttacacaatcacccactcatggtttcttggcccttaaatagctgctgtagggcccacggtggtgtcaggtgtggagggaggcacagcgtggtgggctgggtggagactggagccggcagtgagcatgggagccccagaggctgtggggtctctggcccagaagtgcagtggggagcacagatgcactgcagtcttggggtgtggcaatggctgtgttggtgaagaccaaggctaggggccccagagtgttgagggcagcagaggggctctccaggccaagtgctgaattttactttcctcttttggaggcaaaaggctcctcacatcttcagaccaatctacattctctttcccttctttggatgaaagagaatttggcctttggctccccttcatctgctgttgacattcccagtggattctgtcttggctggcgctcgagatgacgcagtctctgaacattcatttttatttggagttttccaaaagcctgagaggtgaataatgtgatgtgggtgagcttctgaccctctgaagcctggaattgcagaaaagtctgaagacagaccctggacccatccgaccagacactgggtctgggtgggcctgtgatgaattgggttattagcgaaatgcaccccaaggagagaggcaagaggaggagggcactgggaatgtggagaaacggaagcccgaagggatttctggggaccagacagggcatccatcagcctggggggtggattttctttgcagagacagcttggtctgggggaaagaaggagagattgaatgatgtttggtgaacctgagggctgtgtttcctctacaaatccacccttcacttttcagcaccgtctgtccccacgtggcccggaggaatttgaggagtggggccgcggggactgctgcacacctttgagctccattgcgggtggagagacaactaagccaccgtctatgttacggattggcagcccttgctttatggactggaagatactacttttgatagctgcaaagacaagaacagtctttctgtaagacagatgtcccagccactgtggctatgaaaacttcaaggtcactggaggaaatgctggatgaggggcgatgacgtcggccagaatggcggcctgaacacatcactccccaagacagaaatattgaggagctgtgcttcagcggacagaacccagggccccagagaagtgtctggtgcagctttatcatttgcccacaggtggagggatgctttctctccttcctctcccatcacgatgctgtgaggagattcaggtaggaatctgcagcgtgatctgaatcctaagcgatgtgtggtgttttatcaaaagaacaaaattgctgaccatccatcaatagcttcatttttaaagggcctatagttttgtcaaacaatagaaaccattctgtccagagtccagaataatgctccagcccctttgaattaataataccctaccttattccattaacacagcttaaaatatagataccatacaaaaaaggaagaaaaaaagaagaacgcatgagaggagacaggggtagtcctgctaaggccaggggtgtggaacccccggcattggctgtgtgggctgcggcgagactgtggtgcctgcccgtcttgcgctgtctcctttctcggctggacagcgctgcccccttcatccatgtttctcattctggccaacatgatctggctggaggaaatgttggcttcttctgggtctagtccttaagatcttctgtgactcctccatcctgtcttccctcgcttctttggatgctggccaggtgcaaaaggttcatgggggacgttttgaggccctaaaagatgaagaaggcactagatggatgcagaaatagctgggcctaaagtgttcctgtattttgtgtataacactgatttagaaagccaggatcacaatttatcaagacagaaataagcacatgttgcaaacacagtggctaataagctagctgtttatagcatgcagggagtagatggttgttcttttagcaaaaaaaacggagcagcaacttacgaacagccagagaggaccgtatatgccctctgctttgcggtgctcacgtgattggagaaggaagaacagaaaccaagtctgacctaatcactgtattactaccattcatgctgaccaccaccaccactgccaccacggccaccaccactgccaccacggccaccaccactgccaccacggccaccaccactggcaccagcacgtctgctgctcctgccactgaccatcatcatctccagtgtcaaatgtgacctttgccaccattcccaacaccctccccagagccacccacaccaccatcaacacagtcaccctatctcccgcctcctcagcgtcaccccacactgcctccacccctactgccagcaagcacttctgtctccattagcacacgctgtcacctcccgccaatcccctccaccatctgtaacaccaacagcaccatcgccatcttacctccaagtcctcaccgctccccgccagtgcagtgttacggtggccccgccacgagccacccctgtgcattcacacccgtgtgtcctcggcctccctcgaatctgggctggccctgtgccttcctcttgaccacagagggtggtgatggtgcctctgtgtggcttgtgaggctgggtcacaagaatcctttcagctactgctccaacttcttgaaacatgtgctcatgagataacccgtcgtgggacccagctgccaggtctgagaagctgcactgaggccaggtgcagcctgtccggtcgacataggccccgctcagtgcccacgacggccagcagcaactccagtcacatgcgcgagcgatcctgggtatccacactgtccagtctccagacgaaggagactcaactttcatgtgactctcacatcatgaggtacattaaggagaatgccccagctctgcccagacaacccttggaagcacatggtggaataacgtgctgtttgagccttcagggaggttttcacacagcactagatagcagaacggccgccagcactctccccagcttcccctgccgttcaccacccgtccttccctcctcctgcccagcccacaccaccttcttctcttcctctacctccactgccactgccgccaacaccctttctctctgggggccacatggggccaggtgctctgctaacacctcgtgagtgtcacagcagccctgtggcgtgaaccgttctcctacttcacagatgagaagatgaaggctcagaaggtgaccgacttgtcagggtcacccagctatgcaggggcagagccaggattctgagccaggcgtcctgagagccccagcccaggctcctcctcgctccactgctttgcctcccaggggctctttttttgtgtcattcccattaaaaaacatgtttcaaaagaagtggattttgaatctatttaaggagaaggaattgaaaaagtaagctctcgttgtattttaatgttcattttaagtaaatcattacacaagtggactttgagactggaagaaaaaaaaaaaaacccaacccggtgaaaagaaactacactctatgaggaagacaccatcaccatgggtgcaaggtgagtgatcttaatctacccgtcccaagaaaaatcagcacccacaaggcttttgtcactgtcagggccagaaatcataatccttgtccagtttccttttgtcttgggtagagagatatatgctaagaacagaacgtgacctagtggtttatatctgcagcacatgctctgtgttgggtgcaggtgcacacaccccaccgggtgcaggctcccctcaactcatctggcgcccaccgggtccaagggccgccctcctggcaagcacacagtggacagcccagcctcagctatcatgcatgggaaggggctgggggtacttgccgtatctggaagcatagtctggtctgggcaccaaaataattttctggtaaactttgcagaaagattggagttcagcatcgaagggacgccgtgtggtccccacaatcagaatccggtcatctggtttcaggagtttcaggatttggggaaggtgttttttcaggcgtttaggttcattctgggagagagaaaaaaaaattggtccacatatagaaaaaaagaatgaaaaaatgaaagaaaatttacttaggatgcattgcagcatcctttgttaaagtgattgcaaagctctgacaaacacaatttcttaaggtttgtcctgggatgggtctcggaatgtgcttcccagtatgacccagtggattttaattgtcagtgtttcctttcctcaacctctggtgtccagatttagagggtgggaaggaaggaagcaccttggccctaggaatgggaagtggtggctgatttacaaacggaaggaagctcactcggacctgtaatgagctgtggtgctcccattttcctaagttgtttggaagctggacacaagacttcctttgctgattgctggaacaatgaagagcccagctcctgcatctcatgtctgaaaaatacctggttacataaggctgtgaaacttatctctctgaagcagttgggaaatagtttgaacctgaattattttagtataatctcagcactaatgagggagaggaatgagcgagaacaggctggctgttcagcaccccagggaggacgacttccagcccgtgggagtcagatctgaccatgttgccatgggcaacagcctggctgcaaacgaacctcgcccccagtgcagacagcaaagaggaagccggggaaggagaagcacaccaggggcaatggtgagagcctctgcagagacttcccaagcacagtcgaggccatttttgctcccatttggctgacggctaatgatgttcctgcgtcttttcatgtgcttattggtcatttgtgtatcttatttggaaaaatgtgtatttagattgttggcccactttaaaagttgggttatttgtctttttattattgagttgtaagggttctttgtaggttctattaatagatagaagtccctcaatattacatggtttgcaaacattttcttctgttctgtgggttgtcttttcactttcttgaggatgtcctttgcagcaaaaaagtttttaattttgatgagttgcaattttctttttgtggcctgtacttttggtgtcatatctaaggaacaactgcctaatctaaggtcacaaaatttatgcctatattttcttgtaagagtgttctagttttagcccttatttttaggtctttgatacattatcagttgatttttgtatatggcgtgaggtaagggtccaactctttcttttgcaggcagcaattcaacagtcccagcattacttgttgaaaagattattctttctgaattgaattgtctttgcacctttgtcaaaacgaactgtaatgtaaggctttattactggattcctgattctgatccattgatctatgtctcttcttaggcaagtccacactgtcttgattgttgtagctttgtggtaagttggaaaatgaaattgggacatgtgagtcccccaactttatttttcttttgaagaatgttttggctggatctcctgaatttctggatgaattttaggatcagttaccaatttctgcaaataagctggctgagatttcatgggaattgcattgaatatgtaggccaatttgggaattattaccatcttaacaagattaagtctttcaaccaatgaatacaaatgtctttccatttatttaggcttcctttaaatttttcagcgtttttgtagttttcagaaaagtcttgcacttcttgtgtcaaagaactttgtgagaacaatttcttttatttttgagacagagtctcactgtgtcatccaggctgcagtgcagttgcacaatctctgctcattgcaatcaccacctcctgggttcaagtgattcttgtgcctcctgagtagctgggattacaggtgtgcaccaccatgcccggctaatttttgtatttttaatacagacaaggtttgccatgttggccatgctagtctcgaacttctgaccttaagtgatctgcccgcttcggcctcccaaagtgctgggattacaagtgtgagccaccgtgcctggccctaagaactttgtgagaacaatttctatagagtggtgggggtagcaagccgatggtggtgggttgaggggtgagtagggtggtgagaagagacttgccttaaagaacaaagcaggtggtgggagtgactgggcatttggggtgcacatgtgagctgcccaaagaacagtggaagtaggactgatctgacagtcctggtgaggctggagactgagaatccatgggggtagagacacacctgcatggtctgagcccaccctcagcaacccagttgccatggtgatggcagtgtgatccctgccctttctgaggcaggagatgacactgttacctttctgtcctgaaatggcagggacatttgaaatgaatcagcctatctggatgacaaacgttgattctgggcaatgtccagagtgacatccttgctgatggtgaggtgcagtcccatgaacaggggacagaaattggtgtgtcattcaactggtagttcccctacactcagaccacccccattccagtgcagagccgtctgttatgcacgagacctgtgcactcatccatcatgccagcaaaccaccccatgatcacctggccacctccaaaaccgccgcccctaccgcggggcctgccagcccctcacaactgtattactttgggcaatttcaaattagtggctagcatccacgcagcaatttcaatttgctattctgcagttagctccacaatacaaccgccacagccagccccaagaaagcagcgattccttggcagaggcactatcgtgatgtcagggaggcgcttgctagatgaagtaacaaagggtaatggggcagaaaatgcaggagcagcccgtgcgcctcattctttaccgccttcacctcagatacaaacaactgactgagcgcactcgaggcgcaggtgggaggagacgctactctcctaggaggaggagaaaggagcgggcctggtccaggcgtctgcagggggcaggggtgtgtttgtaaaagtggcaggggttggagtggaggtacttggagtttggactttgctgaaattctagaggtgtgaggggttctttcaaagattgctgaggacagtgtgaggggaacaggagtgtgtgcaggaggacagagaattccggagtagggcccatttggttctaagacaagagggccccaaaggcaggttttgggatgatgtttggagtggccccagggctcagagggccgcagggatgcggtgtggtttaggtgcaccaggagggctgacccaatgggcagaaggcgaagctggtggtttcccccccatgtcttccagcctgtgctgtgtgtggtggggagaaggccccattctggcaaccttgtttctgaatcccagcatgacccgagagcagctgtgcgccttctgggagcctttgttctcttttgtgtcacagggaaaacaatgccttcctctcagggttgccgggagtttccctgacatatgtattgtgcttgggaaagaggaggtattcaactgatgtcccccaccgccaccggggtcctccttttcctgtccgcaacagtgtccctgcgcccgggaagtttggcttccatgctcgggtggcgtcactgatcttcgccatgccccaatccccgggtgagcttcctgcctcttattgcgggaggggcctcacccaaaggcagaggggccggagggtgcattcagtcactggattttcaaggggatttcccggagtccctcaaccccagggcaaggtcggccctgctgcctgtatggcacccgtagctggtggagtgccagcctcctggatgttcttctctgtgcctctgtgcccttgggatcagggcagcctttgggacagaggccggggcaggtgggaggaaggactaggctccctaggtggctgagtgatgcaatgaggagcaggttacgatgcctcctgggctcctctcacctgtggatgcctctgctgcccttggcttttggtcaccttcagaatgtggacgtccaatgctcatggccacctggggccctggtggcagaggatcttgggtgagacacagagtctcagaggctgggaaggacagcaggactggcccagtcatggctctggagacgcaggaaggcagcaggaactctgcagccctgctccctgaggggcaggccccgcaatgccatcactgcacggtgcaggccgagtggagctggagttccgtgtagagctgggcatgcacacgcaatggtttcctcccccgctcctctcctgctgcagcattggagctgggggtggaaatactgggggtgggaggtggaggatggcattcatgcctcttgcagctctgagtctggggtggctcaggtcccctcgccggccttgcagatgctcaggaagccagggtgccctttggcttgcagtcccctaggacttatcccagggtgtgactcctggtcctcagtgcagttgacctccccaacacacgacggactcctctaatgggaagtgaacagagaaaacgtccagttcatccacagcaaagaccatgcctccagtggccttcatttcctacagggacaaagctaggcatgggcagggtttgcgggaatcggggatggtgctgagaggttcgctctgtgtcaggagcacaagggctgattcaaggcagggttccgcaggctcggctgcttcttcacggctttcagctccctcctcagcgcgcctccttcccctcacatccactccctttatgcgagggtgtctacagggtatatttcattccctgcctccagctttctctcagaggccccctctcagcgctccttccccagtgctcctctggctctctcaggaggaacattcccgttccccttgctctcccagactcagatgtgcagtgagcaggcagccgcaagcactgatggcaagcccagggcactgtgggagaatgcagggggctgcatgaactcagaggccgtgcgggctgaaatgctttcatttaatagtaaaggaagcggaggctcagagaggttaagttacttgtttaaggacacacagccagctgtgtgaatgctgttcactgctggcctgagttccaggccagtgtcttccactccccaggcttatgtctggtgggagagggagtagcccctgcccatgaatgagccaggtttctgataactccaggtgtgtgacacgtgagacgaaacactgccctgcatttctcttagacgtgggacctggtggagaacccggtcattcctgccatccattttgcatacctacttgtggaccttttcaagtttttctgcaatgcagcaacttcgccagcagagggagtgaactacaagagtcccagattaaataataaatgagttctctgaagactttctgaaatgacagggcaatcaaggctcatttggggaagaaaagattgagcttccactctttatccaaatcatctctacctgcgaaaagtgatgtataatacataaggatcaaaagtgattaaaatccttatgaatttaatcagaaattcacagttaaccactatttgctttggtgcaaattgatgtggaataacaatctcgtgtatctgcacattttttttaacttgtgggaaatttgctggtgatttgtggggggaagtggtggaggagggggaccattgaaaggagagaaaagaaggaaggaagcaattgaaaaaggactccctggaggcccgaatgtggtgcacttagcagttctgctgagggtctttgttcatcaattgtgggccttttgctatttattatgatgaacaataggaaatcctaataataactcctatgtgtgccatttgctttaactgagcagagttctctaaattgtttcttacctctgaatcgtatgtttgggtggaaaatccctctcccctttcttccacactttctttccttctaaactatgtctcataaagtcagaccacagaaccctttcaaatacagttagggcagacagagaccactacagagagccccagtgtttccttcctcgcttgaaaaggcaagaccttctcaaaaagtagaggtaggccttggtaagggcctcctttggaggaaagaaaaggcaaaagtaaggcatgagaaagtcctcaccatcttttctgcgttgggaacttttttgtagaaggttttttctgtgtcttcaatccacaccacggagggctggagctgtcgagccacctgcagaggaaaaggcagggccctggttgtaaatgcacttccctctcaggtgtgcagagccctggttgtaaatgcgcttccttctggggtgtgcagagccctggttgtaactgtgcttccctctggggtgtgcagagccctggctgtgaacgtgcttccctctggggtgtgcagagccctggttgtaaatgcgcttccctctcaggtgtgcagagccctggttataaacgtgcttccctctggggtgtgcagagccctggttgtaaacgtgcttctctctggggtgtgcagagccctggttgtaaatgtgcttccctctggggtgtgcagagccctggttgtaaatgcgcttccctctggggtgtgcagagccctggttgtaaatgtgcttccctctggggtgtgcagagccctggctgtgaacgtgcttccctctggggtgtgcagagccctggttgtaaacgtgcttccctctggggtgtgcagagccctggttgtaaatgcgcttccctctggggtgtgcagagccctggctgtaaacgcgcttccctctcaggtgtgcacctgctctccccgtgcggctcatcagctctgctgcacaggcacagaaatgtgttctgcagctacaacctgccccaccacgtcccttccttcacagcaggacaagtccccaccccccccaaccgctcctctgtcagtcctgttctgacaggcaggacaagcttgaggacaaacattctgctctaggacctcaacatcctctcagtttggcttgaaagaaacccacagttttctgctgaaaatgaatggagaactgggccacgagttttaattaccgcctctggccgttcccgggtttattcaagtttgcttaccatgagaaaaaccgtttcagcactcgggcccccacgaggctatttgttcatctctgtttggctgtgcctttgtggcctaggctccccctgaaaggtggctccgagcccctctggacaagcagggcctcgcgacagagctgggatgggacttaccctgggcccatgaataattgctgtacacctaacaatctcttcaaagcacccctgtgatagcgaagttcaggtatttttgcaacaatttgtgctttgtgcgaaattgtgacagataaaagccatggtgaatacagcgttatgtactcctatttttatatttcttaaaacatcattaaggcagcaggcatgattttaaaccaagacagtcattcagtgagtgatggaaaaatcgctagggacactctactgtgtctgcctccctgtcattatgtacgaagtggcaagtcagggctataaagcagattatgcgccttcaaaggcagaagtgggcactgattgaactggatccttgcgctggcccaacgcctgggccggctgcattcccaggccccaacacacacggacattcagagagaaaagagtgccagccaagcaccatttgataggtattttgcagacccagagtcacagaatttaggaactcagaatcccaaattttaatcgtgatccctgagccagtgtggtgtgataactgcagtgaatgagttggcagacatgtgccaggcatcagccacctatgttgtgcccagcatcacacatggtcagagccagcacacacctggcgctgcctcctcctggaggccttagcacatgtggaataaactgctcatctcatctgaaccctatgaagcagataacaatgaaccattgttatcatccctgtttgcagacaaggaaactgaggcttgcagacattaattgatggccctggtcatacaggtccagtgtggcagaagcaggactggaggccaggctgggggctacaatctgtgctggcagctgaggcagcctatgcgggttccctcatctactctcaccacgagcgtgaggggccagccctaggacctctgcttcggagctgagaactgagacgagtaggtggttatgttacagtggggagctagtcgggcatgagcagggcaggagaaggctccttccaatacatacacacaccaagaatgtcaggtgaccatcccatgatgggcaggtggttgttttctgtatttctataataatcattggtcacagccagcactagcgaaaggcagtctcccaataaacagaaacaccggaagtgggtgatcagcagcttcccaataagatctcaggggttgggcgagtgggttcaaccatgtgcattaagaggcaaaacggtggaatttaactggcctatgaccttctagggacattcgactggtaagggaggagcatctcaagtgagcatgcgcacaactccagtgaacacactgtgcatgcatgctccctcccaagtgctggcaggccactgtgcatgcggacagcccaccccaagggaagaatcaggagagaagggacgcaagaccccagaagcatgctaacatagaaaacccaggctggagtgcagtggcacgatcttggctgactgcaacctagagcacgagacctctcacccttcgttctgctgaatgtgggggtgatctgcatttgtgagcactttattttggccttgccactaggattttattttttggcatgatcagggaacatttttacactgctggtgggaatgtaaactcatagagctgctatggaaaacggtgtggagattccttaaagtactaaaagtagaactaccatttgatccagcaatcccactactgtacctacccagaggaaaagatacaaaaatgattcttgcacatgcatgtttatactttgcacatgcagcacaatgcacaattgcaaaattgtggcaccaacccaaatgcccatcaacgagtggataaaaaaactgtgctatatatatatatatatatgatggaatactactcagccataaaaagaaatgaattaacagcatttgcaatgacctggatgagattggagactattattctaagtgaggtaactcaggaatggaaaaccaaacatcgtacgttctcactaggacgcgaaggcataagaatgatacaatggactttgggaacctgtggggaagagtgggaggggggtgagggatgaaagactacaaaaagggtgcagtgtatactgttcaggtgatggatgcaccaaaatctcacaaatcaccactaaagaacttactcatgtaaccaaataccacctgtacccccaataacttacggcaaaaaaaaaaaaatcaaaatctcaaatctcaaatcaatgagtaggttattaactatagcacctgccagtggactcgaggagctagtctatttcaaagcctagccaagaagactagctgatgaggagaaacaccaagccgggcgctttgcccccgagctttcatcaatgaaacagacaaaatgctacaggataaaggaactctctcgtcttctctcttcatctttgatttttaaaagaacgtttaataaaatcagctctctagtagatcacagcaaagtattaagtgattctccagcttaaacattctgtgcttctacaaagaaagcttttgcataaaatgtagattcgaaggggtctctgagctggcaatccggagttctagtcagtgtgcaggagaaagttgccacaggagggaaatccaggagaaaatgtagggtgggctcaagggcctttggaaatggagctcgacgctgtacactgagctgatctatactgatcccggctgggcaccataccctctgctagagcagcaagggcaggaagaggaatgggatgggtccggtccgaacagggtcactccaaccgggaaatgcacccagtcaggggcgacagcaccacgtggtgttgacaaaaacacatgcttggaagttggagaaaagagacccctgtgtgcagagtctcacagtagcaggtaagtgaggagggggcggagcacaagccagagagggaagcctctttcttcccctgacaattcagtgcttctcactgggatcactaggggagctttggaaagtacgacctccgggtctcagccctggagattctggtgtgactggggtgttgtctggcgttagcagttttgaaagctccccagatgatgctgaagagcagacatggtcaggaagccccgctcggaagcacagatgtctactatgcactggcttatgcacaggttcccaaagaccctgccctggtttctctgcactctctcaataccaccttgagggctgatctcaaccactctggtagcttcagctggcctctacgtgctgaccacaaccaaatgcacatccagagctccaggccagagtttcccatccccacatggtgcctgcctactgaagcctcagaaggccaccttccctccctccatcctgcctcctgcccgttccctgcgtgactctgctcctacccaagccagaggcctgggtatccacccttgtctcattcccgacacctaacaaccccacagtctattcatggcacttcctaatccctttcaactccaagtcttccattctctcagctccttggtgcaagcccccgatttccttccaacatggcctgggcactgctgccaagggatggagctgaagagtgaggagggggcaagctccaaggggccattgttcccttacagctattttgagtttaagtcaaaagcttccctacttccagctccaaaagtaaataagaaaatgagacgttgtatgtaaaaggtttatacttcgtaaagataatttgtaataacaaaggcaagatcttattttttttcagtacctcttaagaatctcagttttagaactgaatccaatggagaaaccatcttcgcatcaacaactatctcttcagattggataaagaaaatgtggtacatatacaccatggaacactatgccgccataaaaaagaatgagactatgtctttagcaagaacatggatggagctggaggccattatcctttccttagcaagttaatgcaggaagagaaaatcaaataccacttattctcacttataagtggcagctaaacagtgagaatgcatggacacgaagaagggaacagcaggcactggggcctccttgagggtgaaggtttggaggaggaaaatgagtggaaaaaatcattactgggtaccgggcttaatgcctgggcgatgaaataatctatacaacaaacccctgtgacacgagtttacctatgtaacaaacctgcacacacacccctgaacctaaaataaaagttaaaaacaaaaacaaaagcaaccgtctcttgtcttagctgactgcactcgtggctgctgtggatcacttctcgcgatgtccacgtggcaagcaatgggttttccatagtgcctattggggcctctattttctcaacccagatgggaattgcagatgtgaataccaagtatttcagcgttaacttttctctttttgctcttaacaaactaagctgcgcagccttgaaacaggagtcgccctaacttggaatgattttgagacccacaatcttgtttccagcatcagattctaaatcagttgttttgaaaacggcggctccattctgttgactgtgaagttagcgattgttcctttaacgtgtagctccttcagaactaatgggggaattccatgcttcctgaatttttaacacacacctgtgaaggaattgctctccctagttcagcagctttgggggcacacagggttgtacagggcactctggagtgatgtggtttggaagggctcaattattaccaaacaagacagagaacgcttcccaagagtgttctcagatgaggataacgatacaactgacttcatttgcaaagtgctctggcgtccaggacaccatttgcatcctcaccggacacatgctccatgtgtgccaagcacagccagcggctctcccctttcacagatgaggctgctgaggcagagccaggtgagggatgagtcatgtgctggctcagcaactggtaagtgctggaggtgggagcgggacctgggtctgcccagcacccacaagcccttgcatggaccaggcggccgccacactgccaggggagatgggatgcctattccttgacctgtaccgctacctgatccgctaccatctttcatcccagcaggaagaatgctaaaaccatcactgtcttgccctccagagctcggatctctggctttcctgaccttcccctggggaagctgaggggcctgctggtcacaggacccctggtgaccatgttcaggtctggccagaaagaagatgggcatggaaactggggcagtgtcaagcggaagctacttcgtccaggagggatgaaagggacagaggctgcttctcttggagaaaagaagacttgaggctggtaagtttgctgttttcaaacgtgtgaaggactgccatggggaagaaaggcaggttttgctatgtttggccctgaacgtagaatgaaggctgttctttcatttcttcctttataagacatttacagaagagcttggtatgccaggcactgtgctaggtgccagggtcacaaagagtaataatgcagggtccctgacctccaggagcccacctgtggtaagggagagcagacctgaggttgagggtgctccaaggaaatcagggtgtcagtgaggggcaccaatgacagaaagtgggagaagtgggcgggtggggggaaccaggaacggagaccgcagacagtggttaaagcagacaggtcttccgagatctccagaagatcagatggtctggagagggggaagcacccttcctgggccaggagccagggcacagggtgaggtatcctcacctggggcacatggggagcacctggcacttctggaaggggtcagaaaagtgcacggccatgctacagaggttgcttgtatcctggaggctgtggaagtcctggaaaggactttaatcaagaattttgatcctttttatgttacagaaaaatccctcttgggagtgtgtagaggaggatgtggtgggagctgtgctggccttggggagcaggcaggtgtgggcggtgggcacagtgaggacaaggcccaggcagggaggtgctgcggggctgctgtggggagaagatgagagcccgcagcgggggataggcagggcaggatggggagggcaggactggccagcctcaatgacagtgggttgtgggttgcaggaggggtctcgatgctagatgcccagtggatggtaatgagggggtcagtgccagctgccatgagcccctgggcagcagggcaggcagggagggctgctggggccagagaagaggagagaggcaagggcagaaagggcctccgaggccacagcaatggcagtggacgcctcaagaatggatggaaggaattctcgagtaaagggggacagtagatgaggccgggagagggtgacagagagcccggggccacacagggaagacgatgatagaggaggaggtccgggctgccaaggggcagcagccgtggatagaagggatgggtctggagcgatagctagcctcgaagccagggggccaatgagcaggaggggggcggccagcggtggcctgtgctggccagagagtttggtaatgaggaggtcactggtggccttggcggggagtggagggaacagagccaggtgacagggagagctccttcacaaagacgggcagacagtaagcctggggaggacgtggcgcatggggtagtcagtgcccaggaaatgtctggggatagcgtgggctagggacagaaggcaggaggatgggctgggaggagaagggctcatcttccttgcaccacagacactgggggatagggtggctgctgctgcaggaagtgtgcaggccagacaagaaatgttggcaggcgcatctgctgggaataaaatctgcccttagagtttgtggaaaagcagtgttctttagtaaaaatctcagaatatactgaatggcataaacaacacctcttctccctccacctagaatcaaccgttgaacacttcctgtccttacagatcctttacgaaaatgggatcttgttcaacacatactgctttacgggctgccttgttcatgtcatatgaaagttatttctccgttatcattttaacaggaagcaccagcattacggttctaattaatcccctggttttgaatgtatagatggtttccatcttttactaccccaaatagtacttatttagggcacctggctgagaatttccttagaatgactgccaggagaggcttccaggtggaggggcctggacattctgtgcgtgtcgtttttatgcgtactgtcacactgcccccccaggggttccatctgtttacactctccccaggaataaatgagggctctggctctctacactcttctcctcgacaagtattaatagtaaaaaactctctgccaatttgctaatgaaaaatggtatcctttgcttttctaattttcatttagctatgaaaaggcttcatttaaattacccacagatagtttgaggtcacggacaattacattaattaattcgtaattgaactttccagagttctgtcgggtagttcacgtcacctgccagtagagggctcttcgctactatcaaatatcactagagggtttttgttgtgtgtcaattatgaaataaagacaaatttccaccgtgtgccttttcaaattctaggaagttctagcaaacaactaaagacgtctctatccacatgcattttatgggcttgatcttttgtattttccaaagaaacactgtcaaacattcaccatcagaattagattctcaggggataatggctcaattaaaacctgtttgtgtttcggcatgcatgggttatgaagatgctctgcccagatgacccctggacgttttggaggttctctctgaaaggatcctattttgcttgccaaggagaactgcaggaaaaaaaacagctactatttttttcagctgatgtgtctcggctgaaactcattcattcattcattcatcccacacatatttacggagcatctgagagctctgtggtgggaagcaggggtgtctgggagttgggagacacggtccctgcctgtggagggtgcagctgcctgtgtctgaatgggtgtcgctgagtgaggtgctgcggggttaggggttagggagggtgcaggggcgtaaggcttatttgcagggggagggggctcactttcccatactgtggtcacttggattctgtttaaatacttcatatgacattttggcctgcatttccactatttaaaaattacattttaagtttctatttccttgtaataccttttatgtacttgcggaggttacttcaagtcctcactgcaattagctggatataaaccatagatgatcatcaaaagaagggcagaggtatactagaatgagaagcctggctgggctggtaaactgaggcaaagcaaagaactagagaggagctgggatgcaggggctcacaggaaagactgggcacagtaactaggaggggacatgcgtgtatgtctgtggtcaatgtgtgtgtgtgtcaatgtatgtgtgtgcatgtgcgtatgttagtatgaggtatgttagtgtgcacatgtgtgcgtgtgtgtgtatgagtttatgttagtgtgtacatgtgtgcatgtgtgtgcatgtgtgtgagtgtattagtgtgcatgtgtgtgtgtggggggcaggttggtgctagtaacaggaacatgttgatgcaattagtgcttatccagactgtgttcaatgggaaggtgttggatggtggggggcgtcaggcttacaaaccacctgaacttaactcttgaagccccgtctcctccccagcccactgcccaccacactatggccaatgaattctcgccaggtggaatggactctagccagcttggagaagcctgtgtgcaaagccattctcaacttcccaaggtacctccatcgcccccaccccgagtgtttctgggttgcctaaacattttgaatgctcgtggcatcaaaccctggtcccgccttgtccccactgcctgatacacaacacctgcggatgccactctgtgtttttggtgattgacagcctgcagagtgtgtttccacacctgactgacacacagtgcccggggcctccacagcctgatgccctccctgtgtggggtgctccctgtcgtcactggacaggtggagtgggacatgtatcccgggtcctggagaagcctggctctcttgttgccttcctcctgggagtccccttcccacggcagcctctgacacagctggacccggctacatggcccaccctggtctaggggcctttcttttgtgttcttttttctccttctttctttgcaggtgcatgtgtctgaattccgagaagtttcctatgtgtcggggtctaggctccctccccaccctgggcccctcccgggtgtctggtttgacgtggcctcccaggactgacaccgatgttccaggcaggggaaacaatggcagaggcctcgttggccgtacagacgccggcatccccacccacagtgggttttgatggactctgggcgctagtgaggtgtctgtctgtgttcctcactgtagcacatggtcagtgtggcccactgtggggcggggagagtggggaggccctgcctatgtgggagcaggctatgtgggcgctctctgcactttctcctcccttttgccaggaaccgaaaactgctctgaaaaatagtctatgtaaaaaagaaaaggttctgcagcctatgtgcatgtcgctcctcagcctgcagctgcgtccgcacgcagtggaaggtgagcctggcctcttcatggacgacccactcaagactcagggcactggcctcccaccgtgtccatacccgaggctgcactggagccgctaaatcctgtgtccctctccccatgtccttactcctctctttcctctccccctcctttttgattagccctgttttaggggccagatgtaggccttgggttatccttactgatattcaccttgtaaaatgagactaacatatgtattacactaattgtacatctctctctctctctctctctctctctctgtgtgtgtgtgtgtgttttaaatcaaccacaaatagcagcaatgtctttgtctgggttattaatcaggaagagaagtcttcttctatgagctacagaaacataccttttatgaactacagaaattggccaggcacctctgctgacacctggactagctgtctacaccaccacacaccacatctgggcaagagcccttggtgtgctgccataaggctgctggctgtgagcccacagaggagccgggtggatggtactggggcacaagagcatcgagggtcccttttgtccagatgctgcagaccactgtgggccacgtgtcctacagctgacactgcctcggccccgttctcccaggtcctcactctaactcagccctcaggggccaggtcaccaagcagaggggaggaaagcagaacctaagaatgtccaggggcagagagggccctcgacccagatccagggggccgctgaaacattctctgctccagcctccttccctgcgccctgccctggccttcccttgcctgtctaatgagaggtctggagggcgggggccattctcactggcaaggcggatacaggaagaagcaggatggccttcagttgcttcatcttctcacactgggatattcccagcagacccgctggcccaggaatggccttgcccctgtgtcttgtggagggcacatcctcccacagggtggggcatgcggagccgatgcttccccagaggccagctggggggccacgcgacggtcttggggcctgacctagcgtgaaatccagaggtcagacctctggttctcttgcatttttgttgacattcagcactctgagtgtcacttttctcatctgtaaaatgggcacgttaattcctacctcatcagagctttcatgcaattaaaagagaaaatatgtgtaaaacgccttagcatgtgcctgactccagggcggaggtcagaaaaagcccttcccgctccgctgtcccctggtttactattatacagactcaaggagactggtacctggggggtggcgggggtggtaggcaacagccctgccttataacttctttcacctgtgaaatgtttattgcatgttcatcatttgtcaaatatttatcaaatatttatactttttataatatgtatatttatatattatatatattcatatatatttatatattatatattcatatatcataaatatatatattatatattcatatattatatatctatatatttatatattcatatattatatatctatatatttatatattcatatattatatatctatttatatattcatatattatatatctatatattttatatattcgtatattatatatctatatattatatattcgtatattatatatctatatattatgtattcatatatatctatatattatatatattcatatatattataaattatattcatatagtatatatctattataaatgtatattcatatagtatatatctatatattataaatatacatatattatatatttatatattatatattcatatagatctatatattatatatattcatatatgaatatatatattatatgtatatatattataaatatatttatatagtatagatattatatagtatatgcatatttatattataaataatttacatagtatatgtatatttataaattatatatatttacatattacatgtatatttatatattataaatacatatttacatattataaatatatttatatattatgaatataatttatatattattacatatttacatatatgcatagttatatattataaatatgcatttatgtaaatatatatttataaatatataaatatgcatataatatgtaaatatataaattatattcataatacataaatatatatttacaatatgtaaatatctgatatgtaaatatgtatttataatatataaatatacatataatatgtaaatatataaatatacatatactatgtaaatatatgttatatatacatatactatataaatatagaatatataaatatacatatactatataaatatgtaatatataaatatatactatataaatatacatatactatataaatgtatttataatatataaatatacatatactatataaattcatatatgaatatataatatataaatatatataatatatgaatatatactcatatataaatatatatgaatatatatttataatatatagatataatatgaatatatatttataatatatagatatatattatatgaatatatatttataatatatagatatataccatatgaatatatattatacactatatgaatatatatttataatatataaatagatatatactatatgaatatataatatatatactctatgaatatataatatatatactatatgaatatattatatactgtatgaatatataatatatagatgtatactatatgaatatataatatatagatatatatactatatgaatatatataatatatagatatatactatatgaatatatatgatatatagatatatactatatgaatatataatatatagatatatatttatgatatatgaatatcatatataaatatatatgatatatgaatatatatcatatataaatatacatataaaaagtataaatatttgataaatatttgacaaatgatgaacatgcaataaacatttcacaggtgaaagaagttataaggcagggctgttgcctaccacccccgccaccccccaggtaccagtctccttgagtctgtataatagtaaaccaggggacagcggagcgggaagggctttttctgatctctgccctggagtcaggcacatgctaaggcgttttacacatactttctcttttaactgcatcaaagctctgatgaggtaggaattaacgtgcccattttacagatgagaaaagtgacactcagagtgctgaatgtcaacaaaaatgcaagagaaccagaggtctgacctctggatttcacgctaggtcaggccccaagaccgtcacgtggccccccagctggcctctggggaagcatcggctccgcatgccccaccctgtgggaggatgtgccctccacaagacacaggggcaaggccattcctgggccagcgggtctgctgggaatatcccagtgtgagaagatgaagcaactgaaggccatcctgcttcttcctgtatccgccttgccagtgagaatggcccccgccctccagacctctcattagacaggcaagggaaggccagggcagggcgcagggaaggaggctggagcagaggacgcttcagcggccccctggatctgggtcgagggtcctctctgcccctggaggtttttaggttctgctttcctcccctagtagactatatatagtagactatatatactatatatatatagtctacaagtaaatagtcatttacttgtagatacatttcttaaaaaggaaacgcttcccctcacccctcactcattattctattagttactgtttgtaaaataaatcctccaaacacaatgatcacaaaatggatttgaatttacagttgtgaaacaaatcggagactcattttccctgcgtgcttccacggtgctgtgagtgaggcgaatgccacctgcctgaagtgagaaatgacaagcatttccctgtagttgcattgtttaccctcccgagattaacttggtaacaggacttctctctaggaagaatccatgaggaatcaggcccttctgttatttcaccttctcctgcaaatgccatgaaccatattttgctgctcttgagccacagcccgtgttctgcagctcacacggcacagtcaggccctccagcttcctgccgtcaacgtaccagcacaagcatcctgtcctgcttgcctttggttaattaaaagcaaatacctctttgcagtgcagatagctgctctgtcagtcacactgggacacggtggcctcaccgcacacaatttttaattgattgactcccactcctgagacctctgggtctttcattaatcagttatatacacaagaaaggtgaagtttaatgaggtgtgtgtcaggcactctgacatgaagtggcccaggtgggtgaatgtggtgctccacattttaataatttttgacacccagcattttgcagtccacacaatgccagtttgtgataattctaataaacgcaaagatcgcttatctggtatcaagacaaaatctctcagcagcaggaacaaagactttcctagagtgagaacagaaagatcacatccttgctctgtcctagattcacaccaggagctactaagctgtttggtgagtcagaaaatggatacttaattcagccattcagccctatttcagtgagcggccgtataatgcagttttgaaacttggaggctctggagccagactgtgtgagatcctatcattgcactgcaaccaggaaaattactaaaatgatttgtgcctcagttttcttaacagtaaaatgggtataatgaaagtgtctacctcatagagttgttgtaaggactgagtgagttaatacgtagtgatgtatgcaacagtctgggatatatagatgcttacgaaacactaatatttttatatttatgtgcttctgtctgttacttgacaaatgtcaacaaaatttgatgtttagaatgaacaaatgcaggtgttcttttgggcaagaggaagggttcattttacctttcctctgaagaacttagtgcttacaacttggtagttaagcacatggaggccacaagtcaggctgcctggcttcaaattccagctcaccttcaaatcattggctaactttagatgtgtgcttgcgtggggaaagattccaagctcagtgaaaagcaatagatgaaaaacagagaacgcagcacattcctcagctactgccaagtcagaggagcttggtaaacaggatttccattgaaactctggagtaaagaccatattccaggactaagagatttgctttggaccacagacgaagtcaaaatagacccatattaacaaaatggaaaacgaagtctctgcaagttcaagctgatcagccagtaatttaactgcctgctagaacaaagccccgcttgcttcagaggctccacaacgtaccatccacaatgtctaatatacaataagaattatcaatcagatgaaaaacagagaaatgtgacacatggtcaagggaaaagcagtcaaatagaaataggccccatgatgaccccgttttgaaatgagcacataaggactctaaggcaattaagttcaaagacttgaaggaaaaagatggtcatatgaaatgggcggatagagaactacagcagagaaatgaaaacgagtaataagcaaatgtaagtgctagaactgaaaagcaaaagataagaagatcagaaataaaaaataagaagatcagaaaaaagaaaatttgttgccagcagatcttcactaaaataaatgctaaaggaagttcttcagctgaaagggaaatgataccaggtgaaaacttaacttgacagagacaaagagagtactaaaaatggcaaatatatggagatgtataaaagagtatatttcttctctcaattttttaaaaagacaaatgaccatgaaatgcaaaaataacattctattgtggtatatataacatttatagatgtaaaatgtataataagaaaatgaaggacagagataataaatggattatgttgtcacaagattctcatattttatgtaaaataccatattaattctacatagactgtgataagaatgactacagtaatccgtaggccaccactaaaaaagaaaataaaaagagaccaaaaagaaggcaggaaaagagaagttgaatgaaagaggaatgaaacaaatggagaacaaatagcaaaatggtagactgaactcaatcatctaaataattgcatacaaaaataaacggagcaaatgctctagttaaatgacatatgttgtcagattgaagaagaaagcaaaacccaactatgtgctatccataagaaatgcactttaactataaagacatagacatattggaaataaaacagcataaaaatataccgtatacactcagcataagaaagctgatgtggctccattagtatcagaccaggtagatttcaagacatggagtatttccaggacaaaaagggtcatttcataatgataaaataatcaaccaggaaggaagacataacaatcctaaacgtggatgtatctcataacagtgcttcaacatatatgaagcaactgacagtactacagggagaaatacagaaatgcatatagttggagagctcctcaaaattctcagaaattttgaaatactaaaaaatatgaaattaacctaaacaatgaaatgaaccaatgaaaacaataacccaatgaaaggtacagttgacccttaaacaacactcatttgaactgtgtgggtgcatatatacacagattttcttccatctctgccacccttaagacagcaaggctaactcctcctcttcttcctccttctcctcagcctcctcaatgtgaagaagacaaagatgaagacctctatgatgatccacttccacttaatgaatagtaaatagatttttccttctttatggttttcttaataacattttctttgctccagctgattataagaatacagtgtataatacatacaccatacaaaatacgtgttattcaactgtttctgttatcaggaagacttccagtcaacagtaggctattggtaattagacttttagggagtcaaaagctatacgtggattttcaactgcacaggggattagcgccccaacccctgtgttgttcaagcatcaactgtaggtaaatgacttgaatataaatttcaaaaaaaagttgtacaatgaccataaagtgcatgaaaatggtggttacacattgtatactctacagtttcctctctgaacgccttccttacaagcatgagagaaaaggagagtgggatgtcctgagtcgctgcagtgggagggaccacgtggctaagggaagaaatcctactgctgtcgctccctagttttttggtgtattagcgtgacactaaggagacattcctgtccgtttatcattcctgtaaactgcctcgttgatgagcatctctcatgctttacagccccttagaaagcagatacagagccaacacctagcctccaatatgggacagtgtttgccaccatgtaggctttgatacagtaaaagctggcatggcagcaactgaaatgaatagcataaggctaacctggaggttctcaaccaagtagaaattaaattttgtaaagccttgatactaaatataaaatatctgtatcaaagttctttcaaacgcattcattttgtgatgataaaatggagacccagggaagctaggagcttagctaagatcacagagctgctcggatcctgtgatatcagcacgtctttacattactctggtcggcttaggtgcctgcaggcttttccatcacacctgtgtgaggagtgcacagaagcacagaaggtgccataccttggcaacccatgtcatgtgaggaagaatccaaataatgcaaatatctctacctgatgccaattattacagtgaggtgggccgagcaaagaaattgtgggtttaattttcaatgagacatgaaagcatttccagaagggttcctgtggcagagggagggtgattgggatggcacagtagggtgcttacggaaagaaaaaagttgtttctaattgtgtgtgtttggccatacgcaataatgaagtaatttgcaggagtagacaatgaggaaatttaagacagtcatgcttgtctgccaatggaaattatctgcagggtttgaaaatgtaatttgaaagagggaggagagttggaaaccaagaaatgtaatccataccttgaagactgcatgcagcatcatttggaggccatttttgccagggtatttcccagcaatgttagaggaggacaagttgaagaggttggctcccgtttcggtgcagatggcatggaccagcattttcttccctaccccagacggcccggctaacagtagcgatttcaccaaaggagctttctcatgcactgctgcagaacctaaaaaaggcagaggcaaaggtgctaatgttctgccaagaaaatcagtggttcttcaactaggataactcaaggtcaaaactgcatcgtgtgactccactttctgcaacagtgataaaggcgtccaaagcatttcaaaccagagacacgcctccatcccagctggctctgtgacacctttaatttgtaggtcagggctcgtggtagagccatagggtctctgcgggtccttaatacccttctccccctctccacatcagtatttcccctgaaatcataattttaaagagcattcctgcaatagcttacctctggctttttttttttttttttgagtgctttctctgcttgtcggcagcagcattaaattctttgaaagcttgggaagaggaatgtggagacatagacgataaggttgactaagtgtttatttccttgcacccctcttgcctaccatttagtgattcttgtgagatcaagggaggatggagatgcaggcagcagcagcctgaacttctttctcctgccctggtttctagctgtcagtagcggcagagttaacctgacgcttgataatgaagtgacttgaattactggagtcattcagaggttcatgccgtgttctccaccacactgtcaatttccttagtgcccagaaggggcctcaggtgtgggtattctccattgcagagaacacaagcagagcagatattgggcacaaagcaactaaaaagtgaacgggattaaattctggaaagtgctgtgatcaaatcatttactatcatgttagtttgcgttctgtcacttaatgggctctttttgatactctgtaaatgtcagtatgatgattatgcttttcttttttcttgtataattgaaaagatacagaaaatttaagtgatgattagacacctaatttttatggttacctaccattctccacataaacttggaaaatagttttgagcaaattctctttaccacgtaactcaatgagcatgccttttttgtggttagtaggggctgcggcaatctaatgggataaaggagagactctttttccacaacaggagagagatgccattcatttgccctgcgttggacacctgggtatggaaggctgctctgtggtagccctggctgggagctagtgtgggggtccgtgggagtggggactgtggcggggagtgacacaaatgtggaaaagactcaggatttgctgtggagagttcaggccaggggaggagctgaacctgagttgccataatgagaacgggaggcaagcagtgagaaggtccaggagagccacagggagttcagagaagaaactgctccccgcggaggactcaggctggacttccaggaggaggtggcatctgggccagcctctgaggaatgggcagaatggtagcatgcggtgaggggggtgtgtgggcaggcttcatgtggggccgggaagccaggctggcacagggaggggtgaggagccagcggtcaggggccctgaaaggtggtcggggactgcaggtgccaggcgggtgctggctgaagccagggggccgggagaggtttctgggagtggtagaggaaggagagaacagtgctgaggacagagccttgggttgggagggggcagcaggaggcagaggagcaagggcaggtgagtggacccgggagagtgtgtggcagtgacacaggcagtggccttccagagaaagggggtggtcaccaaggtcacccagagaggtgaaaaggttggtccagggaggcctcttcaacgggggcctggctgacctcagggaggacaaaggtggacagagggcccaggagctgacaggacacacatgtgccagtgtccacagctcttcctgcccctctcgtagagttaccaagagacacagtatggttccagttttcgcacctgagccctgttcaactttccgagaattaagagataacaaggaggccagtgttctctgtcctcaacccagtttagccccttcctagccctgtgactccaaggaagtgcccctgcatcttggaacagcttacgaatcactaaaagctggaccacgtccacctggaggggtctggcaggagatgaaacagtggacacggtttctgctctgtgagcatgcccccacccttcacttctccctgatctctacgtggcagtaatacctccaggagggtgggtggatgctgaccagatacttcctgggcttcctcttctctaacaaggtggtttcggagtctaagccctagccccaggctgcagccggtgtctcctggccaagtatgtaagcggccaggagatgttctcaaggtcctctgctgagtggccaggtttttagtctgggcagccgccaccatcaaggtgatctaaacaactggagcccccagacattcctttttatgacaggatgttattttaatgtatgaaatgtaaatcagcctcccaaaagcttaactgtgcacacaattcatctgcctaacgtttctatgcattccaaacacttggcacacatgccctgtcatgagaacaaatgccccagccagctctgctctccggaggacctcatagcccttttggacagtaggttcctcagtgagaaagggagggtgtgggtggggtgcttcctgagggcccttctgtggtgtgttcaaagccagcttggaaaccacagataccaccttgtatcctttgcagctgtgaaatacaccaacctcattagggaggcgttcccttccaaacttgttggctcttggttctttctttctcttttattccctccctccctccctctccctctccctccctccttcctcctcctctctctctttctctctctctctctttctctctttctttcgatggagtttcactcttgtcgcccaggctggagtgcaatggcgtgatcccgggttccagcaattttccagcctcagcctcctgagtagctgggattacaggcacctgccaccacacccggctattttttttttttttttttgtatttttagcagagatggggtttcaccatgttggccaggctgctctcgaactcgacctcaggtgatctgcccacactggcttcccaaagtgctgggattacatgcgtgagccactatgcctggctcactggtgctttctgtcttactgccttccatgatgcttcatggaagtgtgaggtctcctctattttatttccattgacacttatacatttattctgttgaccacaaattatgttgcccctcaaatatgatatatttgttatatataatataaattatgtgctattatatattatataaaacatatatattatatatatataaatgtatattaaccccaaattccatttactacttctgacatcaatttagaagaggaattaactatttcttgccaataggcaagttctgaagtcttaagttctgaagtcaaagtggaacaataagggtttgaactactcccatctcattttaaagcaaattaaaaacccagaaggtgatttctatttgagagttgttgtcagaactgaaactcctggctggagttgccatccctgcccctggtgattcaggtcatacacatatcaaagccataaagaaaaaaaaaaagaaaaaagcgaacgtgagccgcagatatctgtgctgtggagagcccatctttcctgcatcgcctgcacaccacagagctctagtgtgtctgtctgaaaaaagtcacaattgaacctcatttagcagtgagagtagacgtcggtgaaaactggcagggccttaaaggtgatcctttagatccatgaaacacacttgcactgactcctgaaaggctgcctctgtttaggacctagtaataggagcctgtgggtaaaaggcaagtggtagccctagcccgttctctaatttgattaatcgtaattgcaggtacttgctttgcctattatctccccagctcattgcctgtatgtccttcagcccagcactgctaagcaggcacgcagagagggtgcagaagtgctctccctggtagtactttgtgtgctggtgggtgcactatcaaaatgaaactgtgcccactcagaattctcagtaggaaaagttaaggagcactgtacttttgatgacaaacaggaacacactgtccaaaccagcaagcggtgcaagctgctttggaaaaggcacatccgcgcacgccgagtctttacctaatggccagattccgtacaatgtgatgagctgtctgacatccaggagggagggcatgggttctatggacacctggcgaagagtagtccccaggtagctgtactcacctggagagaaaagaaacagaggaacaataaatggaaaacagcgctggtctgagctgcataattttggcatctgcaaaacgatcggagaatacaaattgaacatttcagagcaaagagaatcctattaggagagtcattatgaagaacacatcttttctcagataaaggtttgaagaaaagctatccaggcaagaaagccctgctctactagctagagtaaactgggaatgatgttgactattatattagcctcctaatactttctaaaacaacatttgaatatagagttatgtgaaatgggacaaagtgctaaaaagaaggacacacaaaaaaggctgaaatatagggggctctgctttatttatattccaatagattatgtataacatttgtgcaaactttataaataagttatttaagatcgatgtagaatttgtattggagcagtgtaaatctgagtgtaaaatgcagtcatttgaaaggaagggtatgagtctaatttaggataaatagaaacatctccttttgagggtaatattcatttacatttttatcatttttaagagagtaccaaaggaataatgcagaaataaatctttacaggtttaattagaagatatcaaagggcttaattgtaactagtcataaatctgaagtgttattttctaactaatttagataaggtcaccaagaaaattagtttggctgtctccatttgtcatgaggacggacctttataggttcatatgattctctcttgatctgtatctgaatctggagtaaaaatattcaatgaacgaatcaccatgtctggatttttttccctgatgctttcttcctatagcgagtcctggtcctgcagagcttcggatgctacatgtgtacagcaagtacaatatgcacatttatgtgtgtaggaaacactgaaagtatcccaagcttttaagtattttcaaatgctaagaaaatcagagttaaaattcagacagtgaccgctgttttgttgtggggcagggggcagcctttcagagcctccacatgaacaaaacgtccttggcaaggacaatgggtattggttgggagaatgagtgataatgaaagcatctattatggcttcagataccacactttttaatgagcaggtaataaatagaagagtggttaatttagcctccactagaatagaaagagatcctgtaacaaccgttaaatccagcgctcattgccagtaaacatgacattcaaggtgacaggaaagtgaccccaattttcctgcttatctaaacccatattaatctccagatgcaccatattttctagaacataacagatcttgtttaaacaaattatattcagttgaattagtgggtgttggttctaacagaggcaaggacacaagtagccccggctgcctgccaaggtctgagactcgcactgaaagcacattcctgtgtttgcagtggccccacacagaagccatgccccttcccatccgtgcattcggagctcggaaagtccagcattcccggcacagacatcagatcttccacaggggagggaagaagaaagtggcagacgaaaaggcatttaggatagagggcgtgaaaatgccaggaaacccagatcaagagggcagaaaaccaaacagcggctgcacgacaggtggaatcgaatccccttgcaattctaagtggaagtcctaatccccagcatctcagaacgcgaccttatttggaaatagggttgtcgcagatagatttcattaagatgaggtcattagagtggaccctaaatccaacaggactggtgtccttataaaaaaggagaaatttggacacagagacagacatgcacagaggcagaacaccacgtgaagataaaagcagagagggaggtgatggttttacaccaagcatcaccgaagatcgccagccacacgccaggggcagctgaatgccgtgcaggtgcagcctggggtgctccatccagccacttgcttaatgtttacagcgatttagtgaggcatttgctgtaattacctcatcccatagtagtggaaactgaggcacagaaagagtaagtaaaggcctggcatcttggagggaggcagcctcagaaagacgagaggaaggagagattccttgagcctgggaggagagaccggtcagtggtccctgagcagcgggcatccagccccaggccctggaggtctggggggccttcatgggcaccggcccccagaatttctctgcagcaccctggtgcttcctgggaactgggggccttgaggatacctagggcaggggtggggactggcaagaaggactgagtttaaatcaccttggtagtataggggttgtgaagccaaattaaagtgatataaagaaaataaggaacttgctatttcttgcacacctgagattgtggcaggtgcttgctgctgggcacagggccagttctggagcagggtggccatgcaggggtgcagcaagcagtggggtgggtggtgggggtgggctggtgggagccgagggctgggcctggaggaaggtgttgtccccagctctgcagtgcaggctttgcatcctctggctctgttcctccccttgtctcctgtagctcttatctgctgtgattctaatgactgttgagattctaatgactgttgggagttcaatggtgttgaggacagagtgggattacaaatctcaagactaaaaaaagcaacttcgtgtccagcggctgagcacgctggatctgtgcagagcattcctggcctggtggagacatccatccgggcaaccacattctgcgtccggggatccctgctcctgccctgcctggatgaagggctggggaggaacagcccacatccaccctctctcatcttctagaagcaggagaaataaacggctctgggcactcaggctttgcagtgctggcctctggagcaacggaataggcaacagaggaaccctctgggccatgcctctgttgtcaaggtgttaaaaaggaaccaagataataaattcaaaaccagggaacccaagggtgagtgagggtgcctgggtcctcatctcgttaatgctcttcttagacaagatgacgaggcatgacttatctgggtgctgagagcagtgtgctttccagaggcaggggggcattcccaagccccctgagtttatgtgatcaggaagaagctcccagctgtgcaagagcccagtacccctaaggtaggaagtctgcaatgccgtgttgtcagcgcacaccgctcttatgcattgcactctctctcctgaagccctcaccttgtcctggttttatgggtatatagagaatgctcactaccaatcctcgtgccaaggtgtctcacgtcatttttgattgtcagtaggtcattcttagcagattcttcaggaagggctcagggggaaaactgctgagttctttcatgtttatcagtttgtgtcccatgtacttgaaaataaacttggctgggtacaaaatcctaggatcctgcttcctttccctgagcatcttatgtatgtcactccatttacttctggtgtaaagcattgctgtggaaaagtctgagggtaatctaattttctttcctttccaagtcatatgatctcttttacacagatacccaaaggcacttttattagaatgtcttcttgatcaatctgagtcaatattctcagatagacagtgtggtctttcgttatgtggttttaatgttttttaaacgtctaaacccttttcccgtttgccctgagaatacttgccagaggtgctttcgaccgcagcatttaccccaagataactttgccacgaaatatctcgtttttattattatttttgcagagctctagtatactgacttcagaaacaaaagacatcattctatctatagcattctgttttcactagtggtatttccatttaggaaatatagtaattcttgattgccgaaaaatatcaaatcctaggaaacgtagcattcctatgcatgatcttgacatcgttttccagtggttgttggctgaagattcatttgatgaatctgattttttctgaaatagacaattctgatgattcagaagattctgatattagttctgtttagaaataactccaagaacagtttttgtattttattttcacattgaaaatcagtcagatttgcttcagcctcaaagaacacgtttacttaaagttaaatgatcattagcagcgagctgcactttttttttcctaaacaggaaaaggcctaaaagaaatgttcatgaattaaaattatatatatttataaaattaaaatttgagacaaggtcctgctctttcacccaggctggaatgcagtggtgtgatcttgactcactgcaaccttgaattcctaggctcaagcgctcctcctgcctcagcctgctaagtagctgggactacaggtgtgtgtcaccatgcctagctactttttattttttattttgtagaaaaagggtcttgctatgttgctaggctgatctcaaatacttggtctcaagagatcctcctgcctccgcctcccagagtgctgagattacacgtgtgagccactgtggccggccaaaattctttgcattttttctgttcctttgctttgattttcttctttagggactcgtattatctgtatgttggattttctttgtctgtcgtcaatatttgatatgctctttgaattcttttaatatccttaatttctaattttactttaaaaatttgcctttttgccttttatttctaaagcattactatttttatttgctcttgtattcattataatttatttttttctaaaacattttcccctttatttatatttattgagatttgtcacctcatttctgggttttactctttctattttatgctgttctcacacgtcttctataattctttaatgtatattaacttttttttttttttttgcgacggagtcccgctctgacccccaggctgcagtgcattggcacaatcttggctcacgcaacctccctggcttcaagcgattctcctgcctcaacctcctgagtagctgggattacaggtgtgtgccatcacacctggctaacttttgtaatttttgcagagatggtgttcctccatgttggccaggctggtctggaactcctgacctccaatgatccgcccacctcagtctcccaaagtgctggaactacaggcatgaaccaccgcgcttgacctcttactgtatattaacctgttttgaaataggtttcagtatagacctgctttgtggagatgtctttttgggaagttaatgttttcttattctttttttcttatgataattttgcatgggcattgaccttgaacttttccattgctcaaatttatatgagtgaatagtccaatacttttagaaggaagtgtggcgcaggatagcttttccagtttcacagagctccctcctctgtcgtctttatagatgttaaaaatgcggtggtttgctttctgagatgttctggctctggtcccctcccctaatttcttctgggccttctctatgcttcatctttacttttcccatcctgttcaattttgatttaattcccaagagtttctttgtagtatgggccctgtggaggaaggcactggggtgggtcaccgccccagctccttcacactttcttattccggtcctttacactcatctgctattgaggtgggccaaacccctcctagtttcagctttgattcttacctggcccactgcacattacctggcccattgctctctggttattttggggtctcctgttctcaggtcctttggtgtccctaaagcttgtactttggggctcaatggggaaaatttgtcatttagttttggtgcaagtgttgcctggggggttttggtcttgttttctagttgctctattttactatgtggggatttgggaagatacactgccatctttcaagctaaggaccttaactgggaaaaaatgaaaatatggacaggggaaaaaatgaaaatatggacaaggtcaaagtgtgccagattttggtggatatttgactactttggttagattgagtcattttcacttagagtctgtatgaatttgttcttgaattgctataaagaaatacccaagactgggtaatttataaataaaagaggtttaattggctcacggttccgcaggttatacaggaagcatgatgctggcatctgctcagcttctggggaggcctcaggaaacttacaatcatgacacaaggcaaaggcggagcaagatgtctcacattgtgagaacgaaagcaagagagaggaaagggggagatgctacacacttttatttttatgtttttatttgtattattattattttttgagatggtgtttcgctcttgttgcccaggctggagtgcaatggcgtgaccttggctcactgcaacctccacctcccgggttcaagcgattctcctgcctcagcctcctgagtaactgggattacaggcgcgtgccaccatgcctggctaatttttttttttttttttttttttagtagagatggggtttctccatgttggccaggctggtctcaaactcttgacctcaggtgatccgtccaccttggcctcccaaagtgctgggattacaggtgtgagccaccgtgtccagcctgctacacactttaaaatgaccagatctcgtgagaactcactaccatgaggaaagtcccaaggaggatggtactaaaccgttcatgagaaactgcccccatgatccgctcacctcccacaaggccccgtctccagtactggggattataattctacatgaggtttggtgggcgcacagatctaaaccacatcaaagtcactcttaaacggctgactccacccactttgatcttaggcatcttaaagatgcttcctggaaattgacagatcattgaaaaagttcagaagggatgagaaattaataattagttgagaagtcagtccgcacataggtaatgagaatctaccacgtgccaggcactgtactcggcactaggatcttttgttcagaaatccaaaccataaataagagacagttctgttaaaaacagccattttaaaatattaacagaattaacaaaacagaatcaaggtacaggagaaaattctccagcacttgaagaagaaacacagaaagtaaaataaatagaaacccaaaacatatcttaataaatattccagcaaaattcttatgctattaggaaatgtgagggctcctttaagccctcaagaagaaaacaaggctgtcttgcaaagggattaaaataaccaccctttgatcaaaggagaatgccagccttcttgccctcacagaccaaaattgggtcaatgtaaataccaggatggataatgatagggacagacgataatacattgaataaaaaaagaatccatgtgtctacactgataacgcaattttaaaagattccacacttcctcacagaagaatgatatctattcaatgtagaaggaatgatagaaaaatctccacttttacaactgctacagcaataactgatgcagatacaaaatcatcagtgggtgctaaaacgctgcctgagaggctgctgggaacagaatctccacagcctcaaaatatcaccccttggattgattgttcattaattataaagggaaagatgatgctttacagtggagaaatcccgggaacagcacctaagccacaggattaaacttaacctcaccactgatgggacaaagtggcattaagtgcccccagtgggaaacactgacagggagacaccatcattttcctgtcaaaatgtttaacctgaatcgaataatgagaaaaccatgacacacattcaattgagagacagtctgtgcacagctcagactcttcaaaaatgtcagtgttgtgaaagatggcggaaggctgggaaactgttcctgacggaaggaattacgggagacagaagagacacaacaatcacttgcaccatccttggctggattttggatggagaaagacaagtatttatacaggacattatcaggacaattgggaaagctgaaggttcactgtatattaggtaacagtattgcatttgattttctgagtgattttccttctgtggttatgtaggagaatgttgtcattcattgggggtaatttcttcataaaagtaaaactaataactgcattacggtagtacagttatgaggaattttaagctttaagtgtgttttcaggtcatcatggtgttttttaaaaatttagagaaaaccattaggtgaggctgtgataacaaatgtccccacctcattcctccccaatatttgtgtctctattggaaggtatcttttggaaagaattcctccagtaaggattctgttgtggaggccttaggtgctgccccaggtgcattttttacaagtgaaatcattaacaattccccatttccttaaatcagattatgccagaaagaatgcaccaaggaaccttgctagtaggttaaaaacctgcttctattacgttaggggagagagctgcaaccattttattaagagaatctgttagtccacagcatcctcttaggttatttgaatcaattcaatccaacaaacatttaccaggagccaccatcggccaggttttggcttgaacaaaaatgtaaataaaacatatttccggctgctgggatttcaaaacacaagaggtgacacgtgacacatacatgtattattctctgtgtactcaccaatgtaatcagagaggttgactttcagagcctggatcagtaatccttcttccaccagttccttatacagagactcgatggtcctggggagaaagcagagtgtctgttccagaggcacacacacagaaatcggcggtatttctgttaatgatcacatacgcggagaacttaaaccagatctatttcaaagtacatttgttcatatgcaaataaaaggatttttgaagtgtttctacaatttggggataaattaggctttttaaaaacaatactttcactcatccatgtgtgtatctgatgtttcccattaataagaacgatatctttgggcgtctgggaccagctctaactcctgcagtctgcccttccatcagtcttcatgatggcacaaatatgaattagaaattacccaataatagtaatgcaatggacctataattatatattcggctagcatcttcaagctgtagtacatcattaatcctttgtgaaatttatgtttccttttaacccaattgcacaattgtttgaaagaaacatctacaaagaacaaagacttatactgaagataattcttatatggaagataaaacgtctaaagcaatgagggtgatgattttttaggagggtgttatactttacagagtgtttacagatgtcaaaaccacttctctaaaaggaccttgagcatatagccagcacattggtaatttatactaattgagaaaaaaatggacatagtatcccacataacggatgaaactcccaatgatacttgctggggtttggcttgcagaaattagataggttaaactcaaatattattcagtataatccttcgagatgttttgtcttttcctcttctttattctcccatcctactctggtctttctctaagttgagaattgtaaatacaactttatttagacagttcttctgactgtcctgtgatccaagttagtgtgattaaaagatacccaagaatatcagttagacccaagccaaatactattcggggaaatgttaatccaatgaccctagtctttggatgactggagttgtattgcatcaaacatttaaagtagtatgccctctgctgaaagttaagaaatatttaatttagtggaatttaggatagcaatatttgacccatatatatcaaggaagtatcaactgtagtgttttaacttgaatacttatttaatataaacaatatacgcataaaatattaacataaatttgaagaagattctctaacaatcgaacaaatgatattaagaaggtctgaggctaggtgtgatggctcacacctgtaatcctagcactttgggaggctagggtgggcggatcatttgaagtcaggagttcaagccaggctggccaacatggtgaaaccccatctctactaaaaatacaaaaaaattagctgggcctggtggtgggcaactgtaatcccagctactcaggaggctgaggcaggagaatcgcttgaacaccagaggcacaggttgcagtgagctgagatggcgcaagttctctccagcctgggcgaaacagcgagactccgtctcaaaaaaaaaaaaaaaaaagctagaagacaccgtggcacagtgtgtgagcatgggctgcaccctcctcaagggatgggactccgaggcccctctgccccccaaatctgccccaggaggtgccggtgtttacgcatggacagatgtgtgcctccccaggaactggggcacctgagactcaaaacgctgaccagctgcttcttcggcagcagtcagccacagcatctcgacctggaactgcttctcaaacaatgcagccttgagtggagaaacctgcagcccctccccctatggatgtcccgtgacagccatttctctagagagcagaaacccacactcccccgactgtgtttccaggggctgcttgccagggccgcggcagtgttctggcctccctggaggccacagatgcccagtgcccctctgggtgctctgccctcctcttccccccgcagagagctctaggcagggctttctccctcactgagcttccctccaacagagtttggggagagtaatgctgggacacagggagaagcaggaacccccaaacagggtagcgacaggactaagggaagcggagggaacccccaaacagaagagtgacaggaccaaggggagggaacccccaaacaggggagcgacaggaccaaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacctccaaacaggggagcgacaggaccaagggagaggggagggaacccccaaacaggggagcgacaggaccaagggagaggggagggaacccccaacagtggagcgacaggtgttgatccattaataagacctatgggaagaaaaatatacattcaaaattacttcccacattattagggattttaattaaattccttgataatatttgaaaacctacgtactatttattttcagtgttaaagtactttcaggccacttcaagttaaaaatgaacacttgaattcattcgtcctgcactgaagctgggcccatgaagctctgagaaaggacaccgcccttcctgagactgggcctcactgctctcattccttccgcggcaggagcaacggcctcagcagaggcgctcgggcagattcctgtcctgtgagaactcagagtctccgtatttcctcaaatgcttcaccagggtgttatttcttaaacaaaaaacttaaacaaaaaattccatgaattttaaaacttaaaaaaatgttatgacgtcagaagccatgggggtccaggtttgccttctgggccacccaggcatctttccagtctgggatttgtagggacttagaggtggctcccaccactccgggactgtggaggatgaagagggcgtggcatcacagagggggcgtactcggggttccctgtgctgttctctggggctgctcacgcgcatcacaacacaacgagtccattcctcacctgtcagctgtcagatctttatccttctttgccttcttctctttctttttgcctttctttcctttcttctttggaaaaaaaggaaataaccaacaatttagtcaaaacaagcaagcaaataagtcctagaaattagctaagcacgttgttttctgggggtggtgggaggtggaaagttaattgtggtggcgtgaacacagagctgccgtgttttcatgaacgtagggactggcctggaaaatcccaagttgcttatgtggtgtgtccttgtgtggacagacgtgaggtccccactgtggaacttgcacagggccaaattccaaacagggaagagcattctgactttctgggctctggcttggtgtcccacaaaggatgagagtgccgtgtgcacatacaggagtcaagctgtgctcacctttggtgcctgatataagctgaatgcttgtgttcccccaaaactcatgagttgaagcctacccccaaggtgctggtattaagagatggggcctttgggaggcaattaggtcacaagggttccactctcatggagaggtctgagggagcttgttcacccgttccaccatatgaagacacagctaggaggaaccatctttgaagtggataatgaggcctcaccagacacaaaatcaccagacttcgagtccgctggtgtcttgatcttggacttcacagctcccagaactatgagctattaatttctgttgtttataaattactcagcctaagaacgttgttatagcagtccaaacagactaaggcagtcccaatcgcctttcacagctcccagaactatgagctattaatttctgttgtttataaattactcagcctaagaacgttgttatagcagtccaaacagactaaggcagtacccaatcgcctttcgcagctcccagaactatgagctattaatttctgttgtttataaattactcagcctaagaacgttgttatagcagtccaaacagactaaggcagtcccaatcacctttctctgttggcatctagccccacatctggagccctcagggcctggcaacagtctacctctagttcccaaggggctttgcactcaggtacttgtgacagcctagagagacatgcttcaaatgtgcttatttcatgtgcttatttgccatctgtacatcctcttcagtgtgatgtctctttatgtctttcacttgttttctaattgggttgcttgtttcttaacttctgagttttgagagttctttatatgtttattgtttcagagttctatatatgtctagtatatgaatactagatctttgtcagatatgtggtttgcaaatatttcctcccagtctgtagcttgtctttttatcctcttaacagggtctttcacagagcaatcatctttagttttgatgaagtccaatatttccttttaaaaattgtgttttggatgctaattctaagaactctttatctagcctagcccccaaagtcttctctttttgtttttctaaaagttaagtctgtgacccattttgaattaatttttatataatgtgtgagacttaggttgaggtccatttctttttgcttatggatctccagttactctggcactacttattcaaaagtgtctctttcctcctttgaattgcttttgcaccttcatcaaaagtcaggtaggcatgtttgtgtgggcctatttctaggatctctgtcctgttccactgatctatgtgtttagctctttaccaatagcatacagtcttgattactgtagcaatatgataagccttaaaattgagtaaattggtccttctcactttattcttctttttcaaaattgctttagttattctagttccattacctttccataaaaattttagaataaatttgtctatgtctacaaattatatttctgggattttgatagaattgcattaatcctatcctataaaaatatcctaatggacatttttactatgttgagtcttccaattcatgaatatggtatgtctgtctattcagatctgctttgatttctttactggcattgtgcagttttaacatacaagtcctatacctgttttgttagatttacacatatgtatttcattttttgagtgatttaaaaatcacattccattttaactttggtgtctatgtattcattgatgatatgtagaaatataattgatttttgcatgtttatcttatatcctgcacccttgctgatgtaagctgatttggagtttgtagattccttgggattttccacaagaaaataatgtcatctgtaaacaaaaccttttaaccttataatagttttagatttacagaaaaattacaaaaacagtacagaaatacctctcacataattttccatattaacatcttacatcaagtatgggacatttgtcacaactaagaaaccaacattggtataatattatcaataaaaacccgaagtttattaggtttccactaatttttccctaatatccttttgttttccaggatcccaggaaggttttggagtactgatctaacgtctttatttgttattggtgtgttgaagctttctatttcttctagatttggtcttggtaggttgtatatttctaagaatgtatccatttcttctaggttgtccaacttattagcatataattgttcataacagtctcttatgatctttttcgtttctttgacattggttgtaatttcctctgttctatttctgaaggtatttaaatctcatctttttcttagtctagcacagagtttgtcaatttttaaaatcctttcagaaaaccagctcttagttttatcattttttcctattgtctatctattctctatttcatggatttctgctctaatctttgttatttcctgtcttgtgctagctttgggtttaatattctcctcttgatctagttccttgaggtatgttggttatttgagattgttcttttttaatgtaggcatttattgtgaaaaacttccctcttagtattgcctttgctacatcctataattcttggtatgttgtgtggtcattttttttttttttgttttgtttttaaaacaacttttttttttattatactttaagttttagggtacatgtgcacattgtgcaggttagttacatatgtatacatgtgccatgctggtgcgctgcacccactaacgcatcatctagcattaggtatatctcccgatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggttgcatagtattccatggtgtatatgtgccacattttcttaatccaatctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatccctgaggcatcgccacactgacttccacaatggttgaactagtttacagtcccaccaacagtgtaaaagtgttcctatttctccacatcctctccagcacctgttgttgcctgactttttaatgattgccattctaactggtgtgagatggtatctcattgtggttttgatttgcatttctctgatggccagtgatgctgagcattttttcatgtgttttttggctgcataaatgtcttcttttgagaagtgtctgttcatgtccttcacccactttttgatggggtctttttttcttgtaaatttgtttgagttcattgtagattctggatattagccctttgtcagatgagtaggttgcgaaaattttctcccatttcgtaggttgcctgttcactctgatggtagtgtcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgcataaggtgtaaggaagggatccagtttcagctttctacatatggctagccagttttcccagcaccatttattaaatagggaatcctttccccattgcttgtttttctcaggtttgtcaaagatcagatagttgtagatatttggcgttatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgacgcgggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaactgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcgttttgccagtattttattgagaatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagctcctgttattggtctattcagagattcaacttcttcctggtttagtcttgggagaatgtatgtgtccaggaatttatccatttcttctagattttctagtttatttgcgtagaggtgtttgtagtattctctgatggtagtttgtatttctgtgggatcggtggtgatatcccctttatcattttttattacatctatttgattcttctctctttttttctttattagtcttgctagcggtctatcaattttgttgatcctttcaaaaaaccagctcctggattcgttaattttttgaagtgttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcacttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttatgttcgctgaggagagctttacttcccagtatgtggtcaattttggaataggtgtggtgtggtgatgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttcagcctgtgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgacgttagctggttattttgctcgttagttgatgcagtttcttcctagtctcgatggtctttacattttggcatgattttgcagtggctggtaccggttgttcctttccatgtttagtgcttccttcaggagctcttgtaaggcaggcctggtggtgacaaaatctgcagcatttgcttgtctgtaaagtattttatttctccttcacttatgaagcttagtttggctggatatgaaattctgggttgaaaattcttttctttaagaatgttgaatattggcccccactctcttctcgcttgtagggtttctgccgagagatcagctgttagtctgatgggcttccctttgagggtaacccgacctttctctctggctgcccttaacattttttccttcatttcaactttggtgaatctcacgattatgtgtcttggagttgctcttctcgaggagtatctttgtggcgttctctgtatttcctgaatctgaacgttgacctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcactcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctatttgagtacccagctgtgtgaggtgtcagtatgcccctgctggggggtgcctcccagttaggctgctcgggggtcaggggtcagggacccacttgaggaggcagtctgcccgttctcagatctccagctgcctgctgggagaaccactgctctcttcaaagctgtcagacagggacatttaagtctgcagaggttactgctgtctttttgtttgtctgtgccccgcccccagaggtggagcctacagaggcaggcacgcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaaccagcgagactccatgggcgtaggaccctcggagccaggtgccggatataatctcgtggtgcaccgttttttaagcccgtcggaaaagcgcagtattcgggtgggagtgacccaattttccaggtgccgtccgtcacccctttctttgactcagaaagggaactccctgaccccttgcgcttcccgagtgaggcaatgcctcgccctgcttcggctcgcgaccggtgcgcgcacccactgacctgtgcccactgtctggcactccctagtgagatgaacccggtacctcagatggaaatgcagaaatcacccgtcttctgcgtcgctcacactgggagctgtaggccggagctgttcctattcggccatcttggctcctctgcctgtcatttttgtcttgagatattttctaatttccctgcgaatttttttctttgactcaatggttattcaagagtgtgttgtttaatttccgcatatttgtgaatttttctgtattctttttgttattgatttctagtttcatttcattgcagctggaagttacttggaatgttttcaatattcttatatttattaagacttgttttgtgacttagcatgtgatatatcctggagaatgttccatgcatactcgagaagaatgtgtattctggtgctgttgggtacaataactgttaggactatctggtccctagtattattcaagtctgctgtttccttattgattttctgtctggatgatacattcattactgagagtgggatagtgagttctcctactattattgtattgctgtctatttctcccttcagatatgttaatatttacttcatatatttaggtgctttgattaaaggtgtatatataattgttatatcttcctattgaattgacccttttatcattagttaatgatctttttggtttcttgtgatagtttttgatttgacgtctattttgtctaagtatagccatttcttctctcttttgcttattatttgcatgagatatcttttttccatcccttcactttcagcctatgtgtccctaaatctgaaatgaatcacatgtatatagcatatagttggatttttaaaatccattcagtgactctgtatcttttgattggtgagtttaatccatatacatctgaagtattttttgaaaggtaaggacttacttttgccattttgttaggttatttctattttgaggttcttttgttcttctctgaagttacaagttgctgtgtaacttaacgatgttttgtagtgatatactttgattcttttctggttctgggatccaaagacaggcccaacgctgatttttgtgggtgggcccacaaaaataaagcagcacaatggttgcagtaaatgacttgctattactacaccacaaaagtggagaaagctgccatagaagcaaggtgcacccagggtttgtgggaggcccatggttctggggtccaaagacaggcccagtgctgatttttgtgggtgggcctggtgtcagggtttgtgggaggcccatggtactgggtttcactggcctggtgctgagctccatggtgaagtcagatgttcacttctctgtccctttcttccaagataaaactcatgggtctaggagatctctcttggcactaggctgtgtgggctttggggtgacatgggtaaagtgaaactttcattcttactctcttcagtgcatctttttttttatgattctgtgctccacccaggtgctgcagcctctcacctgaatcccagagctcttgtgaagttactttcatctatggatggttattaaattggtgttttcagcttacagtgaaagatcttcagaacaccaattcagttgccttcagggttaaaccataatatcaacacaaaatggatcaagagccagtcatcctaaaaagaccacatgcatggcccctgatctagcaaaagtagtcacaaatgcagctgaatgtgtggaaacctctaagagaaaatgtgtgaatcacagaaagagtggctccagtcatggaacgtggagaaagctgccacagaagcaaaggctgcctatgctcatgccagcactgacagggagaactctccgccctctaccttgggtattctggctccaatgacagggctgtctctggaatgaaggtagaagcaggggccaaactaaatgaacttcaaataccctgatctaactagctactctaaaccactgtgagatggattggtggcaacttacacttccaattcatccaattcctttccctatgattccctcactcacaaaaacctgctcattaccattggcctcccttatagatctatgtacaggaacagttgggggctgtttggggaatgtgctttggctcttttgatagttcccattctatcagtggggcttgggtaatatgaatctgcaactgaccggggctggggagatgttactctcagatggttgggtttatcctatttatgaatccacaggcccaaaggttaaatggtggaccaattaaatttaccaaaggcaggcatgtttccccgtgaggtgtcctggcaacaggcggccctcctggacatgccacagcatgtcaggggctgcttttcatgactgaatccgctccaccgcacccctctgcaggctccttccccactcaccttgtcctttttctttcctgctttcactgggcgctccctttctctgtccacagctagctttaagtttttaagttcctgtctcatcaactcatcaacctaggagaatacaaaacatactacttttaagtcactttgcatgtcttgtgttttgtttgtgaagtttaaaaatcccttaaattatggggtaggtcattagtaggaaattgtaaagaagcacaatggttgaagtaaatgatttgctgttactacaccataaacgtagctgtacctgtatcctgatctctgactgtaattcttttcgtttctcctctttgatcagttctggatcatagtcctgagagaaattccaagactcatcttttttcatccagatttctacactccagaagggtaaagaaaaagaaaaagaaaaaattttaaaaagatataggttaatgaaattttaaaaagacgtaggttaattgtaagttattgcaatataaacataagcctaactttatatgttattgcataggataaaagtttgaataaaataagctggacagatgagattcatatatgtgcttgtaaatgcactaaaaaaagaaaaaaaactgctgatgtaaaaatattgagttttagtttactcaatattttttaagtgtgatacaatagtattctactgtattattataatcatgtaaaaacaatatgttaatgctgggattatacaatcacagatgaccttttttgtaatgttttatcttactttttttcttcaaatgattcactaaaatacgaaagattttgttgcctgttgaactctccaggaattatcccttgcctcctattacaaaacagacaacactaaacacacaagtacccagtatttctccctaattcaacagctaaatttctgaattactttttggatgtttttgaaatcacacatatttaaaatttcccttttgcctcttcctggtggttaggagggtggacctggagaaacatgaccctagacaaagtaagaataatttcccatcactaaaataaatggaaatagagctcctttctcagaagggaggttccaaatgtatgctgaggtgtggaatagctggatcctcgacgtgggacttggaagaggtctcccatgggaagccaagacttgtcatttggggaaggagacatctttctggaatctatgtcgagaatgtaaaggaaatttgctggaatttgtgaagctgacaaccgccacccagtctggccacttcactgggagctgcctttagggttctgatgaccttcaacctaggaaggcagctgaggacccagggcacagacagaggctcccaacctctaagggacaagggctgccccttgtgaagacagcagaggctgcaggcctccaaggcagggggtggtgaatgaatgagggaggcttctcagcatggcttccctgacaagcatggcatgacccactgaccgagaagggagagggtggtgctctaactctacattgggaggaaagtcatagtcacagacagaagcacaaatctggctgctggagacccagagccatcaaacgtgaagacctagcatagagacgtttccccagagaattacatgggcaaactaatgggaaggaggggttgagtctctgaacaaaccacagaggaccaggaactggcaaaagggatggacaaggaaaggggcagggataaggtgctgtgagacccgggaaaagctagactctcaggagaggtggggaaagcctggggagactctgaggcaaactcagaactggtgaataggcaggacaattgtcccgagggttttggccacctgccacctgcctggggcagcacagcttggtgcaagagccactgtttgtggccaggtggaacccctgccctaccacctaccagctggtgaccttagcaggggatagcctttgcagagaccattcccctttctgagaaatgaaaataaccccttcctcacgctgatatggtgatggtaaatggaataaaatatataaagttgtatgaataaattaatttttaataaatatttatatataaataaatatatacagttccagtttagccccaaatagttgctgccatcccccaggaagcagagcatctcacagggtcttagcctacctcattgacactctgtacccctcgaggggagaggataatgcaggacagcagctacaccagaaacagctatgccccaaagccccaaagcaggtgcatgccagcaaagaggaataagggccctggggccagtgcctgcgtctttagtggtcagagtcaggaccctcaggacaggacacctgcaggaagacaggacatggaaatgcagctccagttttcaaaaagagtgggttgggccaggcgcagtggctcatgcctgtaatcccagcactctgggaggccgaggtgggcagatcccgagatcaggagtttgagaccagcctgacgaacatgatgaaaccctgtctctattaaaagtacaaaaattagccaggtgtggtggcgtgcacctgaaatcccagctactcaggaggctgaggcaggagaattgcttgaatccaggaggtggaggttgcagtgagctgagactccagcctaggcgacagagcgagactgtctcaaaaagaaaaaaaaaaaaagtgggttgggttcacaagctgcagctgctgataccagaggtgagcacagaaggggcagaaggggttgtctgccacacacggcagaggcaggtccacctgccttcctggacagactacggcacggatggctcagcaggtgtctgagcggggtgggtggtgggggttccagcaggacccagcaagagctcttggctggcctacctcctaccagcaaaccgaagggcagggctgtgtgtgtattgctggctgagcaccatctctgccacagagatatggaggaccagcccgtggtggcgcaagggcagttgggcaggtttttgaaaatgatgcagaaaatgatgcaaatttctttcagaatggctaatgtgggcttacaaacagacagaaaataaatcacaaaggtggtaaatttttcataggaccaatgcacttaggcgtccttccccagacagggcagtctcataagaggtggcccagggattgggggcacagcgctgggggtgggaagggggctcagatgggactctgaaggtgactgcagaggtgaggccaaagttcaaggggtgtcttcattcacacggggcaggtggccagcccaaaacaggtgtgacgacaagaggggagaagaggcgaaaaaggctgatgggctggagtgggcctacaggaggcagctgggaagcctgggctgaacaactctctttacacataatcctttccagtgagagccagcccgagagccaaggtatagaaaacaagcattgcatacattgtctaaagcatcccattggtggaagagatacttcatgtcactaatatgtggaagttcgttctttgctctgcactcccttagattttgtggttagcttgtaggaggtatgtactccaaaggcccggagagtttacgactcctgcatttgaagtgaattgctcttttctagtaaattttctgaaatgtacataagcttaaactgtgaaaaacttcaaaatgtaggaataacacgtagtgataaaacataggaaaaggaatcaatgcttccttttatgtgtttaaaattgtaagcattctccttcgaaaattctagaaaaggtttaaatgtgtcataatgtgctgtttactaataataatcccccttgtaggatttctaaatcttctgcaatagcagcacctacctgttacatcagggcattttaaacaaaacagctttgttagtaacgggaagctacttttctttttcactagattcactaaaatcaggaaataatgtatttaataataaaaggaaggcagaatctttaacagaagggaaaccatgacacgattacttatgtagaaacagttgtacggtagaacacattctcattctggagttgcaattatatttaaaataaaacactgcagagccgttttgcccatttcccctctagatcgtttaaatggattgagttttccactgaaactttgcttttctcatgacacttttgcgcagggcacttttcaatcccttcaagaatttcatggacatttataaatgcaggaagctattcatggccctcaaagggcaacaactgccccactctctcctagagcggagaaagagcttttatcctaagaatgtgaaaagcgaggccaaggcagtttcacacgtgggggggcaatgaaagaggggcgggggggggttaatcttagtgattaaaatgctaatgttttatttgaagaggaaaacctttgatttttaagaaaagaattctaagaggaagacatttaattccttgaagttaccaaagacctggcagataacaagtccaatgccacaacatccaaccaggaaaatgacactacaggcttgcttctaggagggacgctgcttgctttttcagtcttaatggaaacagatattacacaaaaggcgtggacagttttcagagcttttgggccggtcagcaggttgcaagagttggcttcccatgggagcattagatttctctaatgcttaacgtttgcttgtatagaaataatacacattgttttaaacaaagtcagagtattaaacagattataataaaaaacctgtcccactctatctacctgctaattacattatccaatggcattctttcctatattcatttattcattaaaaatacataggtcaaattcagttattacattttgactttattgagccgattataggccaggcactgctctcagagcaggtggataatggaaggccctgccctcaaggacttggcattgcactgtgagaagcatccgtgaacacacactcacacccaagtggtaagtacagcgagcaaagggtgggcgcgggcagagggggactgtcactccacaagggccctcaaggaaggggcctcactggcactgaggcccaaagggacaagcattctgagccagaggaacagaaagcatgagtgccggaggtggagcgtgcccagcctgctggaggaagcgcagtggccacaggggcgtgtgtagcgatctggtttcgtggaagctctttcgggtggtttctgtgttcttttcctagtgtctatataacatgctcatatgctacttcttgatttatccatgtcagacatgagcccctgacttcctgccatgggacagcaggcttctgctctctggctcctttcttcctgtgccctcattgtctttacatagtcgtatcagaagagaagggagccctgctttccacatcctggggcacctactgtctgagtgtaagtgaaggacagctttcagatgcccagggcagccacaactcccctctgtgagtcccttcttgggacatcctagagaatgagctctaccaaaatgagggagaggcaagaagtcagcaaaggccaaggaaggctcaaggatcgcagctgagacggagggctccacaaaggtgctcttcggaagaaaacaaattagtaagttacctggcatgtttgaaggtgtgggagttatcttataggtacatgcagtaccaaaccagtgagggtggctgtaaaggccaaatgatgatatgcaaagcagagtcttagatgggatgttgttgcagacacatacctgatgccagtggaccctagccaggcccacggccccactgtgtggatgacagtaactcccagcaggacccactggatgttgttactgtcatccgaacttacagaaactactcagtttatgccactatctccaccccatcccaccactgtaatccccaacatataagctcattgttggcaggtgttacctttatatctctgggctagcactgcacctgacaccctggaaatgctgaatgtttgttgaaggaatatgcaagtgaaaaggtgtttttgatagtgactgctctgcaccattaaggagttgatggattcttaagcttggatgacagcggggcttctaccagtacctgcccatacgaggagagcaacatttacctcccccagttgttgtgaatattaaatgagatgggcatggaaaaactccaagccttgcacgtcttaggtacttaataaatgttagtttccccttttgacctcctttcttcccagtgaaaatggattgagttgccaaatcctgccagtgtcatcgtgtcccccagggttcccctttagttcagcatctcatgcagtggggtgcccttgccactagtggtatgtaagagaattttcagtggcacacagacatttttatcttatatcactagcatatcaaacctatgaccacattcatattgttgcttaggataaggtgcaattattaaggtgaaagccctgagtcaatttaaaaatacatctattaagttaataatatccagagaagaccaaggttgggaaggaggccacgaatgactgccatttggaaagattccacttcacatccggattgcaactttcagaaacttccacactagcactaatgactgaggtcaccttggcaggtcactgtgtttggatttatcttgagggcacagtagaaccacaggagttcggtaatagttctaggaaattaaaatgcaaatatctgaaagaccagttcctacacttgcggatccagccagatgacagctatgctcatcaggctgaacaactgacagaaaaatcgtgtgtcagaattgaggcacacatcttagtttaataggaataagacatttgactacacatacagtatcaattttcttaatttaagcaatctaaaaatatgtttcttccctgccactagcatgaaaacattcagctgaagtcttaggggttcaaaaacaggatggaggtcttgactatcttctcatcctatatgcatcttgccttttaaccaattgtatgcttaaggccaccaaaaggaatttttttttttttttgaggcagagtctcgctctgtcatccaggctggagtgcaatggcgtgatatcggctcactgcaagctccgcctcctgggttcaagtgattctcctgcttcagcctcccgagtagctgggattacaggctcccgctgttacgcccagctaattttttttatttttgaagagatggggtttcaccatgttggccaggctggtcttgaactcctgacctcatgtgatctgcccacctcggcctcccaaagtgctgggattacaggcgcaagccacctcgcctggccaggaaatttaaaatagagacaggcagaatgtctcggttgtgagtggcatacagcagcctcccgtgatggggttcccagcacgtgctgctgtcttggtgaccatgcacgttctcctaaactgacctttgtatgcgttacatccttccttcattgcaggaagaaaaagacttggtgacattttccatttttcgtcttcttcctgttcaaagcagaatattttcgttaatctcaggcaagaccgggcagcaaaagacgcagacgctgtgataaccgtgacgagggtccatgccgcgcaggcccagtcctggtccccctgggcagtgcccctctggcccgtctaagtatggagtgctgtgtccactgaccaggcatgggtggtccaggctcaccgaagcatcccctgctgataccggctttctcttctcagtggcctcccctggggtaccccatgccccgagtttgatcctgtcttcttttttgattaaaaaactttctttctttctttctttttttgagacggggcttaaacaatcctcctgcctcagcctccccagtagctgggactgcaggtgtgcaccaccacacctggctaatttttaaatttttctgtagaggtggggttttgccatgttgcccaggctggtcttgaactcctaagctcaggcaatctgtccccctcagcctcccacagtgttgggattataggcctgagccaccacacccggcctggtcctgtcttctcatgctctcactccttccttgctctaaaggctgagttcctagcctgagtccatctgcctccctcctccacgttgctgtaaccagcccttggagctactccgagtcctttgctgagctgtgctgcttgccagttctagcaccagggctgttccttcctctcgctacctgccccatccttgagcctggagctgcagcctgactctggggccctgcttccttcccggagccagagtctagctagcctccctaccctgggccccccacagcagagagagcctggccaccatccttggctcctgctgctgactctgtgcaccaagatgggagattgcggtgctacccgccgccagcccaggccatagctctgctctgagccccagcacaacaccccctctgcccctctgccgccagggttcacctgcgcctaatagtgagagctaggccctgcaaaccctcatgtgatgtttctctgcaataatgttgacactgcctcaatagtctggtttccgatgaccactatcatggctattgctacccttagagagggcgaaaggaacaacgctggcctccatttggtcctcgggttcccgaagcaggctcagtactctctatgcagtgacaggaggggcagcagttgggtggcgcgggcgtgcctcccctgggctgcttccagagcacgccctgactctggcacctgatgggctcttccgtttctgggctccagggttgggctccgggatgcggtggcctgaacacggtgcccccacagtccctcgtggttgtgtagtatccatgcatcagatccagaggtatttctcctctctctccccatggccaagcaatcaccaaaccccactgttctgccgtggaggctttcctggggtctccctgcttctgcctccagtcccactgccctggccccttgctccaaggttggctaacgcagggtcactctcttctctcctgctggaaggggtctgcagcagacctggccttacgacttccttccttggaagccccacagaggcatttgtcttggagctcctgggaggcaccgttccccacaggacacagtccaagcccctcagcagaccacacacaacccccacaggtgtggtccctcaggagtgcccccgcccacctctggggcctttgcccttgccgcctcctgcctctgccgtcactgcagagatgctgacaaggccaccctccctgcacctgccatgctctttgccctgctgtcctgtccgcttggaaggccacccttgtcctacactttctgatgaattcagagtctgaacagacctcccgtcctcctgaaatcctctctgatggccttcctgcccttttgacaggattgtcacttcctaagaacagcccgcttttcccaccagacacagcaggcaggaaggaccccgccagccctggggcctggccacttggcctgtgtgcgacatttgctggatgaaacaagaagagggaaagtataggctcaatccatggataaatgtgtaaatacaatgtggtatttccatacaatgaaatgttgaactcacccacagaaaggagcgaacacagacacgggctacggagcggaggaagcgtgaagacctaggctgagagcgtgaagtcagaaccaaaaggcctcacagtgtatgatcccgtttatatgaaaacagataaactcagggacagaaagcagatcagtggtgccagggggttggtgcggggaagagaggggggaaggggagggactgtttaatgggtacggggtctccttggggttgatgaaaatgtctccactgtcacgctacttcactgcatccctcgtgatttttgccagatctgagaatccctgaccagcagaaccatcatttctttaaagactcacttaaacttatgttctttaaagaggcactctctattgctgaggtgaaaccatagtggatacactggtttcccgatacacatgagaatacaacacaaccatcggaataaaagaggctgggtgtggagccattggactctccccagtgcgtgccccaggtggctgggaaagccagggcttcctggaatcctccccagctcagggctggcagcggctcttgctcccaagacagtgctgggttacaccctgagcaaaggcacacttggttgcctcagttactttctgaggcaactgtagctctgatcaagtcacctcctggctcaagtgtccccaggggcttcccacagccccctgagaccacgggttaccagctcactcagaggacacacctcctgcccctgctgactctcatctgtggtctattcccctgtgaatccaccacgtcttttttcagctttgcatttcagctttgcatttttcagctttgcattttgctttgagtccactgtgtctttcagctttgcatttgctcaggtcaccaggaagcaaggaagacgcaggaaatgggatcacaagagcttcaggggaggcccggggtgctcgggagaggactctcacttcatggggtgggggggcatggcaggcttgcctggaaccgcagcccataaaccatgcagggggagctgcagccagcggggaaccagggagagaacctggacccagaaacaccagggggcccaaagcctatgacacagctcacccaccttccagagcgcacactaaatcaaagctctctggtaagaaagtcccacctacgacacaaggcttgggttagctacgccccattcctggctcccaagagacccaggcattagagaaaagcctgcaagagcagcaagaaaaagactagtagtggataaagcaaggcctgggaggaaagagggagaattcatgaacgaaagagaaatttaaaatcactttaattagtatatttatcctcagatatattatttatcatctgtctgtctgtctgtctctctctttccaggtatcactaaggagtcatacatctttattactttttcgtcaatgttattgtctattattgccatttttgttttggatactcagattgttctatgtttggtctctgggagcccctacactggtgaggctgtgctcttagggatggatgaaggcaaggaagaggaggagggggagggggagggctccagggaaggagactgaggtgtgacaaagggtttccagcagaaggaacagcatgtgtgaagtccagatggggaggctgtgtctcacagggatggctgaaggaggttcggcagccgtgaggactgcgtggggctgggcagacagacatgaggctggagtggcgggagagagagagaggcagagagaagagggaggaaaagagagacagggggacagagatggagacacagagaaagaggatggctcttgaaaggaccaagagctgcagggagcttggagttggcttatgagcagggcagctacccaggagcctggtgtgaagggaatggccccttgggacatcactctggctggaactgggggttgaggggtggggaggaggctagtttgcatgcatatgtgatatccatctgttatagcagaatcatagtttatggcttaaaagttttgctggatgaataggtgtaacatggtatttaaaaaaaattatatttctttagttggtgtggctgaacttcattttatttgcttttcatttcctaactttgtggccttatcttgatttttacaaatgaaagtgcatgagcctacctatttacctgtgaacctttcctgagcagctactaagggtgggactcactagatactagaactgcacagggcctgcctctgagatccttgagtcctcctgcctccccgatcctcgctcgctgtgcctcggggccccgactgcaacacaccacagcccctcttcccccgatgccttttactaggtggttcccaggtccagggcttccctgtaactgtcacacacacgtttccccgaatagaaaccaggggtcgccttcccagatcccatcccaccactgtggctggccttgcacactctggcccacttcctgaggtgaggaaggctagccatgacccgagttctgatgctctcttcctctacacagggtgggtggcccactccactgtcagacaacttttttgacttaacccaatggagagttaaaaaaaaaaaaaaaaaagaaaaagaaaaagaaaagaaaagaaagaaaaaagaaaaaaaatccaatgccccagctctgccctagaccaattatgctcaattaagtgagaatttcttccaaggtgtgtggatattgggagtcgttttttcctaaaaccaccccaggcagctagactgaaggccatagattcattgaagttgtccttccatcagctgaggcccagttcctggagcctcagggagtctgcaccctcttcatgccctaagtctgctccagatgaagccttcctgactcctatccccatcgctcaaaagagatttccagattattcgccctcctggccatcttctgtggactgttctagctacccaggctcccagtcaagcaacggtgctggtttaatggtcatggtggagccacggccggtaacctccttggcctttgcggcatgtgaaggtggcctgcagttatgccactgtctggacattcccagcacaccatgggcctggagttaacaaagtcctcctatctttttaatgcatataccatgtagacagatatctcctgctttgaaattatatgaatggtttttaggtgtttattcgtaatgacttgaccggctcaggctgctataagaaaatagtatacactaagtgccttataaacaaaagaaatgcatttttcacagttccggaaactggcaagtcctagatcaaggtgcagattctgtgtctggtgggggctgctctctgcttcagagactgcaccttctagccatgtcttcactccgcggaaggggcaaagcagctctctggggtctctttcacaaaggcactaatctcaatcacaggggctctgccctcaggacctaatcaccctcagaggccccacctcctaacaccaccacattggtgattagctttcaatgtatgaattttttgtaggtgggtgaacacaaaaattcagaccatggcacccaacaaatgtaaatttcttacatttggcccacctaagtgacttcatgcttctggaggggagtgtttattcatgcctccgccattttccatctccattgctttccacacttgctggctgaacaaataatgaacaggtgggaggagaagtgcgttctcacctgcagaccgacctcagagttgagtcactgtagtatctgccttctctgcttggccacaccagcatgccatgatctgtggtttgttgcatccaactttcttgcctttttttgcaaactgagccatttccatggctccagttttctgggccttgctttctctggggctcctcaaatatcacagttagtagtactgagacttgacctgcccggtctctgggtaccgctaagatgctcaaccgcacagaaagcttcctttagagcagacagttgctttctcatcggcctctcactttctcttcatggcccaatcagttataaatcactcaggacaaagcagttgttaagtgaaaataaacttatggaggcctctcgatttgatttagacgatagtagtcctcctttctccaaggaggatacattccaagaccccagtgcacacctgaagcctcggatcgtaccaaccactacatacactatactttttcctatacagaaacaggcaggtagtgtatacagcatgaacatgctggacaaagggatgattcacgtccatggtgggatgggacaggatggtgtaagacttcattcacactgcgaagaatggtgcacaattcaaaactcaggaattttccatttaatacttatgggtcacacttgaccgtgggtaactggaactgcgaaaagtgaaactgagaataaggggggactagtgcatatttaaaaagctggtttatggaaactgaccatttttcgtaagtttccggctactgtgtgaactttgtcccttacacaacacagataaatgctacatggagaacgtttctaaagtttcttactgagagtcaatgggacatactgagagatgcagagatgcaaatgcaaatgtttccagaagaggctttgttatcaaaatatctttgtgaaattaggagggcagtcagagataaaccgtgcgccttcttcttgccctccccaaatgttaactactgctattatttcctgcctggcttaaagagcgattcaaatgcatggaggttttgttgaaaattttctattggtaaatatgtgcatctgaagtaggctgttgagggatggctaacatctcacactggtagggctgtggaaaaattcaaatagggctgcaactgttagattttttgaaatgaggttatatattttgaaatacatctgttctcagcggctttcagattacctgctcctcccctctgggtccgtatcctggggtgggggagaggtcgaccagcgattttgaagaggctgacgatttcccactgatctgagagtgaaataataatccccttctctagattcagaagtgaaaaccaacccagaaactataatggctgaacactatatttaaaaattaatatgcaccaaacaacgtgatagcttatgcaactaaacttgaaaaacagatcaaggatctccactattttttttttttttgagatggagtttcactctgttgcccaggctggagtgcagtagcacaatctcggctcactgcaagctctgcctcccgggttcatgccattctcctgcctcagcctcccaagtagctgggactacaggcgcccaccaccacgcctggctaattttttgtatatttagtagagatggggtttcaccatgttggccaggatggtctcaatctcttgacctcgtgatccgcctgcctcggcctcccaaagtgctgggattacaggcatgagccaccgcgcccagccacatctccactatttttgagcttgcatttagctcgtcattttactttctgctcatgcatttgcgacagcactagggaatcaacattcctcatggctttgagggctgcagagtgctactctttcccccacaaaagaaatacaagagataggagagaatctacagtgggaagtctaaaaatgtacagctgtgtcctaaatacatttgtcacaagtttctttgatggtatctgggttaatttttgtcggaaagagcttcttggttatgagtacggtagtaagaaataaaccacatttctcacatgggccatgcaagctgccagctggttactggctctccagtcctcagacttgggctggagtctacaccatgggccctcagctctctggcttttgaactctaccaccagctctcctggggccccctcttgtagacggcagatggtgggacttctcaggctccataaccaaaggaaccaataccttataatgaatgaatctttctctatataaatataaaagggcacagaagatatctatatatacacacacacacgggccacatgtactttttatatatcgctctcctattgattttgtttctctggagtgccctgactacactttcttctcaagccttctcctcacctctgctgcatcatttcccccctgtgatcctctctctctttaaagaacctcctcactgcctccatcatagccttagttttcactcctcattttttttttttcagtggaaaataacttttagtgagacctcagcagctgcaaaatctattcctggcattaagctccgtcttctactgcaatttggtctttcttgagtggtttcatgaatattttccatgaatactttcttctcttccatggtctgggagcagccatggccaaacttggcagtggtgtcaatgaacttaaggtcagtcttctccagagcccgctgtttggtctcagccagcaaagacttgtggagggtgagcactcacttcttggttcccaccacacattccttcagcatgacaaagccactggtcacttcaccatatgggacaaagccacccagagagttgatattcttgtcaggaaggtcatggtcagtggaggcattgttcttgatcagtttgtcgtccttgataaggtagccctggccgatcttagagatcaatcttcttgtgatctcagtgcggtgatggtagcctttctgcccagcacgtgccacagagaaggccacacaggcaggatgccatgccccaatccaggccaccttgcgcaagcctcagtgggtcttgcagggtagcttcttggtgtgtcaatgacttgtgacccctttgtagtctttgcccttggtcaccttgaagacgtcaatcatctcatcctgcccaaacacttggttcacaggtatgggctgctctagcctctcccggccccagtccagcttcttggccacggtgcctctgttcacctggatctccatcagcggggccttcttctggcgtggaggaagcaggtatatgtgggtgtggcagtgacatggatgacttggcagtgcttcttcatgctgctgaagtcctgctccagctgcttcttgccatccatattctgccatttcttgcagtaattggtaaaggcctccttcttagatttatgccagttgttagagaagtgctttttgcactcatcgctgatgtactgagcgaagatggtcttgaaggtctggaggccttgaggtttgaggggtttccacatagcccacaatgcccatagccaccatggcagtgtctccacaatagtcacagcctctaccacctccttcttgttcacgttggatcctagcctgttgacttcttgcacgatgtgggtcatgccaaccttgtatcccaggaaggctgcgaagtggaccggcttggaagggtcatccttagggcagctcttcaccttcccacgatgcgtgctgtgcacttccgaggcaggaagccgagggacccatgtctgggagtggaggacttcttgtgagacatcacgccatcacatcttgctggtagagcctaattttttttctttttttgagacagagtctccctctgttgcccaggctagagtgcagtggtgcaatactagctcactgcagccttcctcccaggctcaggagatcctcctgcttcagctgcctgagtagctgggaccacaggcacacaccatcatgcctggctaattttataaaaattgtttgtaggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctatcagcttaaagagattttgggctgagacaatggggttttctagatatacaatcatgtcgtctgcaaacagggacaatttgacttcctcttttcctaattgaataccctttatttccttctcctgcctgattgccctggccagaacttccaatactatgttgaataggagtggtgagagagggcatccctgtcttgtgcccgttttcaaagggaatgcttccagtttttgcccattcagtatgatattggctgtgggtttgtcatagatagcccttattattttgaaatacgtcccatcaatacctaatttattgagagtttttagcatgaagggttgctgaattttgtcaaaggccttttctgcatctattgagataatcatgtggtttttgtctttggttctgtttatatgatggattacatttattgatttgtgtatattgaaccagccttgcattccagggatgaaacccacttgatcatgctggataagctttttgatgtgctgctggattcggtttgccagcattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcaaccactgctcaaggaaataaaagaggatgcaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactacactacaaggctacagtaaccaaaacagcatggtactggtaccaaaacagagacatagatcaatggaacagaacagagccctcagaaataatgccacatatctacaactatctgatctttgacaaacctgagaaaaacaagcaatggggaaaggattccctttttaataaatggtgctgggaaaactggctagccatatgtagaaagctgaaactggatcccttccttacaccttatacaaaaatcaattcaagatggattaaagacttaaacgttagatctaaaaccataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccaccagagtgaacaggcaacctacaaaatgggagaaaattttcgcaacctactcatctgacaaagggctaatatccagaatctacaatgaactcaaacaaatttacaagaaaaaacaaacaaccccatcaaaaagtcggtgaaggacatgaacagacacttctcaaaagaagacatttatgcagccaaaaaacacatgaaaaaatgctcagcatcactggccatcagagaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcaatttctcagggatctagaactagaaataccatttgacccagccatcccattactgggtatatacccaaaggattataaatcatgctgctataaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacagaggaaggggaacatcacactctggggactgttgtggggtggggggaggggggagggatagcattgggagatatacctaatgctagatgacgagttagtgggtgcagcgcaccagcatgccacatgtatacatatgtaactaacctgcacattgtgcatatgtaccctaaaacttaaagtataataataaaaaaaaaagaaaaaaaaattgtttgtagggatgggggtctccctatgttgcccaggctggtctcgaacttctggattcaagtgatccttccatcatggcctccccaagtgctggattataggcgtgggccactgcgcccagccaattctcacttctcatggcagagggactcaggaggcagaaagaaaaccttccttttatccttccagaaattcccagttggaagactatataggaagttcatggtgctggatttcttcctgccttccatgctgttcccatcccccagttggttttagctcttcctgctgcctcaatatgtggctgtaatccagattctccagcctccattcacatgaattttcctatacctcatccgtgccccaccttcaactagagttttcctgtgcagggatatgtcctgatccgcaccactggtctttatctctcctgagtttgtcctgaacttccagctgttgaaccatagacaatggtttgactcaatagctctaaagccagccggtccatctgttcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagtactttcacccaagggcagatcttcatctgagcatttattcatgtcttcaaaaataattactgcatagctcttgagttccaagagctgtcagagatgccgatcagagtttgggtcactctagctgctgtaggggaataggctgtagaatggcaggagaggaggtgggggcactggctgggaggctggtatagttgcagctgtgagaggcaatgatgcctcttggtcaggtggttgccgtggagatggggagatgtgggcagacttgggctgtgagcgtaggctcctgaaagagtctcctgccattccatatccctcatgaagcctcccctgccactctggtgcctaagatcatcactctcctttgagtctgcagtgcctccattggccctttgcctgtgtaaccaaatatatcctttctctaagcagtgatttttgagctttttataaaagggacctcttgaaaacatgaagaaagtccacacaccttttccccagagaatgttccttcccatgaaagtttacaaacaactgcagggtgtttaaccatggggtccctgttccctaggctaaggactctattatctctgtcacccacaagccaacctctcacttctttccatcttcttctcttattgtatttcagtgggcacagaagatgctccagacatacatttccttgatggcaccctcattcctgataacttcctttggaaatgcatgacattcacttgtccatttttgtaaagtcatgcaaaatttggtttgaaatgttctaaaataacctaagaatgtggttggcttaatggttcaatttggagcacctctttgggccaagggattggagaggaggagctgtggtcagagttaggtctgctggcactgcagataaacaaatgttttcaatgtgaattgtgctgtataaaggtccaagggtctttccagaagaagttagcactaagttaaagcattttgaggctggagtgcatttagagaagactcattaatgttcatgtgatcatgttatgacaggtcaataccactttaaatcattccaaatggtctaacatgtggcttgaaaaataacagaggaaacagttgtaaggatgattgcatagtgctctattactgcgacttttgtttctaaagccaatgtgagggccacacaactgtgagacaaaggcgattactttggtattgaaagcacctttgcaggactgctatcagttagcagaaaatgtcctcctggcactagcattgtcttctgttaaagtgctttccacagagcattccttaactgcagtccacaacaattctggatttaaaactgagaactcaaaagaaagactattttttttgagagttctgtatatattctaggtgctaatccttttcagatagatagtttgcaaatattttctcccatccatagcttttttttcatcctcttcactgggtctttcagagagcaacagtttctgattttgatgaggcccaatttatacattttcccttttatggatcctgcttctggtgtccagtctaagacctctttgcctagctctagattctgaggatgtttttcctatgttttaatctcaaagcttcatagttttatgtttaagtccatgaccgattttgagtttaatacttgtgtaaggtgtgaagtttacctagagattcattttgttgcctatgaatgagagactaatttttagaacctcttatttgaatgtatttattgcgcttctttttttgtttttagtacagatggggtctcgctgtgttgcccaggctgggtgccaactcctggcctcaagtgatcctcctgaccaagcctcccaaagtgctgggattacaggtgtgagccactgggcaggactactgtgcttttgtgttttctcttccactagccctgagctgaagacgaacatcccagaatgttctgttttcttctgtctttcagtatctcagtatggaggggctccagatggatccaaataaggaactgcgaacgttcatattttaaacattaaactgtttcaccaagtttcttgatgaaaagatcaaatgcaggcaagattattaatcacaagatattttattctaaaatggtcttgtgtacaattacagagatccaccatgacaatcctgctctttctcactccactagccctgcaataaattggaaattcacacagaaacactgattcattgtgaaattcaaccgaaacattcagcagttctcatgactttttttgcacttataatagattttttcatatttatgttaatttgtaacgatctcatggacatgtaaagcttttagctctctacctgtgtgacattcagaaaataacctattttccatttaaagaggttagttgaaatattcagataggattatcctatctaatcctatctgaatatttcaactaacatattaatatttcaattaaaacatgaggtcttttcaagttttccaattatgcatatagaactggcaattgatatgtggtcttgtcaaaatagtgaaagaacaatcatgcagctgggccctgtgagggctgggataagccagcgtccagacaagttagacacaactattttcctctctcttctcccttgccctctaaccatgaggaattatagtgccttttgctataagtcaaaatgtcagttctcacaaaaggatttgaataactggtctcaggaatggtttgaggtactctagggttgataccagagtaagacttttaaaagtctctggaaagggtagcagcataacttaaatatatcaatttttattagagatgaccatttcttcttttaataatcacattgtcactatgcagatctgcatttttcatgaaaaacttcatttctgattctgaaggcgtttccccttcatttgcaagcatttcataaatgctgatgttcttaaactttgctttttgttcaaaactgttcatcgttaagtgactctttaatagctagttaataaaatactttcacccaacaaagaccagattgtgtagctggtaatttcagatttacacggaacaagcttcactaacagcgaatttttaatttgcaagtataaaactcccttgtgcatatttagaggaagagattcttagaataaaattggaatgcttccaattctctttattcttaggcacttcttcaaaattgtctcgcagagtaagagtatgatttttaaaattaactgtattcagggggctttttttttccagaacaagctagaacttctggggtataggcagaacaatagggccctaggtggtctcccagatcgggttccctggaaacactcagatggagatggatgtaggtggtctactgggaacaccacccagaaggaagagagggagggaagcagccctgggcagagggagaagctaagttatgatgcaattgcaagagagctatcagctaatcccaaagggagcaacagaagctgggagaacccttggagttgtccaggcaaggtgagggggctgggctttggtactatcacgtgactgtccttggatgcagctgccccagaagtggtgtaacctcgcctgtagtggctcccttagactggagcaattcctggggtgggatttagctgtgagtgtcagcactgtcatgtggggagccaggtgcttgagtgccttggtcctgaaaggggtatccaaggggcccaactcagcatctactgccagtgaattgggttgtgccccaaatgagcagtaaggggtctcttcttttgttcattcagtgaacatcagtggaacgtggttaaagaaagggatgaagacaaatggaggcagacggaagaaccactgcgggtcacagtgcaggagccgagcatgtgaaaggaaccactgccttcagtcggccagccgcagtcatgcccggagctttgaacacaatgttggcttttatttatttatttacatatatatatatttatatatatatatatatatatatatatatatatatatatatatatataaataattttgcgacagagtcttactctgtcactcaggctggagtgcagtggcacattattggctcactgcaacctccgcctcctgggttcaagcaattctcctgcctcagcctcctgagttgctgggattacaggcacccaaaacaatgcctggctcatttttgtatttttgtagagatggggtttcaccatattggtcaagctggtcttgaactcctgacctcaggtgatctgcctgccttggcctcccaaagtgctgggattgcaggtatgtatttttagtagagatggggtttcaccatgttggccaggctggtctcgaactcctgacctcaggtgatctgcctgcctcggcctcccaaagtgctgggattacaggcgtgagccaccatgcccagccaaaatgttggcttttgttaccattgcctacatcgtgccagatttgggtgctgtgattttatgtttaccattaccctctctcccttgctcgtaacttctaactcaagtagctcgtcttgcttgactgcacaggctatcccttttctctctcactgtgacctggcaccagggttcccagacacagtctgccagaccctcggagctgctcctcccacacagaagtttgcgagtctgtgtgctggtcagaacatccttgtaacatgaggagcacgactgtggctgtctgagctggagctgggtcactgcctctcaacagtcactgtggatcataacctctatcaatccactctgaagagctgatgcagactggagtcacagcaggatcatgatcttttttttttttttatattactttaagttctgggatacatgtgcagaacgtacaggtttgttacataggtatacatgtgccatggtggtttactgcacctatcaacccgtcatctaggttttaagccccgaatgcattaggtatttgtcctaatgctctctctccccttgccccccatcccctaacaggcccctgtgtgtgatgttcccctccctgtgcccatgtgttctcattgttcaactcccacttatgagtgagaacatgtggtgtttggttttctgttcctgtgttagtttgctgaggatgatagttttcagcttcattcatgtatctgcaaaagacatgaactcattctttcttatggctgcatagtattccatggtgtatatgtgccacattttctttatccagtctatcattgatgggcatttgggttggttccaagtctttgctattgtaaatagtgctgcagtaaacacacgtgtgcatgtgtctttacagaatgatttataatcctttgggtatataccagtaatgggattgctgggtcaaatggtatttctggttctaggtccttgaggaatcgccacactgtcttccacaatggttgaactaatttacactctcaccaacagtgtaaaagtgttcctatttctccacagccttgccagcttctgttgtttccacactttttaataatcaccattctaattggcgtgagatagtatctcattgtggttttgatttgcatttctctaatgaccagtgataatgagcttcttttcatatgtttgttggctgctgcataaatgtctttaagaatccactcttcagagctgattccgactggattttggtcagccatgaagtggtatctgactgcaacacactctacttcaaacatagtcatgttttaggatgaggccatcttcaagcctgagatccgtttctcatagaaagtgtttatgctgaaagcatatgggccctaagagttcacttctcctgcaggcttcaccatgaagacccccccagttattggcaagttcattccacctccgcttccaacccccctacacgacggaaggacgggcccaatgtgacactgtgtgaactctgatttcctttggtaacaaatacttctgttaaaatatatccagatgtcagcgctagatgataaatttgaacaaacacattttggttaaattagtatgattattttgactttccagtgtttacttggtttgttaagcatttttacttctctctaccattgaggaaagacaagtgggataatttattttgaggaaggaaaactcaaagctatcacgtatgtgaaaaaacatgtgaggtatctgagttgttgaaatcacgattgatcctaattgatacttacaagttatagaaaatgtggcaatggattgccaatcaatatttaaaaactgaaaacctgttggtagataacatggtttctctaggaaacaaacggctgcactcccaacagatttgtaaatatctcattgactcaaagcaaagaagtcaataaaaagaaaatgaaatcaaatttctaaaatttcatacaaatattttaccttatttttctcctttgttcctttcttttgttttttggctttcttgggttgtttttcctttttcttcttcttctttttgtttttttcttcttcctcttggtttgctatgatatcctcaataacctagtgaaaaccaaaataatcataccattttcatagatccctatcaagagaaggactgttttccctgtctgaaaggaagtttttgtgctggtcagtgtcatctctctgcctggccctggaccctgcaggccgaccccttctggggcatggtggggctcctgcctaccatctacccttagctggattcatgaacagggggcagcagcctcagtgtagatggagagagagtctcgacgtttctgagcccagttccttccctaattccacccactccagctcctggaggttccacaaactctaggggaggtcatagcttcctcaacgtctcagcaacagctggatgtgccagccctgcccacagctcgtcaaaatccagggggaggatgccactgcttcctgctaggctccaatggcaacagccactcttgcaataactttcattttcatgagttggtttctttcaccagtgatttaatttatatcccctacagtgacaaaagaccttttatcctcctaaattataaaatatttgttaaaaagtatccagttcacataggattagcactactggagaattattatagatttgttaaaaaaacatataattcagttcaatacaacagtgttcactgagcactcactcactgccatagagagctgtgaattccaggagatataaaggtgacaatgacaggacacgcttcctgtttggcccccagggctctgctcatgacttgtcatgtggccaagacaagctgcataagctctctgagactcagtttcctcagctctaaaagggagccagcatctccgtacatagcacttaggatccgccaggcatgcttctgagagcctcacagagacagactcctttgctgctacaccagacgcatgggggttgctgttgttgccctgttttatggatgagggaactgggacacatacagtgcagtatcccagccagggacacacagctagtgagtagctgagctgggattcagcacgtgcttaaccaggatgaatttcataatgtagggagaaaagaggcataatgtataagaacacatgtcaacttactccatcgtacaaaatgcacagagtgaaaccaacaatccatactccagtctcaggtacatacacatgtagtccaagtacaaaggaatgtaagggaatgacaaactccaaattaagtacagcagttgcctttgaagatggagcaattaaaaaattgggggtggggagacaagggctaatatcgttttatcctagtgtggagaaaggcgagaggtgaagcatgtgttgtgaacatatttggccatgcaaaaatgatcttttcccagcctaggcaacatgatgaaaccccatgtctacaaaaaaaaacacaaaacattagccaggcatggtggtgcacacctgtattcccagctatctgggaggctgaggtgggaggattacctgagcctggaaggtagaggctgctgtgagctatgatccagccactgccctccagcctgggtgacagagtgagatcctgcctcaaaaaaacaaaacaaaacagacaaaggctcaccttgactcacagaatcaaggtgtggctgcccaggtcttcattgtactggagcacttgtaacacagacattgtttggaccttagaaactgtaaaacttttctgctttctcttgtgggcatttagtgctataaatttccctctacacattgctttgaatgtgtcccagagattctggtatgttgtgtctttgttcttgttggttgcaaagaacatctttatttctgccttcattttgttatgtacccagtagtaattcaggagcaggttgttcagttaaaattgacaccctaacatcacaattaaaagaactagagaagcaagagcaaacacattcaaaagctagcagcaggcaaaaaataactgagatcagagcagaactgaaggaaatagagacacaaaaaacccttcaaaaaatcaatgaatccacgagctggttttttgaaaagatcaactaaattgatagactgctagcaagactaataaagaagaaaagagagaagaatcaaatagatgcaataaaaaatgttaaaggggatatcaccaccgaccccacagaaatacaaactaccatcagagaatactataaacacctttatgcaaataaactagaaaatctagaagaaatggataaattcctcgatacatacaccctcccaagaccaaaccagggagaagttgaatctctgaatagaccaataacaggctctgaaattgaggcaataattaatagcttaccaaccaaaaaaagtccaggcccagatggattcacagctgaattctaccagaggtacaaggaggagctggtaccattccttctgaaactattctaatcaatagaaaaagagggaatcctccctaactcattttatgaggccagcgttatcttgataccaaagcctggcagagacacaacaaaaaaagagaattttagaccaatatccttgaacattgatgtaaaaatcctcaataaaatactggcaaaacaaatccagcagcacatcaaaaagcttatccaccatgatcaagtgggcttcatccctgggatgcaaggctggttcaacatatgtaaatcaataaacataatccagcatataaacagaaccaatgacaaaaaccatatgattatctcaatagatgcagaaaaggcctttgacaaaattcaataacactcatgctaaaaactctcaataaattaggtatcgatgggacgtatttcaaaataataagagctatctatgacaaacccacagccaatatcatactgaatgagcaaaaactggaagcattccctttgaaaacgggcacaagacagggatgccctctctcaccactcatattcaacatagtattggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctgataggcaacttcagcagtctcaggatacaaaatcaatgtgcaaaaatcacaagcattcttatacaccaataacaaacagagagccaaatcatgagtgaactcccattcacaattgcttcaaagagaataaaatatctaggaatccaacttacaagggacgtgaaggacctcttcaaggagaactacaaaccactgctcaatgaaataaaagagaatacaaacaaatggaagaacattccatgctcatgggtaggaagaatcaatatcgtgaaaatggccatactgcccaaggtaatttatagattcaatgtcatccccatcaagctaccaatgactttcttgacagaattagaaaaaactactttaaagttcatatggaaccaaaaaggagcccgcattgccaagtcaatcctaagccaaaagaacaaagctggaggcaccacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgaaaaaacaagaaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaaaaacaacgccatcaacaagtgggcaaaggatatgaacagacacttctcaaaagaagacatttatgcagccaaacgacacatgaaaacatgctcatcatcactggccatctgagaaatgcaaatcaaaaccacaatgagataccatctcacaccagttagaatggcgatcactaaaaagtcaggcaacaacaggtgctggagaggatgtggagaaataggaacacttttacactgttggtgggactgtaaactagttcaaccattgtggaagtcagtgtggcgatgcctcagggatctagaactagaaatactatttgacccagccatcccattactgggtatatacccaaagggttataaatcatgctgctataaagacacatgcacatgtatgtttattgtggcactattcactatagcaaagacttggaaccaacccaaatgtccaacaacgatagactgtattaagaaaatgtggcacatatacaccatggaatactatgcagccataaaaaacgatgagttcatgtcctttgaagggacatggatgaagctggaaaccatcattctgcgcaaactatcgcaaggagaaaaaaccaaacaccgcatgttctcactcataggtgggaattgaacaatgagaacacatggacacaggaaggggaacatcacactctggggcctgttgtggggtggggggaggggggagggatagcattgggagatatacctaatgctagatgacgagttagtgggtgcagcacaccagcacggcacatgtatacatatgtaactaacctgcacgttgtgcacatgtaccctaaaacttaaagtgtaaaaaaaaactttcagaaatgtaaagacttaaaaaaaatagtcggatatataattatgagcagctgaaaagatgaaatccttatttgtggagtataaatttcactgtggccttatcagttaagccttttaaagtcttaccaattatatggtttatttcatctctctccttttatagtttattagtttaaatttttgagtattacattttcatggttcacaattcaaaagttatgaaagagtaattatacataaatacagtgaaaggtttcctccccatactgttaactagccaagaagatccactttctctttttattttttattagggcataattgacaaaaatttaatatatatacagtatacaacatgatgttttgatacatgtacacattgtggaatgattaagtcaagctaactaacatgtccatcaccttacatgcttagcattttttgtgtgtgatgagaacatttacaatctattctcttagcaattaaaaatatacaatataatattgttaattatggtcatcatgctggacaatacatctccagaactttttcctcctgtctaatggaaactctgtaccctttgaccaacatctctccattccctgatcttcccctcccacccttggtaatcactattctactctctgcttctgtaagttaaattgtttttttagattttatttataagtgagatcatgcagtatttgtctttctgtgcctggcttatttcacttagcataacgtcctctgggttcatgcatgttgtcacaaatgacagaaatttccttcttttttaaagctgaatagtgttccactgggtatatacaatacattatgtttatccgttcatctactgaagaacactgaggttgcttccacatcttggcttttgtgagcaatgctgcaatgaacatggtagtgcagacatctctttgacacactgatttcatttcctttggatacatactcagtagtgggattgctggatcatatagttctatttttcattttttgaggaacttccacactgttttccataatggctgtgttaatttacattcccaccaacagtgtacaagggtccccttctctcacatccttgccaacatttgttgtcttttgtctttttgataacagccatcctaagtgtgaagtaatatctcattgtttaatttgcgtatgtctgttgcgttcagcatttttccatatacatgttgaccatttgtatgtcttcttttgagaaatgtctattcatgtcctttgcccaattttaaattaggttgttttcttgctatagcagtctttaaattctttatatattttggaaattaacgccttatcagatgtatggtttgcaaatattttctcccaattcataggttgactcttctcttttgtttccttgctgtgcagaagttttttagtttggtgcaatcccatttacctgtttttacttttgttgcctgtgcttttggggtcatatccagaaaatcactgcccagatcaatgtcatggagatttcccctatgttttcttacagtagttttatagcttctggtcttttgttcatggctttcactcattttgagttgatttgtgtatatggtgtgagataagggttcaatttccttgttctgcatgtggatatatagttttctcaaaccatttatcaaagagacttatccttcttccattgtgtgttcttgacacctttgttgaaaatcaatttgctgtagtgtgtggatttatttctgggctctctcttctgttccactgatctttatgtctgtttttatgccagtatcacgctgttttgctttctgtagctttgtaatatatttggaaatcaggaagtgtgatgtctttagctttgttcttttagctcaagatttcattggatatttgaggtgttttgtggttccatataaattttagaattgctttttctatttctgtgaaaaagtgtcactgaaattttgatagtcattacactgaatctatagatcactttgggtaatatgttcatttttacaacattaattcttccaattcatgagtacaggatatctttctatttatttgtgtcctcttaaaattctttcaccaatgttttgcatgttttgtaggtttcaatacacagatccttcacctccttggttaaatttatacctaaattaaaagaatgttactataaatgggattgttttcttgatttctttttcagagagttcactgttagtgtatagaaatgctactgatcttttgtatgctgattttgtatcttgcaactttactaaatttgttcgtcagttctaatagtatttttagtggagtctctggggttttcctttttctttttcaaaatttttaaaaattcaatacagacagggtcttgctatgttgcccaggctcttctcgaaaacctgtgctaaagtgatcctcccacttcagcctcccaaagtgctgggattacaggcgtgagccaccgtgcccggcctctggatttttctatatgcaagatcaaagacaggaaatttcacttcttcccttcctatttggatgccttctatttcttattcttgcctaattgctctggctaggacttctgtactaggttgaataaaactggcaagagtgggcatccttatcttgtgcagatcttagaggaaaaactcagattttcactattgagtatgattttagctgtgggcttttcgtatatagtctttatcgtgttaagttccttctctgcataatttgttgagtttttattatgaaagagttttgaattttgccaaatactttttctgcatctattaaaatgatcatatgatttttatccctcattctgttaatgtggtatattatactgattgatttggataggctgaaccactcttgcgtcccaaggataaatcctgtttggtcatggtgaatgattcttttaatgtgctcttgaatttggtttgctagtattttgttgagggtttctgcatctatgttcatcatgaacattggcttataattttcttttctctcagtatcttgcctggttttggtattaggtttatgctggcctcataaatgaatttggaagtatttatttctcttcaatttttgggaagaatttaagaagcattggtattagttctttacatgtttggtagaattcacacaagaagccattttatcctgggcctttctttattggaagggttttgattactgattcaatttctctactcactatgattttctattttttcatgattagtcctgttgttgtataataatttatccatttcttctaggctaatgaatttgctggtatataattattcataatagtctcacgatcttttgtatttctatggtatcagttgtaatgtatcctctttcatttttaattttatttgtgtgactcttttctctcctagtctagttaacagcctgtcaattttatctttcacaaaaccaactcttagtttactttttctgttgtttttttgaggctccatttcatttatttttgttcttatctttatttctttcctctgctaattttgtacttaataatagtttgtttttctttttctagttccttgaggcataatgttaggttgtttgagatctttcttcttttatggtgtaggcatttattgctagaaatttccctcttagtactgcttttgttgtatctcataggttttagtatgttgtgtttccatttttattggtttcaagacattttaaaatttgcctttaaatttcttctttgatccattggttgtttaggagcatgttgttaatttctatctatttgtgaaatttcaaagatttttccttttattgttcctggtttcacaccattgcagtctgaaaagatatacttcatatgattttgatcttcctaaatttgttaaggcttgttttgtggctgaatatatgatttgtcctggggaatgttctatgtgcatttgaaaggaatgtatattctgctgctgttggatcaaatgttctgtatatgtctattaggtccatttggtctaaagtgtagttcaagttcattgtttccttattgattttatgtttgaatgatctgttcattgttgaaagtaaggtactgaaattccctactattattgtattataatctgtctctcccttcagatctattaatatttgcttttcatatttatatgctctgatgtttggtacatatatatttgcaattgttatatcctattgatgaactgatctctttataattatataatgatcttatttgccctttttacagtttttgacttaaagtatattttgtctgacatgattatagttacccctgctttcttttggattcaatttacatggaatatctttttctatcccttcaccttcattctatatgtgtccttaaaggtaaagttaatctcttgtatgcagcatatagttgggtaatttaaaaaaaatccattcagccatgctatgtcttttgattggagaatttaattcatttacatttgagataattattgataggaagaacttattgctgccactttattactttctgattgtcttgtaaatccttctttcattttgttctgctattattttcctgatttcattaactagtttatttgtattgtcttgtaatttgctgagcttctttagaatacttattttgaattctctgtcatgtaattcatggatctccaattctttagggtcagttactgaaagtttattgtgttccgttggtggtatcatgtttccctgattcttcatatagtcttataaatgagtctgcaaatttcaagaagtagtcacctcttccagactttatggactggctttggtaaggaaagaccttcacctgtgggcagcagggtggggggacagaggcatgctgggggcactgtagcatcaggtctggtgttgtgaggtaccaagtgttggggtatgtggtggctccgaatctgggggagcgttcagtcttgccatttcaggcagctggagtctgtgatgttggcacctgcttagtcctttgtggctggggtcagctgcaggtgcacatgtggcactgggggccagcagcttgcatatgcataattgcagaggccagctgcaggtcatcaacaccatctgcatgcatgggcatctttaggctgagctggaggggtgcatgcacatgtagctacagggaccagctctgggaacaagcacagtgtggggatagttgctggagggcatggccaactggttatgctcatctagttgtgggggccaggctagcagctactgcaatagcctggctacaggagtcagccttgggtgcatgcagtggtggggttggagtctgtggtagggggctccaaggctgttttctggcatgcatgcagtaggtgctctgggtccctggcccagagaacctgtggaggcagtagctggggtggtttcaaggagatgtggtgatttaggcacctagggaacacgagggccacttgggtgggtcggtgggctgtgctcactgtggcaggagcagtcatgtggctctgggtggctccagtgggggacaggtaggagactcaggcacctggagactgtgaaggtgaaaagaaatgcagtgtcctcagtggtgaaagctgaagggggtcccctgcttctgtgcaggcagttggtttcctcagctatgaaaactgtaggatcctctgcagaatatgctgttggggttcatgataacaaaccctgaggggtcctctgtggtgaaagctgcaggtggttgtgtggtggtcttgagttcctcagcagggctgttgagttcctcagcaggggtctgctggagtcctgggctaagcaggccactggggtttgtggtgacttccagtgtgtggctgatcataatacacttgctaaaaagtcaacccaaatactttggatatgcttctaaagacattttatatacatatatgcgaatatacatataacacacacacacacacacacacacacagagcacactggcattgttgtgttatgtttgccaattgtataggtgaaaagtaatatgtcattgaagttgtctcttttttaaaccaatacaaaatttattttacctgcactcttcagttatagcaaaatcttccaagtgcacagagatgtacacaggtatacacacaaatgcacattataaacatcaacttgtcattttatacaaatgttagcgtattatacatactgttcttgttctgcgtttttcacctaataatatatcttggccatctttccttagtggtacatacagaacttcacggttcatttttcacaggtgtattgtaacaatttatttggccattcccctaccaaataagattgaggttatttctaatagtaatctgctactactaacattgttgccatgaataaatgcatgcaaatatcattttgcaggtggtgaacatatctgcaggataaattccttaaagtggaaatgctggatcaagtgtatgcacatttgtaatactgttaaacttcccaccatgggttgtgtcaatttacccttctgccagcagtgtaggagtggcctgtttccccatatgcttgttgtcacagtgcatcttgtttgccagttgcatgggtggaaaatgtagtcgcttttgttttttcaagaagccaatattgaatttattttgctcctgctcatcaacttgagcaaaatcttccgaagttaaaagtgcactttactggctattaagtcagccatcatttttttgggctcagggccaaatctggcctggtgcctgttttctcttttcaaaatataattttattgaagcatatcatatactcacccatttcaagtgtgcaattcaataatttttcagcaagtatatcaagttgtgttccactaccacaaatcagttttagaacatttctatcaccccaataagattctctcatttccattaactgctaatcccttttctctctccttcccaggtgtattagtccattctcatgctggtatgaagaaatatccaacactgagtaatttataaagtaaagaggtttacttgactcacagttccacatggctgggaaggcctcaggaaacttacaatcatggtggaaggggaagcaaacacgtccttcttcacatggcaacaggagagagaagtgccgagcaaaggaggaaaagccccttataaagtcatcaaatcttgtgagaactcactcactgtcatgagaacagcctgagggtcactgcctgcatggttcaattacctcctaacaggtccatcccacaacaaatgggcaacatgggaactggtattcaagttgagatttgggtgggaacacaaccaaagcacatcaccaagcaagcactaatctactttctgtgtctacaggtttactttttctagacatttcatataaatggaataacaaaatacattgtccatagtgtctggcttctttcatgttgcataatgtttcagtatggcataacactttaagttcatccatgttgtagcatgtatcagttgtgtgttcctttttaattgccaaataatataaagttgcatggatataccatattttacctatctattccccagttgatatgtatttaagctgtttcaaatttttggcaattatgagtaatgctgctatgaacattcatgtacaaatgtttttgtgtggatatatgttttcatttctgttggatagagtcctaagagaagaattgctaggtcctttggtaaatttatgtttaactttttaagaaattggcatgatgttttccaaagtggcaacattttacattcccactagcaatgtatgtgggttcccttttctccacatcttcagcatttgtaattgtctttttttttgtatccatcctcatgggtgtgaaatagcattacatttccattttaattttcattaccctaatgatgaataatgttgaacatcttttcatgttcttactagccatccatacatcttcctttgtgaattgtctgttcaaatcttttgcctgttttttgactgaattgtttgtcttcttattgaggtgtaagagtactctgtattttctggctgtaagtcctttaacaggtaggtattctgtaaatattttctcccagtctgttacttgtatcttcattttcttaatggtatcttttgaagtgcaaaagttttgcattttgttgaggttcagttgatcaattttgtttgtcagtgtagttttaatttgcatttctcttatatgtgtgaggttgatcatcttttcatatgttgaacatcttttattatgtttcgaattcatttgagttttcttttctgagcactgtctattcatatccttttgctgttttttgtattgggttattattctttttcttgtagagctgtaggagttccttacatattagaagaaaggactcttgtctgtgatacccatcacaaataattctctcagggtgtcatctgtcatttcccttactcaggggtcattgtttccatgtaggattaaaacaattttgtgtgtgtggttgaatttatcaatttttttttctgctatgatttctgggtttgtatcataattagaaagatctttcccattctgaggttatgacatatttctttcttagcttcttctagtccttttgtgttttgttttgttttatacgtaagtgtttgatccttttggaatcattccaaagtaaagtataaagacttgggaatttaattttcttttttcttagatgacaacctggctcttcttataccatttatttccttttttcctttcacatttgagatgctgtctttattataaatttccgtatgtatttgggtctatttcttgattttctgttcttttccattgatgtgcctttttagtcttttgtctgtgccagtgggctcctaagaatatgttttcatacctggcaaagctagttcctcctcactatgcttcattttcagaattccactggttattcttggttatttgctttctacttaaagtttagtttggtcatcctccctgcctcctccccgccaatgccccaatataatgctattggtattttcatttggatcatattatgtctatagatgatgtttaggagtcaaggtatgtatggtgtgagcattcctacctacgagcatgatatgcttttccatttcttcgcatccctcaggagtgttgtaagcttttcttcacgtagaatgtacatttatcattaagcttattcctgggcatttgacctttgcattgttgctgttgtaaatggtctcttacattacattttctagctagctactgtttgcatgcacaacagcgattgctttctgcatgttaattttgtaatccccccatcttgcttctcatattatttaaagtagttttttagtttattctctttgcttttttgctctttagtttattctctttgcttttctaagtattgaacatatgtgcaaaaggtgatcatttgcctcttctgttcccctttagaacactagaaaggggatatattatttagtagttcctacaggacaatggtaaataatagtggtgatgatggccattcttgaatttttcctgacactcactagtggaaatgtttctagtgaatttctttaagcatgacactgggttttgaattaagaaatattttataatgttcaacaagtatccatctattccaattttgtagagttctatttttaaatatcaaaaatggatgttaaatttgtaaaatgcctttgcagcctccatagtgaggagcttatggttttcccttttggattttttaatacgatgcggtgcattcatagacatccttaacccaaaccattcttgcatcctggaataatcaccacttgtggtgttttactaatttaatgtggtgctggttttagtgtgctaacacgttagttaaaatgtttgtgttaatactcataagggagactgatctgtgtctttttttgtgttcaatcttttttgggggttttgattcaatgttatgctcgtttcataaaaagtatttgtattatttttgttttattaatatatatttcaccttgtatgtatattgttataatgacaatgcttggcctattctctattcatactatgactacaatgactactattactgctactgtcaacgttagtaacaactgctacgattttctgaagggtttcaatatgccaagctctgttctaagtacctcacgtgtattgtctcatctaattattacctcagtgcagggaggtagacgttgctagtaatctccatttatagatgagaaaactgaatcggagtgtggggggatgaagcttgtctaaggttgcaggtctagtgtgtgggggaactgtgatttgtaatcaccatgccgttctgactcttcaatcatctgtctttcaaggctaagctgctttgtggtctcctctgttctctttcaatgtgttaaccagacattctcaattttcttttgactagtattttttaatgtttctcatggcaatttagatgttctaccaacattcttaatcctataatcgctacctttctaactgaacataaaatgtgtctggatgcttgccatggactttcaagacacaacttgtgcctggcaatttagctggcgggacaacacctaaacacataaaaaaagtgaaacaaccccaaatcaaaatgacaatcactcaaggcagggcttgacaaactgccaaataatagggtcaatatttggtgctcatggaattcagtgaaggagggaggagtcctctagagggctgaggcagcctttgggagcagaggctggtttctgatggagaagtgaagaaagagcaattcctgtgtgcttaactctgagggctcttggaggggagcacagggacacagggaggctgacagcagggtcagtcatgctgaagtcctgaaaccccgagctaaagcctgtattttactgctgcagagaacttcatgttacttaacgaatttcctgttaaagaacatcaggctgttttcttctttgtcaatgcaataaacaaggcagacgtgaacagcatccatggcaggggtcagcaaattatggcacatgggccggctctggccggccgcctgcccatttttgaaatgaagtgtgattggaacacagccatgcccatcatttacatgttgtctatggcttctctgatgccggtattagtccattctcacattgctataaagaactgcctgagactgggtaatttataaagaaaaagggtttaattgactcacagttccacatggctggggaggcatcgggaaacttacaatcatggtggaagggaaagcaagcatgtcttacatggtggtaggagagagaaaaagagagagcacaaaggggaaaatgcccccttacaaaaccatcagatcttgtgagaactcaggatcacaagaacagtctgggggaaaccaccccaatcaggtctctcccttgacatgtggggatttgagatgagatttgggtggggatacagacaaagcatattaatgccatattggtagagttgagtagtgccagcagagaatgtatgtgccacagcctaaaatatttactgtttgtccttttacaaaaaaaggatgttgacctctggcctatgacaacttctgttattattatttatttagtataaattcctcaaagagcatttatgagccaaagcacatacacatgaaaagttttgatatttgtttgatccacgtcacttaaaaatgtcatgctaatttacatatccagtagcaatgtatgagagtgactttttcccacatgcacaccaactccagtcattacaatgacttaaaatttttaccagtcctataggtgaaaacagatatggcaacattactttatacatgtaattgccagtgagttttaaaaatttttcttgtgttaaattcctgtttatattctttgcttttttatcagggtgttccaatttttgttattattttccgagaaatatttatatatgaaaaatacccattgtcatacatgttgcaaatgtttttcctcagttatcatataccttgaacttcatttgtgattttttttggccattttgctatttgagttttgtgtagttaagtatatgagcagattctcttcatgttatttgcctatggtgacatgtttatgaaatttttctccaattcaaacaatttctttagtaatttgtggtttaacatttttacatgtaaatatttaattcatctgaaatttgttttgtataataaggaaggctctacttgattttgccaaatggtgagccagttattatttattaaataatattatttattagtctgtccttccccatttatttggaatgtcatcagtatactactgaattctgatatatgtacctgactaagtttctgagcacactattttaaagtcagactccttgagtatgaacctcagctccacaactaatttggccaaatttttgatcttcatagtttggaagaattaaatgagttgacttatataaagtgcttgcatggtacctggcacagaatatttgtccaacaaatgttatctgttatttttgttgttatctgtctattcattttccaacattgtggtattttggctactttatatctttataatttgttttatatcaatatggaaagttccctattatagcttttttaaaaatttattattattatactttaaattttaggggacatgtgcacaatgtgcaggttagttacatatgtatacatgtgccatgctggtgtgctgcacccactaactcatcatctagcattaggtatatctcccaatgctatccctcccccctccccccaccccacaacagtccccagagtgtgatgttccccttcctctgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtatctttatagcagcatgatttatagtcctttgggtatatacccagtaatgggatggctgggtcaaatggtatttctagttctagatccctgaggcatcgccacactgacttccacaatggttgaactagtttacagtcccaccaacagtgtaaaagtgttcctatttctccacatcctctccagcacctgttgttgcctgactttttaatgattgccattctaactggtgtgagatggtatctcattgtggttttgatttgcatttctctgatggccagtgatgctgagcattttttcatgtgttttttggctgcataaatgtcttcttttgagaagtgtctgttcatatcctttgcccactttttgatggggtcgtttgtttttttcttgtaaatttgtttgagttcattgtagattctggatattagccctttgtcagatgagtaggttgcgaaaattttctcccattttgtaggttgcctgttcactctggtggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctagggtttttatggttttagatctaacgtttaagtctttaatccatcttgaattgatttttgtataaggtgtaaggaagggatccagtttcagctttctacatatggctagccagttttcccagcaccatttattaaaaagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattactttgggcagtatggccattttcacgatattgattcttcctacccatgagcatggaatgttcttccatttgtttgtatcctcttttatttccttgagcagtggtttatagttctccttgaagaggtccttcacatcccttgtaagttaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcgaacgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcagtaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaacattaatgaatccaggagctgtttttttgaaaggatcaacaaaattgatagacctctagcagactattatagttttttaaaaaaacttttgggatatttccatgcattcattcttcagatacttgaaaataattatgtcaataaaaacttgttttgattttaattggaattgcattaacttcatagaataataaaaagatagtgtgtatttgtactttattgagtctttttatccagataaataattgttcagtctatcattcaagtcttctttcattttcttcagtgagattttgtcagtgtaattctgtacaatcctgtataatttgtcaatataatttcttgttaaatgtattgggtttcctagggagataattacatcatgatcttaaaacaatgataaaattatcactttaaaatatttatcacttctttcctttttcttatttgtttggcattttttataatgtccagggaaatattcaccaatcgttctgatagcaactattctttcttgatcttgacatttttttccaacagatttaacctaacaattttatttccttaaaaaagaaaacgtttttaatttaatttaaaaaattagagactatgttctcatggctgtaaaactagtattatcattattaagaaaaactaaataaatattgagcacttactatgcactcaattctgtgattttaaagaatcgtaaaatatggttcttgccctcagaaggtttataatctcatggagaagataagccttctgttcttttgttcagcaaatatttgttgaatgtttatatatgcaaattaaaagtccttcctcttgagaagttgacaggctaaggaagagataaagcatgcacatgaatgttatgatacaagcttgtaaatggtgaaccagtttaatagaaattcaaataaaatgctgtatgtttgaaggccccctacattaaaagaaaggtgtccatgtgaagtagcgtagggtaaatgtcaaatgaatgatgttaatagcgcagggctttagaggaagggttagtcacccaggttgtgggcagttggggaaaattttactcaggagataagacaaattgcccttattgattttcattttgacaatgcctctaatgcctcatcattgagtataatgcaaatcttctcttggtttctatgctaaatactgtgaagctaagaagagttttcctattcctagtttatgaagacattaaaaaaatagttttaaatgtcaatttcatcaaatgccactgaagcatctatagagatgatcaaaggtgtttcactcgaaaaaaggcaaggagctgggtcttgacagcggagcaggagctaagcagaaaggcacccagaactcaggaagagcatggcacacccaaaggagcagtggcatgagccagaagcacaggtgagtaggctgctggagccaagggcctgctgaggaggtggggcttggagatgaggggagagggaagctgggaccagaacacaaagggctcctgcagccaagctactcagaatttactaagaaaacgaccttcacacatcatcacatctctttcaaaggtaagacgggaaaaaaaaatgaactcattttgaataaatatgaaagtgtgtacaatgatgaacacccaaaagtatttccatgtaaatatttgtaggaaaataaccaagacctaataacgctataaactcattaattttaaagtttaaagaaatgtcatttgatatatttacattttatttctcaagcatatttgtacctgttgtatggtcttgtcagaaaaaataatagctgaccctccttcttcaacgtcagggtagtcaggaaatgtcccggttaaatttctgcaggaaaaaaaatagcaaattaaaatggaaatgaagtcctctcttgttatataccccatttatttgcttatgttcatttaaatgagtgatggtcattaagggtggagggttccctgtagatcaagggctgggcatggtgtcttgaagaaactgaaggtactgattacattcagtagcaggtttccttcctctagagaattgttagtctgatgcaaacatctctctttaaaacatattgtactttttttcctcctttttttttttaatgttgagatgctctgtgtttaagaatgaagacagaagcacaaataatttcttcctgtttaaaattgaggataaacacaggatttcaaactaaacgaaggatggagttgtggaaattacacagttagtaataattgtgaaatatacacccatgctttaggttttagttaaatctgaggccctatgttttatgggttgcaaatagtattatttttccataatcacataatttctacattttaataaagcagactttgaaatttaatgttgagaatttcagaaggggtagacagatagtattcttaaaagaagttgactttgacatgaatgttatatttattgtacgtaagactatctgccaagttagttccattaattcacagaagtacagaatctgaggtttagaggtgaccaccatgtttaaaatggcccttaaaaaactggttcccaaacttttggcctcagaagccctttatattcttattaatttttgaggatcccaaagagtttttgctagatgacttacagctatcaataatttactgtgttaaatattaaatctggctgggcgcagtgtttcacgcctataatcccaacactttggaaggctgaggtgggaggatcacttgagtccaggaatttgaggctgaagtgagccatgactacaccagtgcactccagactgggtgatagaacaagatcctatctccaaaataaacaaataattaaagcttagaaatgtataaaatatatattttagttaatttaaaaataaagtaagctcattatatgttaacataaataacattttatggataataaatatattttccaaaactaaaagaaaaaactagcgagaagagtgtcacagctttgcatcttttcaagtctcttttgtgtctggctgaatggcaattaaccggatgcttatatctgtttctgcactcagtctgtggaaatcttttgttttggttgaagtataggaagaaaatctggcctcaaatggaagagtacatagaacaagaagtattttaatagcccttttagctaactgtgaatattctgctttgatactacaccacagctagacaactggtagcttcctacaggctagctgtgatgtggaatctgaacccatatcaatgaactttccccctatctgtcacatgaaaatccatggatttgtctcgtgcctggaatagaccttttatccatgcatgattttttgtcctcaggtctcggtcactggaaaacgatgctttgcagaattatgtgggtgttcccacagttgatacatttcatcatattgaaaagcacattaattaataacactacagatcttataatggaaggtctaagtcatgggaacctctccaactcataggagtgaatacaaattttccaaaatcatatttttttctggaaggttcaaattttaccattggcaacaactgttgttgacggtttgttcttcttcaggttcatctgattcacttttgaggaaaagtctccccaaaacccaaagtccagagtttgtcagttgttttctcaagggaaagatgatgttccattaagaaatggctggttcagtctgagccttaaccccctcacaggtgtttcttggagacaatcttcacgttttggtatgcagcagaagggatttataagcactgctgattttgtcacatagaacgttaaaaagctatgtgtttcaagggtcaagtctgaataatattattttttactgcatcctcaagaacattgtcaaataaaataaaagtcgaaggaaaaataataattttaagttgtggggtacatgagcaggatgtgcaggtttgttacgtaggtagatgtgtgccttggtggtttgctgcacagatccacccatcaccttagtattaagcccagagtccattagctattcttcctgatgctctccctccccgcaacacccctgccccaacaggccctccccatgtgtccacgtatgttgatcccatgtgtgttgttcccctccatgtgtctgtgggggacacagggttctcactgttctcactgttcagctcccacatataagtgagaacatgcagtgtttggttttctgttcctgcattagtttactgaggataacggcttccagctccatccatgtccctgcaaaggacatgatctcattcctttaatattccatggtgtatatgtaccacattttctttatccagtctattattgatgggcatttgagttgattccatgtctttgctattgtgaatggtgctgcaatgaacatatgcgtgcagatatctgtataatagaattatttttactcctttggctatatacccagtaatgggattgctaggtcaaatggtatttctgcctctagatctttgaggaatcgtcacagtcttccataatttccttccacattcccttttctctgcaaccttgccagcacctgttgtttccagactcttttataatcaccattctgactggcgtgagatggtatctcgtgattttgatttgcatttctccaatgatcagtgatgttgagcttgttttgacatatttgttggccacatgaatttttttttttttttgagaagtgtctgttcatgtcttttgcccactttttaatggggttgttttttttcatgtatatttgtttaagttccttgtagactctggatattagacctttgtcagatatatagattgcaaaaattttctcccattctgtaggttgtctgttcactctgatgatagtttcttctgctgtgcagaaactctttagtttaattagatcccatttgtcaatttttgcttttgttgcaatcgcctttggcgttttcatcatgaaatctttgcctatgcctatgtcttgaatggtattgcctagattaaataaaattatttttaaaggcaggtgtatggcagtgaagactacagtgtttactgctggagctgctggcttgattctctgctactattgtaccattggtgccaatgtcaacaaagcaaaaatagcacgcaatgtcttggtattcatttgaaagcagtttggcttttggattccctgaacagatcttgaaggcccccaggggtcctgggacacactttgagagccaggcaccctggggacctgggacacactttgagagccattcccttggccactgctgaaatgtttcccatgatggtgagctcactcccccaaggtagcccatccacttccggatactttctgacactgaactgtcatctcactccctggaccactgagctgccctctggggccaaacagaacctgattctctttctctacacaggagttactttggtgggatcactcacttattcactcctccatccatcaaacctttcattcatatagtcaaccaacaaatatctgtctagtcccaactggattctagatgcagtgatgggagacagagatctgacattcaaagatggcagaggttgccctcacgcagctcacattccacaatcatatggccagtgtggatattgggccccaggtggtgcctgtccacaagactcatgtctgaaaccttgttaaactgaccacgctccgccacagacccgtgcatcgcccagcctggacggggcttagagagaaaccatgaatacattaggagtcaaaatgacagcactgttttcttcagtcccactcacgttattccttcaataaccacttttacaaggaacctcattgcataattttattttcgtattgtaaagcttgagtgtttttgaggactcaaaacaaacttagtgacatatgaaaaagcaaaaagaatttacatacatcatttctaacgtggaattcttaattatggaacacatcgactgtcatactaagatttaataatattacattatcatggtgcttttggcaaagataatattaaatatattatttatttatttaattttagacagagtcttgctctgtcgcccaggctggagtgcagtggcgcaatattggctcactgcaacctctgccttctgggttcaaatgattctcatgcctcagcctcccgagtagctgggactacaggtatgcaccaccatgcttgactacttttttttttttgtattttttgtagagatagggcttcaccatgctggccaggctggtctcaaactcccgacctcaggtgatccgcctaccccagcctcccaaagtgctcggattatgggtgtgagccactccgcctgggctatttttaatagatgaacatatttagttttcctttgtcatgttagtttatataattagtcataatctgaaatttaattagtcttatccttaaagaatgaaaaaaaaactgttgtagggtacacattaaaaatataaaatttgtatctagaaagtgacaatgtgcctgatagctcttatcacacatacacagacacacccacacatgcttgtgcaaacagatgggtgtgcactatccctttcttgctcactgcactccatctgtccctcccgtgggtggctagaaggcctctgttcccacagagcttggacccctgctgtgcgatactcccagggtcccctggctttgcactgactgtctcttcttggccccttccctgtgacttggccacttagagcatgttaagagagacagttatgagttctattttatattcctgagactttaccaccttggctgttggatttctccctccctcgattttcagctgtgtcctggggcacaaacaggaactcatcctgacacatcccgactgagcctcctcagaatcaaggcacagtcggtcccgctcctgttgttaatcgtaaggaagctgcgaggtgatgagtgctttatgctttgggctcagcacgctacacgaggtgtaaaaccttcagaggggagagggcagatgatcacagaccagtgaatggaaaatatttggctcccatgatgtttctggtgcaaacagatggggtccgaggcactgactgcaggtgacagcccatctggggacttccccaggagtaactcaggaccccaaattacagggcgtcaggaagacggttctcttggttaaaagtggaaaccaaagtctctgctttttgtggaacctgattcctctgagccgccctcttgccctaatgggcacttaccctgtctttgttttctcagggtctcaggcccctggagaggcacaggctgtcctttggatgcttggacacacatgttcaccaaccgtggtgcctgggacccacaggccgaatgcctggaaaaccctcttctgtgcttagggctgccacacggtgtgggcacccacagcattcaaacaactggaatcgcaaaatgctgggctccaggccctggacaggcactgccagccacacactcctcaggcctcaggcactgtctgcccatgtgtcccagggagagggcagaggggagccaccaccttcaagagctgattcgtccacctcggacctgtcttgccacttcccctgactgcggctgctgggcgtggggtctcttgggcccttggcatctcccacctcatgctcctggggaccctctcctccttctgtgcctcatcccaatcagacactcccccgtagatctgcaggatgctcaggtctcactcatttaacaaacacgcagcttcctgagctcccagcctcctccagtgactctctcatctctgtctccttcccagcctggctcttcaagaactcttcatgggacctgtctccattaaagtagctctcacaagggatgatgggctgtgctgcatcccctgccccctcatagtcacatgcagacgtccaagctgccaatacctcaggatgcgaccaggttggaaacagaatcactgcagaaggaactggcagagacgcggtcatgctggagtaggagggccccatccagtagggctggtgtcctcgtgagaagaagaaatgaagggaagatgctgtgaagagacgctgggagctggcgaggagagagacctggacagaaaggtccctggtgccagaaaggttgggggccactgtgttacagatttccttatctcctccatgacagcatcagccacatgatgggacttacgttttaagaggatcactcctacagaggagtgtaattcctaagaaaggcaccagcattcacttgtaggtgaccaaatgttgactaatggttcggaaatacctgagaaacctacaacggtcttaccaaatcagcatccacttcccgcactttgtgttcctgggtgacctttgcctttcttgtttctcctcttctgttttgttctgtagatttgggtgaaatgagagagtcctcacacagatagtccaggttatatttttcatgtgaccacgtgatgagttccattttctgcatcgctggttccatttggtggtttggatgcccaatcgaggagtcggcttggaccttgcctgttgcggcaatctgagagcaaatgaaagctggccaggggagggtgggggagggtggattcaggaatgacattgtagcacatgctgcatgtcaactttgtaaatcagcaaaacagttcgcagataatcaagtggctttggaattaagattcgaagtataattgagggaaagctgcaatttaaataattattatgcaaaaaagcagcatatttaacacaatgattttgcagaggattttgtgttaaaattgttttaattaggaaagatctctgcatctattaaaatactttacaaactgcaaagaaaaactgagataatcatcccctcaaagcttaacatccccctttttctccaccccaaagatacacacctcagtaagaccactggctgtaagatgagagggaaattattttatttgattgaaaaacttatactatacaacataactagggaggacctctctgatatgatggcatttgagcaaaaccttaaagcaagtgaaggaatgtgccacttagtatatttttaattatttacttatttttgagacagagtctcactcactctgtcgcccgggctggagtgcagaggcgattctcctgcctcagcctcctgagtagctgggactacaggcgcacatcaccatgcctggctaatttttgtatttttagtagatacggggtctcaccatgttgcccaggctggtctcgaactcctgagctcaagtgatctgcctgccttggcctcccaaattgccgggattacaggcatgagccaccatgcctggctgtatttattattattatttttcagtcaaggacacaggctctgaggaggaggcctccggagggcccaaggtgcagccaggagagcagagcagctgtaaggcagcgggacaaggctggtggtcggggcagagactatcacgcagactgttgtaagtgggggagccatggaatttcatgtctagaccagggcacctttaagaatgacagagggcgctgttagttttttattttttatttttttctgagatggagtctcgctctgtcacccaggctggagtgcagtggtgtgatctcggctcactgcaacctccgcctcccgggttcaaacgattctcctacctcagcctcgcgagtagctgggattataggtgcgtgccaccacgcctggcaaatttttgtgtttttagtagagatggggtttcaccatgttggccaagctggtctcgaactcctgacctcagatgatccgcctgcctcggcctcccaaagtgctgagattacaggcatgagccactacacccactgggtgctgttattaatcaaacataaactgggcctgacactaggaaactgggacatagatgaacctaaccgtatgggtactggtttcattctgagcgagagaactgggaactctgagccaacacatggcatgacatgtcttctgttttaaaaggatcactctgctgtaggaggcacctgcccaaggcaccattctgtcacgaagccagggccagccagacctgcccactctctcgcctccgcctccgcaatactttattttgtccacggggtgtttgcctggcagccgagtgactcaggccgtgttgctgccatttccttatcgtacctggaaggttttccacccgagccccacagtccggaggcgggggctgggactcccctggggcagagaaacctcctttgcactgtcggaggctgtgtgcctgccttgctggcctggctagatctgtggcacactactactctattcaattcatgtcagtttagtttatggctttacaggcatctctgctagccccgcagcaatctgttctgaaaatcaggtgctctgtgcaggcaacactctcttggaggcctatttctcattattttaaatgggaaaattgagacgccttacatgtgaaccacctcccctccccagctagtgttttgccagatgatggaagcacactgggcaaagcctgctcacttcctgaaataataagaggaaaaaccaggctgtgaaaagacatgagttgccactttgcttttggttgaaagaaaaagggacaggaggagaaacccctatgtgtgtatttacagttgcaggtgctcagagacaggcgagaagctgtccacctggattagcttggaggcatgcgactggagggaggaagactgctaatttaaaaaacatatatttcagtattattgtccttgctacagcaaataggaactatgtaattaaataaaacaatagaatggtttataataaaaataaatatcatgtttggctttatgtcttagttttagagtttgattattgactttataatttttacagtggaatgggtccaattttctttgaaaatatttttgtttctagagttaggaaattgtgacctgtctttaggggagttacattctctatttggctttcttttttcttttcttttctttttttttttttttttttttttgagacggggtctcgctctgttgcccaggctggagtgcagtggcgcaatctcggctcactgcaacctccacctccggggttcaagtgattctcgtgggtcagcctcccgagtacctgggactacaggtgtgcaccaccacacccagctaatttttgtatttttagtagagacggggttttaccatgttggtcaggatggtctagatctcttgacctcgtgactcacccgcctcagcctcccaaagtgctgggattataggcgtgagccacaatgcccggcctattcagctttctactatttgttggctttaacaattaaagcaatctagttactgcacctctgttattttccattcttactacgtttttaaccttcatttatcatacattactcatttccatcgatttctgtcagctcctggctctccactttgtctgatgtatgtttatgcttttgtatcagtgtgatgcatttaccttgtttttctttataataaagttgactatccagtgccatttgtccttccttattgttctcattttattttaatcctaatgactttaacaattatgttttcaagttcaataaataatcctgttgggattttaattgaaattgcgttatctctataaattacctagagcagatttatcatctttccatttaaccagaaacatagtccatttctccatttattcaagtcttttctcatttcttccttttaacactcatagacttcaattttcataaggttcttatacttttcttccatatttagcatatccttgattgttaaaaatacattttgccactttctttaaagtattcatttttatttccttttcatgtcattgtattaccaataatttatattatggcactaattatattaggggcaaaggtcatctacattgtcctttcctttcctgggaagacctatagtatttctccattaagctgtcttgtttaaaaaatatataaaaaagtatagctgtcttgtttaaaataaaacaaaaacactttacatatatatatatatagatatatatgagtatagctgccttgtttaaaaaatacttggtttttcattcattccttcataacatccctgtagactatttttgccagatactgttctgggaaaaggcagtgaacagaagacataaaaatctctgtcttaatcgagcttacatgttattatgctgtgaattaatcttttctatttaaaaattttaaaaataagacgagtaattttatcaaatgccttttatgtatgaacttaaaatgataaggctcacaggtggggaacccagtggagcccactggccaaggacgccacgctgtgggtgtgaaggctccaatcagaaactttaaaataaagctttacacccgataaagaagcagttgggaggctagatgtataatgaaaattgtattttactggaaaggaagcagcccagggcagctgccattgattagttagctgtgcgatttgggcaaatcatcgtatcacagtgggaacttggttagttttcctctctgcagaatggtgcaattgaactagctttattcatttagttatttaaaaataagtatgtatgcctagtagacaatttccagttcctttcagctctggaaactctttgatttacatgtgtcaaatgctggggagggcaatgttaattttttacataatttattccatgattaatgttactttcttaatagaaacacattcaacatagccatctgcctttacattcttttatttgcaaaagctggataagagaaacacgtatgcctgctatctttcagttagcaaatgtgaggtatggagcatttggtcaagttaaggcctattaaaaatttatgcatattgtcaaaaattcttgcacaaatgtgaaaatgaccatctctggagtttgcagtgatttagaaagcagagctactacaatgatcaatctttcccctgaggtccaacactgagcttcaacgggcctcacatttcagactcacaggacagagatttatctgtgtttcatcaagtatgaaaaatatgtggatggaggggtttccagccggtcccccccaagtcatccagccacctccattaatgtcagcaggctcataaatttttcctgcgttctaaagaaagcagcttgtgccactgcacagaagcctccaaaggtggcagttgctgcctataaattcacttacactcaataaaggcaattgactgcacatggacttaattaccatggccctccttgggaaactgaggggctcactatttctcaaaggaggggaggaaaaagtgttatgcgaagcaaggcaacctcttagcggcaccttacaaaatctgatttattcattgatgtttctacttattactgggatagtcttagcagttatcactcaagaccgaagtgtccttcttgattggaaagtattatctcgaattctcctcaggcttgaatcctacaggaacctccccatccaacttccttttttaaaaaaattttattaaaaggaacaatatattactcagcacacaattggctatttcggttctggttactcttctactcagaaaatgggatgcatgctttattttcacctttcttcaatatttacttgtgtagaaaaatgaatacccagagaagaagagagtaccttaggaagagatagaaagattttcccattaaaggcactgtcatccctttctcttcaccgacccatcgttcaaaacctgcgccatcattcacccagcaacccctcctcattgataggagcaggtcattcccttttctaactcaggaatccagaaagcttaggaaaacagacataggagaaaggttagcaaaatgttcagtcatttacatttgaattcacttcttatgtactacttttgaaaagaagtaatcttttacaagtagcaacaagagtgagttgaagaaaaggacaagtttagggtctagaggcaaactctgaagatctcccagccttatttgatcaagtgctaaatgaatatctatcatatttatgaaacacaaaggcctgattgtttctgctcaaagcaacacatacatgttgacatacatctccaaatgacacagaaattaagagcgtgctagaacaaaccgaatggctctatatccaaagaacagctctgtcctctgccgcagatgcgttaagtactgtaaagaatatgactcccaagtcctcttacttccccagctacggtgactgcagcagagatgcagtagatttgaggtcctccactttcccaggatagcaccaattttaatttttttttttttgagatggagtctcactctgtcgcccaggctggggtgcagtggtgcaatctcagctcactgcaacctccacctcctgggttcaagtgattctcctgccaaagcctccttagtagctgggattacaggtgcctgccaccatgcctggctaattttttgtatttttagtagagacgggggtttcatcatgttggccaggctggtctcgaactcctgaccacaggtgatccacccgtcttggcctcccaaagtgctgggattacaggcatgagccaccgtgcccggcccagtgttaatatttttagtggtgtccttcccctctttagagtgattctctgccctggatggcatgcagagggcagcagtgactgcttagcccatgggttcttcaggtcatgccccatcagcagcagtggggagctcgcttatcacttgcattccagtgggatggacagaaaagcacaatagagggtatgctggacccaagggtgcaacctgggacagcctgcgggcccacaaaaagaaaatccattcagcgcatttgccaaagagccccgaatctgtctttcatcatgacttggtgcccggataaaccaagagagcctagagctgctggatgttcttaacttgatttactgtgacgaccgacatcaaaacctgtaatttcacgcgagctgtgcacctgtccctaaggcctcagtgaataatgcctggaccttaagttctcatcccacctcttcctccgttcaacctaatatcttttccaccaaagcaaacagtagaaaaagttattttccttctcatatgagtaacctacacatggttcacatctccacagatcacagctgcttctgagaatttactaaaaatataattacacaaggaattcaaaataatgagcctctaactcacctctctgcatgtgaccatcagtctccctctgtctttctaaaacctcttttttcatgctgaaagtaattcatgctccatgcagaaaacttggactataaagggaaagaatacatacagccatggtcctcagaagatatctattgtgaaccttcaggtggtttcctttgatgtccttagaagtcctcagagagaacaattctgaactttctcttgagaaacaattctagttttacacaatgctcgtgtttcaaaaagtctttactcacccagattgtagttctcaatctgccagtaactaggcaggtttttagccaagttacctgacttttctgagtctgctttgtcatccgtaaaataattggggcaagccacagccagctttctcaaatcccgcaattcttctccttctctctttctcccctcctccatctttttctcttttccttttaactacacagaaccatcactatgctctgcatgaagatgctaagaagtaggagagaggcaattaggagttaggaaagacccaggttcctaggtggcacatagtgagctgcatgactttgtgcaaccaccatctgtttccaacaaaatgacgctgaccacctaccactcctctgcaccacgtggctaaggacattcctgctggcatgttcggaaggaggagacctacttggtgttgtgggaatcagaaacctgaatatgaattccagcctcgcctattatgagccatgagccctgagaaagccactgagcatgtctaagccttgggttcccatgacagcttcctggggcagcccctggtgctgtgcccttgcctggcaggagcagtagagaaatgcaagttcatctgagagaaaggaccagcttttaaagtcgtgactagtgatgggaggtgctgcagtcctgagagctcggagatactagcagggagagtatcaggctggagtggagggaggaacgtgaagacgcgacattctgtccattgcccgaagctctctggacagcgagtatggtcgctctcgctatttgtggattagctctcaaattcaactggcatctactgggaagatgacagacaaggaatctggaggtctccccaggtcccacaagccttcgaacgacaaagctgaactcgcagaactgtacactgaaaggggagaattttactgcatttaagctgtatcttaatttttaaaatgaaaacaaaaatataacgaagcatttcaagacctcctccagaaagaatgtgcatttgctggcaatctggaggcatggtgctcacctgccctggagactcaagcacattgcgtgctgtttttttttaatttttagtttgtctgccctgttattatcccctcagctgcatgcccacccccaccactggcagcccttgctctccgcgcctccaccaccagccagcctctccttttgtaggtcggcaatgcagcattttgactgtgggagccacagaagctgtgtacagctgtgaatacaaaggccccagactccagaataaaaatatggggtactatggatatgggaaacatccaaattgcaagtcatttatctgagaatctgatggacttcctataggtttaacatgattactgagggtgtatcttgtgccacatattgttctaagggctttatacttacaaatctatattactctacctatgaggtaggtactattactacccctacctcatttttaagatgaggaaacagaggcacagagaggttaagaaactggctcaaggtcacgcagcccgcaagtgatagagccgggatttgaacccaggcagcctggctctagggcctctgcccctctgcatgtgtgtggcatttgcaatgcatttgttgattagagatgcagaagacaccatcacatcacaagactgaaagtggtggctggtctacaccctcaatcaggctcacctgctgaggaccccgataacctcaagcccccgagttttcccaggccacctcacttctgactgattatgtgttggcttaaaagatggaatgtggctacctaatttacatcactttcagattcctcaagcttacgtgagttaaaaggagtctgctaaaatcagactagcaatgcccctcggccactgccagagctggcacctgatgggagtggggtagagggtgggtgtttacctccctctgcactgaagaatgagctggatgtcaggcatattttcaacaaattaagtaacaagcgtaggtggcggagaaatggcaatgctccacgatggtgcaatttggaattttcaattggaaagatcctgaggcctagaatcagtcccagggtccagagatgacagccactcaggtggctccaaagcccgtggggagatgaggagaggctgctgcatcttcagtggcaggagcccgcagtcccaaggctggctgtgggccaggcagcccacctgggcttcaggcttctctgttatcacaccaaggggctggatgaagttacaaccaagacccctttacgatactttaacatgaagcttattgatacatcctgagacctagacggcagttcaagccatgagaaataccaatcagagcaagatgttttctgacaacaagtgtacccatgactgctttgtccaatatgggagccactagcaacaaggggccatctaagcttaaactaaaatgaaataagatgaaatgaaattaaaaattcagatcctcagtcaccccagccacctttcaagtgttcagttgccacatgtggccagaggctaccacaccagacactgaacatcaaacacgtttccaccactgcaaagtcctattgcacagccctggtctggacaaatacaaacgtctataatttcttccttcattatgaacgctattcatgaatgaaagcgattatggcgctcatctcatagagctgttgagagttgtagtagacactgaataatgatccctaaagatactgagtgctaatccccagggtctgtaaatggtatcatatatggaaaaaggggttttgtaggcgtgattaagatccatgagagggggagatgattgtggattagccaagtatgtcctaaatgcagtcctaagtgtcctataagagagaggtagaaggagattagacgcacatagaagaggacaaggtgatgtgaccacagaagcagagaacagagcgatgtggccacaagccaaggaatgctggaagcccccagaagctggcagaggcaaggaagggagcttctggagggagtacagccctgccagcaccttgatgtcagtctcctgacctgtgaactgggagaaaataaatttctattgttttaagccaccaagttggtgtcatttgttacaattcaatagcaaaccaataatagggttaaattagttaatgtataaagcacttcaaattcctggtatagaattatagaatgagtgctcagtaattgtgagtctctattattattattattgttgaatacacatctaacatgtccaaccaccaaaatggttctaattacaaaggaggccaggggcggggtacagggaaggagcccacacttgagttgtgactctgggagtaggaggtagggccgaaggtttaagtagagggcatcagtgtttgcttgatgaacaactaaagcatctccaaacccaaatcatgttccttaaattgcaatatttgacaaaaatcgctatttcaaattgttcatccagtacaaagaaaaataaacacaactatcacacaatctagaaaattctaggcctgtagagcttaagtgtgaagcaagagaaaacacaccagagtgggggcaggaagtaaaatccaagtgaattaactaaaaaactacaagaactaatgtgagaattcacttagggatgcacaaactatatacaagtatgcaaccaataataaggaaaatatttgaagaaaacctcattcaaaacagcaaatgtacatataaaatgcataaccccaataagtaatttgtggggcccaagtattttattggcatcacctcatttgaccccacagcatcagagaagtgatgcccaggtgctcccagccagcaagggggcattcgctggcagaaaatgggcaatgggctgctggggacagtatcatttttcttactgttgctttctttctctctctttctggctttcctataagtcagttagaaaaaaaaaggccaggcatggtggcttacgcctgtaatcccagcactttgggaggccgaggcagatggattacctgaggtcaggagtttgagaccagctggccaacatggtgaaaccctgtctctactaaaaatacaaaaattagctgggcatggtggcgggtgcctgtaatcctggctactcgggaggctgaagcaagagaatttcttgaacccaggagttggaggttgtagtcagccgagatcgcaccgtcgcactccagcctgggcgacagagtaagactgaggctcaaaaaacaaaaaaaggcaaatgataaactgagaagtcactattacaataattcaaaaagctttagcatctgtaatacatatataactacattttagagatcacttaaagaaaagaaaaaaacacccaaaagggaagcccataaatgactgggcattttacaatgcttgcaacgaagaaaccaaaagattatttaacctccctattaatacaacacatacaaattaaaagatgactgagaaaccatttttcttttatcaatttggtaaaatatttaaaaagatcataatcaattaattaactagtgcatccatgcaatcgaaagtgaggccatcaaaacaaagatagttctccttggatgaatattttaaggacaagcgaaatctcaatgttaaatttttacaaattggagaaagaattcctaaaactgtaattaaaaaatatgtatacgtatatatgtatacgtatacgtatacatgtatacatgtatacgtatacgtatacgtatacatgtatacgtatatatgtgtatacatacgtatatacgtatacgtatacatatatacgtatataagtatatacatacgtatatacgtatatacgtatatatgtatatacatacgtatatacgtatatatgtatatacatatatacatatatacgtatatatatgagagaaaaggactggaaggaaatttatcaaaaaatttcatggtagctatctctatatcctcacagatgattttaattttcctctttaagctctatcttgcgaatgttctacaacgaacattacttttaacattgggaaaaaaacttcatatacaataacgtaagaattgacttaaaaaacaaccccttatgacaactataagtgctgactcaatgagataagcataaggattccaaatcgtgggaatgcatattaagtgcaacttttaagaatttgttgagccatcattgtgtgtcctattggaatttatcctgaggactgaccgtgtttcatgtttcaaaaaacaatatttgctttttatttgcctttgatttaaaaaagcaaggaaacggattttatcaaagtcaatcagataagtgtaatccaattaaggaaaataaattcacccttgaccttccattacttcaaaaagaggcatttttacatctttgtgaagtctgcacagcacacccacgaggacgactctaactggactccaaactgtcaggtcaaggacaccagataaagtgttctcaagggacaggccggtgagggctggatcttcaaagggcgtccataaacgctgggacaacggagagcgtgctcccaggatgatatccagagctgctcctgtctcccatgaccctgccaggacctcaggtggggaagcaactcacatccacggccagccccgtctccttgcccttttgtcaaaagatggttgccacgggtgcccaaggtattatactcattgatgtttctaaaatcagggtgtcttaaaaatgtaaaatcaacccaaatagatggcctttctttgtcctcatattttttaatgagggtttctattataaaaataacacttattttttctactttaaacagtacagaaaaatatgaaacaaaaagtaaccccaccactctagcggctagaagtagccatgctgacagtttctagtgtatccttcctgaaatttccatccatctgcaaatacatatttattttatttatttattttttgagacagagtctcgctctgtcttccaggagggaatacagtggtgaattctcggctcactgcaacctccacctcccaggttcaagcaatcctctcacttcaacctcccgagtagctgggattacaggcgtccgccaccatgtcaagctaatttttgtatttttagtagagacggggtttcaccatgttggcccaggctggtctcgaactcctgacctcaggtgatctgcctgcctcagcctctcaaagtatagggattacaggtgtcagccaccgtgcctggactgcaaacatagatttagtaagttaaatgtgtttgtgaatatatacaatacatatattttagcatatttggggttacagttgtacatagtgctttcaacttggttttgccacttaataataaattagattttaccctggctgtatgaaactaaagaatcatttcatttacagaaaatatatttttgaatacctattctctgacacacgagaaaatggggaaagtttcggataagggaaattcatgaacattgagcacacagcatataatccttgttaattatggaaaggaaagttttaggtgtaaaccaaagtgatttaatcagaagatttaattcttttgaaacaatgcctttctacctgcatttccatgattgcaactgcacaaaatcatcccaagtatattttctccagacccaattatgtaattgaataagaatgaaaaactgtaataccattggcttgcaccattcactgcttattcatgaaatttatataccagtttcatcctagtaccaggcacagtcttaatgggacttgcagtttacatgagagagggggcatctgagtgagcagtggttacagcctggagaaatgacagtggcccacactttgaggtctcagcacccttcatctgttcacaactccatgaaacagggacaattcttgtccttatatcacagatgaggaaactgacgcacagagaagctaaatgacttgcccaagcttacacagctattttgtgggaagcaatggctccagtttgcattcctaatcattgtgccaaactgcctggaggagcaaagtggaggggctctcagagctcaaggaggagacagaaggaacctgggagggaacagtcagggggctttcataacaaagcactatcaacttgaacaacaaagtagtggggcagcacggtgagggaaggaaagagaggagtgagggtggggaccctgagcccttgggccccatcctgtaagggcctcggtcaaagagcggggtgaatgttgagaccctagcagaagccctggggtggctgagaacttcgaggcggtgctcatcttcccacctgggcagcatggtgtggggctgatggtagcaaaatggaggggacctgctggataggcccctgagacctgggcctggtaccacctatgctcatgggggagaaccagcagccagcagagccgggctcagacccaagaggcttggattgtgggtggccagtgcctggggacacgtggcagaaaccatgggctgcaaaggaagtccccaacagaccaggtgggccgtaccagtgcagccataccacatggctgtagaaacccaccaggcgccgggtgcggtggctcatgcctgtaatcccagaactttgggaggtcgaggcgggtggatcacttgaggtcaggagtttgagaccagtctggccaacatggtgaaaccctgtctctactaaaaatataaaattaggctggtatagtggtatgcacctgtaatcccagctactcgggaggctgaggcagaagaatcgcttaaacttgggcggcggaggttgcagtgagccgagatcacatcactgcactccagcctgggtgacacagcgagaccctgcctcaaaaacaaacaaacaaacaaacaaaaaaccaccagggtatgaaacggtgtgcctggcactctttgccccagccgacagctgttggtgtaatttccttttacagtcagatgcagtaaggagaagaaaaatggggcaagattcttgaaagagagacatttaaattgacttcaaatttccccatgagagacagttaacatgaaagagactactttaaatcagaagagacagagtcacctataattggcaaatgcaagtcttccctcccccactgctttttaaaattatttatttattgtcttttttactgtgagccatttttggtgaagatgcaagtcttataccacgagcaggagtgggagtctgagaacgatggtagcacgggaaaactgggttttggtattctgggtaacagaatatggtattttaaagaacgaaagcattggcatttttgctgatatactaacattactatgatatatttctaacagctttatgaaggcctgagtgatatataataaactgatcatatttcaaggatagaattttataagttttgacaaatgtatgctctcatgaaaccatccccagaaagcaaggagaaaagggatggagaaagaggggtatgtgcacatcaatactgtctgctcaattaacagcagccctctgtctccattcatcactaacagtacagaatttacacaacatcaaattcctcattttaaataccccttcattcaaaatatcccattttgctataaaatatacctgataaataagacatggaaagaaaacctcacaaatgtaatcaattctgaatttttaaaagtcatcacttttaaaattgtattgtaggaaaagatggaactctcagtcaaaaacatgtcattgaagcaaacattcgtaaagaaactttgatataaaattgaagtattattgaggagatagtgtattaggatcccacataaagttaacacaagaagtttatagtagtttaggtttttgtaaatcactgtaaaagtaattgatatgtattagatatctattgctgcataacaagtcactccgagccttagcagcttgaaacaacaaacacatattgtgtcatggtttctgggtggggaaccagatgtggctcagctgggcgcctctgcttcaaggtctctcacaaggctgccatgaaagtgctggcgaagactgtggtctcatctgatggctcacctgggtcgaggggatccacttccaagtctatgcctgtggttggtgggcagcacttagttctcaggctgctggagggggccctcagcttctcactggctgttgcctgggagcctcctccagctccctgccttgtgggcctctccactgggcagctgacacaatggtcgctgactctgagccagcaagggagaaggcaaatgagagagcaggaaaggtgagcaggatgaaagtgatatcccatcactctagccgtatccttgtctttggaagtgttactaggtatagctcacacttcaggggagggatcactggaggccagcttagaggctgcctgccacagatatcttttaatagaatctttttgagagaaagtttgatttttctattgccaacatttaaattctctggtcctaaccacagttggcgtcagagcatcttgagacctgaagtgatatgatgcaataccccatcaagaaaacagatgggcaagcttgccttctatggctcctgggactgatcataacaatctgccctcttttcttcccttcttgaaataaaattgatttaaaatctcttctaattaggttaccatcaaagtgttctgctgtgtagaaaaattctctgatgaataccttttacaaaccatcttttgtaaacaagttttaactcatttaacatttcatttaagaacattaaagaacacccttaaatatgaatacgcctggagccttgtctccaaaactacctatctacccatctgataaagtttggatgccccctccaaatctcatgttgaaatgtgatccccagtgttggaggtggagcctggtgggaggtgtctgggtcatgggggtggatccctcatggcctggtgctgtccttgctatagtgagtgagttcttgcaagatctggttgtttaaaagtatgtggcaccaccccctgccgccaaccccgcactctctctttggctcttgctcttgccatttgacgtgccttctcctgcatcaccttctgccgtgagttgagttaaagctccctgaggcaaacaggagcagataccagcatcatgcttcctgtaaagcttgtagagccttgagccaattaagtttcttttccttagaaattatccagcctcagatatttctttatagcaatgcaagaaccacctaacacaccatcattcaaggagacctggtggccaggtgtctagtcccaggaatcagcagctgcctcaaaggattatgaccgagagggaccatgattgagaatctcaagcttcttacaagtagagaggctggctagatgccagaagggaaggttatttctgggtcccctgacttttggacagacctggcctgtgaagtcctgccatccttgggctatgtcatgcacccattatattccaagccatgtggtcacataggcactatgtgggccgtttttccatatttaaaaaaattaatttctgaattcttagccttggcatttcacgtttctaaaacgaagccgagaaacctcatgactctatatcaatatgcttctgtgcttaaaaacatacaataacctcagccactaaagaacagactggatatgtcacgatgtagctcatgttcacctgcattcgatgaaccaatgccggatctggtcttgaaggttctccttgatatccacgccttctatcaactttaggtcattcttgatggtaaccagggcttccctgtagtcctcttcatgctttatctgcacctcattccgcaggcggtccaccttttcagcctggattactgtagcactgacttcattaaagagaggaggtggattctgaaaatatatacaagcaacaaggtttgaggtcataaaagttacagagttggtaaaaatatcagaaactgaacaaatgtgttaatatcttccatagtgtctagcaaaggcaaataagaaatacaagcatccagaggaagcaaagctaactgagtgcatttactcagtgtatttaatccaaagtccctgacataatgctttatgttcttttgttttgaagttttcagcttcagtatgtttgaggtttctctcctgtcaacaacatagatctggattaaaaaaactcaatctgagaattatagaaaagaaaaattttattcattgtacagaagaaacatttggagataatcttctcaagttttttatctaacacactttcttgttttttttttcttcctttcctaccttctgttggatttatgtagttttgttcattcttgtcatgcagtggtttaaaaattatacatcttattttaatcttctactggttatcttaaaattttaacatgttacttaacatctacatttctatctgtctagaatttatcataatctagagcttctttgaacaagtataggacctacgcatgtgttcacttttcttcccacaacctctcgttttataatatcatagactgcaattaattttgaaaagcaagatatgtttacatttaattatgagatgttctggtttctctgtttaccctttgcattagtccatttttgcactgccgtaaaagaatactggagggtgggtaatttataaggaaaagaagtttattttggctcacagttctgcaggctgtatgagaagcatggtgccagcatctgcttggcttctggcgaggcctcaggaagcttacaatcatgatggaaggtgacagggagccagtgtctcacgtggtgaaagggagcaagagataaagaaggggaggtcccagacttgtataaacaaccagatcttgtgtgaactgagagaattcactcatcaccaaggggatggtgctaagccattcatgagagatctgcccccaagatccatcacctcccactaggctccacctccaacactgggaatcacatttcagcatgagatttggaggggacaaacatccaaaccatataacccttttcttcttttttgtattcagttttcattttgctgaagtatgtccttgagtgtaactttcagaatgaatatgtacagccataaatattataaggactagcatttctaaagatgtcttcatttggcccctcccacttgaatggcattttggtagttcccttgaggaattctacttctaatatgtagagtttccagttccttttttgcaaatttaattgttgttcctttgcaaataagctgtttcctccctgaaagtgtttataatgctttactctcaagagttttgaaagtccatcaaaatgtatgtaggtgtaggcatttcttcattcattgtattctcctttggtaggtctatacaatataaagaattgccttcaactcttcaagttttctttctattatttctttttctccatttccttgtctgcaataaacattagataaatgccagagcaccagattgatctttcatgactctgagcttttatattttccatttgtctatttgcactaggtgatagtgcaaataggagaaaaaaaatcactatggtatggtgcaaataggagatttctttagctttatcttccagaaacaatttgactttcagttacgtgtatcatttggattatttaaattttgcagtggttattgttttaatttttggcatactcttatattcccagaatagtttcttattttatacttgtgccttccttattttttgtggtcactatggcgaacactgttgtgcttctggtcattagggcagcctgcaccaatagctaagtgggtgaaatccaggaatactagggagctctggagtaaagaaatgtccaagggtaagagaacaacattaaagtccattttgaaagctgtgaaacaagaatatggcaacattcaagaccctgtttagaaaagacattagcaaaactataaacttagatcaattacttggaaaaaaacattatcttaaagattcaattcatgtcataaactaaaataaattttaaacgaattagttaaatgtaacacaaatgtacacacacatatacacacactctctaagaaatacctatgaacctctggaggtggaagggatttcacaatgaagatgtcattaaaatacagtgtccactcaccccataaaatcagttaaaagagaaaaggaaaccacatatatcatactttgtaaatatatgcattagaaaatcctaaggaatttgagccaattttctaagtttagtaaaatgagaacatataacttttcttttttggagacaaggtctcactctgtcacccagtctggagtacaatggcacaatctcagctgaacctctgcctcccgggcccaagtggtcctcccacctcagcctcccaagtagcgggagtacaggtgcacaccaccacacctgggtaattttttgtactttttgtagagatggggtcttgccatgttgcctaggctggtcttgaactcctagactcaggcaactcgcctgtctctgcctcttaaagtgatgggatcacaggggtgaacgaccatgcccggctgagaacatacaacttttatgatgctagaaaaaaacccctaaaaattactttttaaagtaatataaaagcgaatatggaatgagaattacagaatcattttaaagaacaatgttaaaaacaaatgatcattaattgccccaataaaggtactcaaaagcatgacttttctttatattatgtattttgtgtcaaaactgaacagtaggaatttcctttatataatcattaaaaatatccaattcttatgtcgtccaggtaatgtttttcattcctcgtgcttacatcttaagtgtgtaagacagaagcataaattcatatagagactttaatctctccaatggctaatttagttttcacggagatgttaaaatggatatctgcaataaatgactcaaatttctttttgcctctgatgaaagtgtaaaattgttttgaagtcttgtattaataatgtcacaattatctactgtataatgtatcatctgatgttgcttttctccaaattacgttgttcctgttgctatttgaagatttccttcatagatgtttacagacaaactatattttacctgagtcttttctcctttcatccctaaaaatgaatgaatgagcaggtgactttgatttgtgtcttgtcaacagccctatacgaagtgtccaagaaacttcctaacacttccacaatccatgagtgcaacaaaacactcagctgtcattggattttcctgatagccccttggcatggttcccatcttacatattcctgtaccgcgtttctttattcatgtccacatctatttttattttacttttatttatttatttagtttttgagacggagtctcactctgttgcccaggctggagtgcagtggcgcgatctcagctcactgcaacctccatctcccgagttcaagtgattctcctgcctcagcctcctgagtagctgggactataggagtgcaccaccatgcccagctaatttttgtatttttagtagagacagggtttcaccatgttggtcacacatctgttatttgaggtaagaatgaagacatgactatcccacttaacagatgaggaaacagaggttcagaactcagtgactttcccgtcattccatgttaatgaagaatccagcagtgaggcttcccggctcctttagtgctgtgtttctcctattacaccatgctgtgctgttagtatgtgtgtattcatgcatgtttcttgatatagactttctctgacaaaaatacatttgggtaatttgtggctcctttctccggttgcttttgaatttaaaggttataacatatttaggtcctatgttaatgagcagcttttcctttgggctaaaacatcttttcctctttagcaactttggtcatgtggaattcaaatttgttaactcactgcataaacagcaactcatttaaaaataaattacaaatattaaaggaagatagagaacacgatagtatgctatatattgaaatacatcagctgtagaataatgcatcttaatgaaggcttcccatgtgaataaaccattatatttacaagctttccatagttaatgacccagaactggataacgaaacctacatttatagcaaggtcctccgtcagcaaaaatatacatattaataattgatgttgctgtaaaaataggacataatgtgatgcctcctgagtttgcggggaaataggactacatggtccattaacttaaaatgcttatctaatgtttgatgggctttgtctttaaaaatccttcttcaaattagtaagagaaaatggacatttgtccaaatgaaagtctgctcaatttatcagctgcaaatatacttgcaaataagtgactgaatgctgttaactttctggggcagctcgctgtcttgccggagtgtgctcttcgtggcgctttgttgttaccaaaggtgaagaaggagcagggtagacatctattcccagcaaatgaccatcctgtgaaatttctcgccatcgtcaatgcagagattgatgagcaccacggcccccctggacacctcagtgttcattaggaagcacttagaggcgcgtgttcggtcagatcattgggctcgccacatgccctgggtctaattttgcacatggaagacctcacgctgcggaatgcaccgctcctcagtcggttcatttcaagatcatgcgaagagggaggtgttctttagtttgttaaaatcagccattttgtttcatcatttcatttcagagtaatatatctatatttatgtatctgtgtttatacaatatacctactcataaagatgaacccagcaggagaagtgaaaaaagatagtacagatagctagagctgatggtttgcttttgccctctgctcagagtaaagttatggtaaatctttatctcagatgcaacaattttagtgggcacaaaactattaaagaataaaaaatgttctagcctgttaagcctaatttctaaaaaaaattttagtatataaaaaaattgctttattaggaactgggttataagaggtctagttgtgcttataattaaatagtggtgggcttttcatctgttacttttgtgcactactttctttaaaaatatattaaacactttgatggcatttatggtttgctaggcactattttaagtggttgaaaagtattaactcccttacttctcaacacagccttatgctactaggtagcattactatcttcatcttatatatgagaaaatcgaggtacacagaagtcaaggaacttgtccagggtcacacagccaggaagtggctggggctttggcctgaggcatctatttctggagtctctgttcttactctccgtgctttgctgtctctctctgctgataggtttcctctgacttaaaaaaaaacacttttgggtactatagaccatacttttataaaaaatgtgcatttgtaattgtaatactgctgaactaccttgcaaagaggttggactatttactctcccctcacaagaagtgcatgacaatatctgtgcttctataccttgccaacactgtaacgttaacttttttgatatttgctaacttaaataggtaaaagatggcaatttaagaaggacttttgaattatgaatgatgtgagcatctaaatgcatgattataagctatttaaaaaattaatagctaacacttacgtagtgcttactgcatgctactactgccagacactagtttaaatcccttacagacagcagtttctttaatgcttaacacaaatctatgagctaggcgttattactacctccattttgcatgtatagaaactgtgacacaaaggggtcaaggtgccagcccaagttcacacagctagaaaacagtcggattggaatctgaacccaggcaggttggctccagggttcttgaccttaacggctttaatctgatgcattagagcactttgcaatgagccctcatattagataagtaaacacagatgtcctgccctagaatgtagacaaaagattcctgggctcaggggacaaacaggagggtaaggaagagaattattttcatcatttagtctctgatgatctggagacctgagacaagaataaaactgcatcccaatacaaagaaaaaactaaaaataaaaccagaggttcccaagtaactagattgcaaaatcccacgtaatagaaaagaaaatggtgacttttcctttttttccccaaagcctcctagagtggccttttgaaaccacagatgcttccaggcgtccttcttgaaattctaatctcctcactcaggtgtctgatggccctgaagacacagttgtataggatgcactgcttgtgtttgcaaactttttgctggtgcaacaacacaagctgtgtgcacaggtagcaccatttttgcctccacaattcccccctgcagctagctatggtagacgcaggtgagatttaaaccctatgggctactccaaaccctttgctttacaggatcatatttttaacagactacattttcagttcataacttcagcagtatatgatgacaaaggccaggacgttttatagttgaaactcagttgcacatgtattttacacaacaatctatttattttgaatagtttgtgttttgttgcatgaaaagttatagttgttgatagttttccactgtataaaatcagtcagatatcgtgacaacatactataatttttcaagataattaatatcagccagcattccataatggcatatcctatcccaagctccaggctagaccattttccttcaatctgtcataagggcctcctaacagcatctctgtgaaataggtagcactctccagcccctacagaagaagaaactgaggctcactggttaagtatgtcactcaaaatccttccattggcaaactgcagagctgggctttgagcctagctctgtctgcctgggaagcgcacactcccaactgtcccccaatcccatgcctggttctccctcaatgcaggggagcaggccttcaaagctggtgcctggaaactcacactcgtttccaaggtgctgcttccttcccaggacatgtagggaacagcccttttgcatttaaaaagtgtaacaaaacaaaaccaaagccaaacaaaatcccacaaatcacagcaaatgtattttttgagaataatatttttttaaataaaaataatcaaagatcatctgcagcaaatatgatgaataatgcacatgaccaagctagactacatagtttcatttcattttgaaatgaaagtgtgatcatcaaagagcatttcatttagattctttgctcactttggctttgacagcaattcccaaagaggaaccccatgttctgagggcaacaaaagcacaattacaatatgcacagagctttcccaaacagagtctcgggagagggccacgctcatttgggcgcccaagctcgtacttgaggttagttgttaataagaaagaaattgaatgtattggccaaaaaataatttagaatacagcttgcctcacgttagaatgggaaagtgaacagggttttacgatgcttttaggattcagtagatgcgtttaaaagtgacaggtcttcctctttaataagtgtttccccagtgttctttattataatgcaaacactgatagcttcagggtaacataaaatatatgatggtcatgactgtaggacaaattatttcaaagggatccacaaaatgaaatgtattacaatcattaagtttccttctacttgatccactccattggctctgccaattaaaataactgcacataaatttttagagtgctatttatttttctttgtagattttagaatataaatatttaaaatgacaatatccaaaaaaaaaaaaatttatatgacaatggtaagagaaacattcggtcaggaattgaatgcatgatgatgtctcttgctctaattctggtttcagttactaaatagtcactcctagaaatatgccaagcatctcctaaagatacaaatatggttttgatcagataagtcaatgatttctacattggtatagtgcaacaaaatgaaatcataaaaaataaattttaaaatgagtaggtaatatcttaaccagtgatatagtggaaaatatattcaattgcaaacatttctttgatttagggtgatagattttggatttttaaaaatggtttccagccagtgaacagaagacaacattcttttaaaaactgaatccatatatctctcaatggtgtacaatttcaatagaatatgtaatgccaagtgaagacacactcaaaaaaaaagcaaactgaagaaagtcacattgaatacaaaacagacgttattctctttatactattcaaactgtattgctgaaaaaattaatacaaacttcattcatttgagctgagtacatgtaaactacaaagtaacactaaaataaagttaaaagcatgtaattctatctttgtatggtatcagtgtaagctagtaagactttagcatgaacaaactgtgtttagccattgcctaagtttctggtgtgtggcacagcataggtgttcagtaaatgtagactgaattaaataaaatggaactctaattaaatagaagttgttgaatcccaactgattctaaagtaaaatttcatgttaaacttagactgtactagattaaatcttttgacttctaatttaatttttaaagtagaaaactggacataacaattgtttttatcattacattctatatccatgtgtattttacgggtgttgaacagagaaatactgacatatcatcatgtacctacctatccatatacaccaaacaatctggagatcttaggggaaaaatttatgaaactctactgccatttaatattactttttttgttttgtaaaatgtagtactatttatttttaaaaatgaatgcataatagatatacatattttcagggtatacgtgatatttggatatatttatgtaatgtgtaatgatcaaattagggtaattggactatccatcatctcaaatatttatcttttctttatgctgggaacattcaaatcctactcttttagctatttagaaatatacaattgattattgttaactatactcactttattgaactattaaacactagatcttattccttctatagaactgtatttttctacccattaatcaatctctcttcatttcccctcacccacctgcccttccagtcctctggtaaccaccaatctattctgtatcttcaggagatccacttttttagctcccacgtacaagtgagaatatgtgatttttgtttttctgtgctggcttatttcatttaacataatgacctcctgttccattcatgtctgcaaatgacaggatttcattactttttatggctgaataatattccattgtgtatatacataccacacttttctttattcacttatctgttaataggcacttagggtgattccatatcttggctattgtgaatagtgctgcaacaggcatgcaagtgcagatatctcttcaatgtattggtctcctttctttttgatatgcactcaatagtgagattgctggatcatacggtattaggttggtgcaaaagtaattgtggtttttgccattactgttaatggttctatcagcctaatagttctatttttagtcttctgaggaacttccatactgttttccatagtggctaatttgcattcccaccaacagtgcacaagcgttcctttttctccacattcttgccggaatccattattttttgtcttgttgataataatgtactttgatttgattttgtatatggtgagatataggggtctagctttaatcttctgcatatggttatccagtttttctagcatcatttattgaagagactgtcctttctccaatgtaggttcttggagtctttgtcgaaaataaattggctgtaaatgcatggatttatttcagggttttcagttctgttccactggtctgtgtgtctgttttcaggccagtatcatgctgttttggttactaccgttttgtagtatattttgaagtcaggtggtgtatgtaatacctccagctttgttctttttgctcaggattgtttgggctattcagtgtctcttgtggttctataggaattttagaattttttttctatttttgtgaagaatatcattttgatagagattgcactaaatctgtaaatttcttgggtagtattcatattttaacagtattaattcttccaatccatgagcatggaatatcattccattttttgtgtcctctccaattttttcatcagtgttttatagttttccttgtagaaatctttcacatctttggtttaaattattcctaggtgtttcatattttttgtagctactgtaaatgggattacttttttgaattttttttagatttttcactgtttgctatagaaatgctactgatttttgcatgctggtttgtgacctgtaactttactgaattcatttataaattctcacagtttttttatggaatctttaggttttcctagctataagatcacatcatctgcaaaaaaggctaatttgacttcttcctttccaattctgatgtctttgatttctctcttttgccaaattactctggctaggacttccagtattatgttgaataaaagttgtgagagtgggcatccttgtcctgcatgtttcatgtttattgatttgtgtatgttgaaccattcttgcatccctgggatgaatcccactaggtcatggtgaatgacctttctttttttttcctgattgtattttttttaaattgtaatttccagggtatatgtgcaggatgtgcaggtttgttacataggtaaatgtgtgccatggtggtttgctgcacctatcaacccatcacctaggtatgaagccccacatgcattagctatttttcttgatgctctccctccaccggccctccacctccaacaggccccggtgtgtgttgtttccctccctgtgtccatgtgttctccttgttgtgaatgatctttttaaagcattgttgaatttggttttttagtgttttgttgaggatttctccatctatgttcactggggatgttggccggtagttttctttttttgttgtgtctatgtctggctttggtaccagaccttatagaatgagtttgaaagtacaaatgacccttgaacaacatgggggttaggagtgctggtgacacacacagtaaaaaaatctacaaatagcatttgactccccaaaacttaactactaataactggttgatcagatgccttactgataacataaacagtccattaacacatattttatatattacatgtattacatactgtattcttacaatgaagtaagcgagaaaaaagaaaatgttattaaaatcataagaaagagaagattatttactgctcactaagtagaagtgcatcatcataaaagttttcatcctcactgtcttcaaattgagtaggctaaggagaaggagaaagaggagaggttggtcttgctgtcttaagggtggcagaggcagaagaaaaatctgcttataagtgggcccatgcagttcaaacctgtgtggttcaagtgtcacctggtcttttcttctccttaattttttttaatagtttgagtagtattggtattagttctttaaatgtttgatggaatttggtagggaatccatcaggtcctgggcttttctttgatgggaggctttttattattgattcaatctcattagtcatcattggtctgttcaggttttctgtttcttcatggttcaattttggtaggttgtacatgtccagaaatttatctgtttcttaaaggctttccaaattgttggtgtacagtttttttgtcatagtttctaacgatcctatatatttctgtggtatcgttgttaagtctcctcttaaatgtctgatttcctttattttggtcttctctcttttttcctcctagttagtctagctaaaagtctgttaattttgttatcttttcaaaaactcaacttttcgttttgttgatttgtgtgtgtgtgtgtgtgtgtgtgtgttttagtctcaatttcatttatttctgctctgatctttatttctttcctttcactaattttgggtttgatttctccttgcttttctagtaccttgagatgcactattaggttgtttgagctctttctgtttttctgatgtaggcctttatttgctataaacatttcccttagtgctgcttttgttatagcccatagattttcatatgttggtttcaattttcatttgtttcaggaacttttaaaattttcctcttaatttcttcattgacccattggtcattcaggagcatgttgtttaatttccatgtttgtataatttccaagttttctcttgttattgatttctagttttattccattgtcatcagaaaaaatacttgatatgatttcaaatttttaaaatttgttttgtggcctaacacgtactatattctggagactattccatgtgctgatgagcaaaatgtgtattctgcagcagttgggtaaaatattctgtaaatgtcagttaggtccatttggtctagtgtgtagcttaattctcatgtttctttgttgattttctgtctggatgatctgtccactactgagaatggggtgttgaagctacctactattattgtattgcagtatatctctccctttaggttgatttaatgtctgctttatatttgggtgctctgatgttggtttcagatatatttataattattatattatcttgctgaattgacccctttatcattatatagtagcctttttgggttcttttttttttacaatccttggtttgtagtcttttttttttttgagatggagtcttgctctgtcacccaggctggagtgcagtggtgtgatctcggctcactacagccaccaccacccaggttcaagcgagtgtcctgcctcagcctctcaagtagctgggactacaggcatctgccaccgcatctggctaatttttgtatttttagtagaggcggggtttcaacatgttggccaagctggtcttgaactcctgacctcaaatgatccacgcaccttggcctcccaaagtgctgggattacaggcgtgagccactgcacctggccagtttgtagtctattttatctaatagaagtatacatattcctgtcctttttttccatttgcatggaatatcttattccattcctttctttaagtccatgtgtgtctttataggtgaaactggcttcctgtaggcagcatatggttggatcttttaatttttaaaatccattcagccactctctatcacttaattggagaattaagtccatttacataaaatgttatttttgataggtaagaatgtactactgccatttacatttttttttctggttgtttgtaatttcttcctttcttatactcttcctttgtgtttaggtgattttctctggcaatatattttaattaattgcttttttatttttagtatatctatcataggttgttgctttatggttatcatgaggcttacaacaagtcatataagttattttaaaaagatgaggacttacctttgatcacaaagaaaggcatagaaacaaaggaaaaactaaaacaactacactttatctcccccacattttgactttttgttgtctcaatttacatctttttatattacttgtctcttaacaatctgctgtagttactgttaattttgatagtcttttagtcttactagagatatgagtggattacacaccacaattacagtattagagtaatttggctttgtctgtatgcttacttttatcagtggcttttagatctttaaatgttttctttctgcatgttagtgtctttttctttcagactgaagaactccctttagcatttcttgttagatgggtctggcagtgatgaattccctcaaattttgtttgtctgggaaacactttatctcttcttcatgtttgaagttcagctttgttgcgtgcagtattcttggttgacaggttttttttttttttttcctttcagaacttaataaatatgtttttctactacctcctggcctgtatggtttcctttgataagtctgttaccaaactggagctccattatatgttatttgcttcttttctcttgttgcttttagaatcccattgctgtccttgacttttgagagtttattatataccttgggatagtcttatttgggttgaatctgtttggtgatctctaaccttcctatacttggatatttttatctttctctaggtttgaaatgttttctgttattatttatttgaataaggcttctaccctttctcaactccctcttgaataccaatgattcttagacttgctcttctgaggtaattttctatatattgtaggtattcttcattccttttcattcttttttttccctctgactgtgtattttcaaatagcttgccttcaagctgattctttcctctgtttgatccattttgctgttaagaacctctaatgtatttttctatccagcaaatgtatttaccagttccaggatttgatttttagaagttatttcaatatctttgttaaaaatttctctgacaaatttcaaagttgctttcctgtgttattttggagtttgctgagtttccttaaaattgctatttggaattattgatctgatggcacacatgttgccatctcattagtgtcagtcactggcttcttgctttgtctcattgaggtcacatttcctgtttgctgttatttcttgttggtgtatgtctatgtattgtcattgaagaattagttatttattccagtcttttctgtttggattgttttggtttccttttgatatgtttgcttaggggttctttacaatttacctgttgaatttcctttattgctaggtaactgcctccttttcagtactttatggaaccttaagcccaggtttgcattagctctagcaaatgtttggagtgatgcctggcccaatggggaaggtcccaaaggggatatccctgctatgcaggaaggctggctagtggtttttgcccaggggacctgtggagcctgccttctacagtgtggtgctgctgaacagccattctgactttgcatctcttttggccaagatacagagaagagttttgtgggctggggatgctagtcctgcctttccctttgtctctggctgccctaaaaggtttttatccttacagatactcatgatgcttcctgtaggttgaggcagggatagttctcctgcaagggaacccaagatggggaagctggttatttacattgatctcactttttccagggtagaaaccatgagtctgggggagattttttccacacatgaggtgcctggcagattgcggggaggagcactgtgaatatagaagtctgattttcttactattggctcagaatttttttacctctctgtggccctggaggtcaagtcatccttaaatctgagttatgggacattgctggtgataatcttggtgctggatattcgtttttgattttctgttggggggagtgaagccaggttgcttctattctgacattttggtgagctgcttttacttttaaatgtgtgttttttttctaattaacaaagtaaaatttgactattttagaaaatgaagatgattacagacaaaaaagaaatctcccaaagctcacacattaaaacatcagctttattcagactttgtgtattttctttctttcttttgtatgtgcatggatgtgtgtatatacttagttgaagtatttacactttagttgaaatctatatactttagaattatacatattatatgtataactatatgtataattctatgtataattctacatattatatgtagaattctatgtataattctacatattatatgtataattctatgtataattctacatattatatgtataattctatgtataattctacatattatatgtataattctaggtataattctacatattatatgtataattctaggtataattctacatattatatgtataattctacatattatatgtataattctatgtataattctacatattatatgtataattctatgtataattctacatattatatgtataattctaaatcctgaatttttaccttgagcattttcatgtagtcaaaattagtcagaaacatactttttaatgctggcatatcactacattatacagggacatcatacattatttaacattgtaattatttaactagatacatactgtaagaatactaaaataagttattcccaattttttcgctattaaaaagaacactgtcaggaacttctatgcacacacatctctatttttggtgagtatcttaaaacagaaatataacttaaggatgaagaatataaatatcttaactatcctgtggcaacttgccaactggctttcagaaaggctgagtccatttaactccttgtgttaagaatgagcatctcatcactaccttgtcaataattataattttaaaaacttttaatattttgctaataagacagacaccacttaccccatttcactaattctaagatgtacatttttcatagtttagcatatctgaaattagggatgggtgtgtattacactcaaggttgtgttttggcttatttggcagcacttttttttcttaatggcacctaaaaataatgatgcatcttacaattgatgatatcttaaagattcaatgaaattacagtagaatctcatgtaatttttattttgtatttttgaccactagctaagagccatgatttatacagaaccatttcaatgtgcgagtgaactttttaaaacaaatttaactgtggtaaaagaacataatataaaacataccagtctaactatttttcagtgtgccattaagtagtgttaactataatcacattattgggcaacagatctctagaactttttcatcttgaaaatggaaactctgtacccattaagcaacaactccccttttctccttcccccagtccctgacaaccaccacctactttctgccctcatgagtttgactactttagatagtgcatataggtgaaatcatacagtatttgtctttttgtgactagcttatttcacttagcataatgtccttcaggtttatgcatgttgcagcacgtgtcagaatttccttctcttttatagctgaataatattccacccagtgaatttctaaatcataaaaatttataacaacttgcagaaattgctgacccattggattctgacagcacacctaaacaactaaaaagcaaaggacaggctgggtcccaaggggttccaatttccaaaaacaaatgttggcttatttttgaaacacaaagatcaaacagaaattaagaatgtaggtgataaaatcaagatatttttgaaatcatatctgctcttctggtgttatttcttatgttttttaaggcagtaagcttggatatcacaacttgagagtttacaaacacagatatggtaagaccatgcccttccaccaggaaactaggcagttccaagtttctggaacatggacttgaattctttcctcaagcaaaataattatggtgaacaacaaaggctgtgtggagaggccatgactgcagatgaagcaatgcaggatgaggggccagggtaaaatgtaaactattctaaaactaaacgaacttgccgtgtcatttagaatgtgccattataaaactgatgaatattacatggcaatatcctgaaaattgaactaaattatattttagttatacttaataccactggcaaaaccttttaatttattttaaatcctaaaatccccaaaaagaaaactgaatatttatacaagaagacttaattaaaatatggcttaaatggttaggtttatggttgatcatagaacaaaaggatttaaagtatcaaccacatagtggtgaccactttatttattttccctgaaagtgaaaagaggaaggcagtattagaaattaacacttaaacctaaaaagaagattaaaaagaaaaccatatcctcacattggttaaaatgtcgtatttgttttacttcttatgttattctctgacatttctactgtgtctgcttttataaatagacagaaaagaatcccgatttttgtcctacctgacatatatatttgttaagtacacagaattggcaaaatgtatttcaaattgactattatttgatgaaggtacaattttaaaagctacaaattatttaagtcatgattcatgtcttttccccctctgacataattttgaacatgcattttatctgtaattttttagacataaaacacatgtttattgcagaaagatgtaagctaagcaaaaattaaaaaacaatcatggtgttcatattttacatttcacaaaatatgtagaaactctaaaacatcacttctaaagatacataataggatattttaactaattatttatgggcaccaatttcttacaactctaaagctatactaatatgaatatctgtatattgtatactttgctcatattcttggctttttttttttttgtagcaaagaaattccaagggttggcactactgggaaaaaaggtgtgtttgtcatgagacaaactgaacttagaaaggcgggcaatgaaaccctcagtagcagtccctgagactgtacttgcccttgggtccctgcccaaactgagtctcatccttactgggtctcttttctttcgttagcatggatttttaaaagcgatttaagtttccttatgggcactgtgctgtaggcggaaactcccccttctcagcccccattccttggtgcctccttcccgacctgcgtcgtgatctgagggttcttcctgccttatttggggccctccctttattctttacagacattctcctactaaatctcttgcatgcctaattccatgcatgctctcacaggacccaaactaacagaaggactttgaaaatcttttcagcatttgctacatggttgttttattaaggtttcttctcctttggtcagtttcactattcatacttccctagacagttttctctcttcaatattttctattttatgaccacagttgttcatgacatcacctaatagtttttaacctgctagtgcctgtggtcactgtatactgtgtatatgactacatatatatatgtcatatatatgtatgtatatatatataatatacatcatgtgtttgtaaatatacatatacacatacatacatatttgtcatacatttgtattttcttcttttcttgattagcctcaccagggctctgtatgttattagcgttttcaaagactgagtcattgtatttatcaatgttcctgtttcaacatttttacctgggcactggatgggggtatcaagccaagtagctcaccagaatacaccttaggtcaatgctggaatgaggccccaaagggctttgtttcttttctttttaaaattacaatgtcctttaatgaaaactgagcaggtcaacaaagccccactaggactgactggtccccttctctggtcataatgagctttgcaaagaattggcttcagggggtttgagagctgcctccaagtgcttaagggattgtcacatgaaagggaaagaggacacattccaagctactgcagggacagagcccagcctggcagtgggatctgcaggaaggccaattgcagttcaatgaaagagaatgggctcctgtgggaggcagaggttctgttttcaggaggggctcgggcagaggagtcagccttcctcagaggccatgcactcgatgaggcaaagcatgcagaaacatctctagcagcagacagactctaagatggtcccagtgaccccgcctcctggtcttcttccctcatgtaataccttccccttgagtgtgggtggcccctataacttgcttctaaccaatatgatagggcaaaggtgatgggatgccacttctgtgatcatttgcataagattctgagcagcccccctctccctgctggcttagacgaagccagctgccatatggagaagcacacatggcatggagctgggggctgcctacagctaacagctggcatgaactgtggcccaggatctgatgccctacagggaacagaatcctgccagcaaccacacaagcttgcaagcaggcccttccgcagttgatcctcagttgagacctcagccctggctgacaccttgactgcagccttgtgagatctggaggggaggacctagttaaggtgtacccagattcctggccctgagaaactgtgagacaacaaattggtgttttaagctactaagtttgtggtaacattgttatgtgacaatagataactaatccacctaatccacctttccatctctatgattcagtaatcaccagcaccagaaaaaaaaaaaagccagctgtatcaatgcaaacccactgttgtgaccgcccatcctaatatagtggtgtgcactgctgacatcagacaggaatagcagattgtgacggctcctagcctgtttccacatctacagcattctgcatcttgcacagaaatgtataaatggatataaccctgatctcttcagatctccctgggcaggcttctgtaccatatgggtgactccattccattaaatcatttatttttctttctttcttccctcaaaaactctcagaagaagacacagtctcacatattctattgtctttaagaaaaccagatgctatctcttaaaaaaaacttaccatacccaggaagatcatctcctcttctctcagtttttcagtttccttacgttgatggaaacgtcgccaaacctaaaaacaaataaatggttacttgtttaatacatacaaatataaagaaaacatggcttgcagtttctcccatataaactgcacatctcaaaatgccaactaatcctaagctctaggctgtccatgtgtgtgctgatggaatattttttcttctgtgatcacaggcaaaaacattgttaaaaagaatgaaccacagaactaacctataattgttattagtgagattcctttaccttggtttcttcaagaggaacattctaggtagcaggaatgtgaggctagatctaaggacggcacttcatggttttaaaggaaaaatttccaaagtaatgtggggaaatatagtaacctccaagaaatgtacaactcaagcttttaactcagatgctacaactttatattcccacagaaacccgaaagaaaacagactcttatccatccttccccatcaccttctcctattcctattcagggaaaattagggacagagtcctcatcttctggcctaattttatgtccttatacttattttctctgaaacctaatgctagtttatatcaccttgccatctgctgtgtttccctgtaagtaaccctagcctctatttgaaaaaaaaaatggggcacaaatccatggtgcttatctgataaggaaagaaaaccttacggattccttctagaagggacactgatgtgctggttattagtgatggctgctgcatgtttctggaatctattaaggcctggtccctcttctgtaattatatatctgtgtgtgaatgtattccaaaaatccattaaggatttatatcctcactgcatttcagcaacattcatttcaacaattaccaatggtctttaacaatatttgaataaaatgccctgagtttagtacctatttagagtaaaaatttgaaaatatgaccaagcttagttaatggtttccccagggtaagttaataaatctttctggaatgtaatctagttctattaagggtaggatttggtgtttgagttttgaagctcagccccaaaattgagatgtatctttagtgtataaggcaccttgtaccccaactccaggagccctaggtttgcaccttctgaatgcggagtgcagcagcccaggtatctgtcactttcttgccaagcatcttggattgctttgctctatattcttgcagatagatttgcttcatgaataaagcccttaggcgaccttgccgtgccctctcagcaatctggattaatttaacagcctcatcgaaagggatactctttacagggtatttctgcaaaaaacagtcaagataaaccaatgtttgaacatgttaaccacatcaattgatcccagacacatcacatgcttacttcaaacacaatcctgctaagggtccccacggctgatcatgagtgtgagaaccgctgaacactgttcatttttccagtgaatgatgtatattttgataacatgacatgctcatgctgtgatcccaaatttaagggccccctgactttcctttatccttctgaacaaaatactaattagctccacgatattttaggttggcagcaaattatactaaaaatgtcaataaaattgattcagtaaaacttgaaattgctatcaatatttcattaacttaataggagaaacagagaaatgaaaaacctacctctaatatgagcttttaaaatttaaaatatatatgaagtaaaatgctgatcttaaaatcaagtacagaatgcccagtgaatacaactaatatcgaaatcattttgggggcatttaattttatatatgaaaagtcttccagtgtctataaacttgcatcttaaaacattcaaacatgatgagtactagtaaaacagaaaaatcagggctggtaagtaaaatgttgttttgggagatctcacatggtgtatgtggagacaaagttaggcgaggggctgtgtcattttttgaggaaagagggacaagaacaaagggctccgggtgcatgctggggcctgtgtgggctctgggtgcaggtgaggcctgtgtgggctccaggtacatgctgggacctgtgtgggctccgggtgcatgctggggcctgtgtgggctctgggtgcaggtgaggcctgtgtgagctccgggtgcatgctgaggcctttatgggctccgggtgcatgctggggcctgtgtgggctctgggtgcaggtgaggcctgtgtgggctctgggtgcatgctggggcctttatgggctccgggtgcatgctggggcctgtgtgggctctgggtgtatgctggggcctgtatgagctccgggtgcaggtgaggcctgtgtgggctccgggtgcaggtgaggcctgtgtgggctctgggtgcatactggggcctgtgtgggctctgggtgcatgctggggcctgtgtgggctctgggtgcatgctggggcctgtgtgggctccgggtacatgctggggcctgtgtgggctctgggtgcaggtgaggcctgtgtgggctctgggtgcatgctggggcctgtgtgggctctgggtgcatgctggggcctatgtgggctccgggtgcagctgaggcctgtgtgaactctgagcaggctcaatgggaggccccagtgctgttccagaggccccagagcaagggaacaggggctcatgtggcctggcttggggggtgtccatgcatggatggaagcagaagggacagatcactggagtcagaaaagcaccaaagaggccaggcacagtggctcacacctgtaatcccagcactttgggatgccgaggtgggaggattacttgagtccaggaattttaagaccaggctgggcaaagcggtgagaccccgtctctaaaaaaattttttttaaattagtggagtgttgtgggacacacctgcagtcccagccacttgggaagctggggcgagaggatcacttgagcccagaaattggaggctacaataagctatgatcatgccactgcattgtggcttgggcaacagagtgagattctgtctctaaaaagaatttaaaaataaatttaaaaagaaaagcaccaaagcataggtgaagcctgtttccaggcctcagagggcagcaatggttgccacagtaggacaatgtgaaggtgctgaggcttcatgtgtggggcgctgccaccagggccactgctgccaggatgatccctcttctgtgcaacaaggccagggtcaggggcacaggaaggagtgagaaggagaggaaaggcacatgtatactgagaacctgcagatgtcagatgctttttttatgcatgctcatcacattcacaagagcaaactccaaggctggtgttactgtgaccacttaagagtgaagacaactgaggatcaaagaagtaaggtaacttatgcaaggccccgtgggtaagaagagaaggagccaatttgaacagactgaccgtctttccactaagcaacccactacccttcaacatggcacaaggaatatgattgcttatgaggaagctctttcacataacaatccctctgagtttgttttcagtaagatttcaccgcttcaaatttgcagtgagcacacattttcaataatgcacttgtcaagttagagtagaacgagtatcattctggcattaaatgagatgatgaacttagcatacagtacccagcaaacatgagttagtatcgtatttctttcctttagattccgggctgtcattctgaaaatagtcgtggccattatcaaataattctaagggattttgagtagggaactcaacatgtcaaacatttttaagcatttaaggaggcccacagtggatattaatgtaggagatggacaataattttcatgcatcaaaattcttcttgggttatatatattgtgtgtgtgtctgcatgcgtgtgtgtgtatatatatacatatacacatatatacatgtctcataagacccctttaagctgcttatatacagtacgtatcccaagaagaatatattgtgtgtgtgtgtgtatatatatgtgtatatatatgagtgtgtatatatatgtgtgtatatatgtgtatatatatacagtatataccccaagaatatattgtgtgtatatatgtgtatatatatgtgtgtatatatatatacagtatatatatatatacacacagtatataccccaagaagaatatatactctgtgtgtgtgtgtatatatatacagtgtgtatatatatatatatacagtatatatatacacacagtatatatatatatatatatatacacacagtatatatatatatatatatatatacacacagtatatatatatatatatatatacacagtatatatatatatatatatatatatacacacagtatataagcagcttaaagaaaggggtcttatgagacaccaaaggccatggggaagtcgcagcagggaagtccttgtggttttctgagcccctggcacatgtgaaatgagactggggtggagatgaagtacttaacccagtggaggtgataggggctggccaaagctggatgctgaaggaacacagaagcctgtctgctctgactgagaacaaatgaagaggaacagtgagcaggacaaatggcaaagaggaatttttaggatttcactgtagtgagtgcaacgtaatctcccttctccattttccaacacaaaatctttagtaattctgcagtgctcatcactgcttggtgcaaagggattcctttcagggaatgaagtgtgagtgcttcgctctgactgatgcatggacagaaagcacagacataggagcccagtggtgaaaggatggctagttgacccccaagtaagttggctttggaatggacttcaaggaattcataatgtaaaagaagggccagtagctgggagcaggggcacaggaaggagaggtcatcttgagttaaatgggtgctatggtttaaacgtgtcccacaaacttcatgtgctagaaacttagtccccaatgcaacagtgttgggatgtgggacttttaagaggtgataaggtcatgaggcctctgtcctcaaaatgaattaatactgttatcgggggaatagcttcctgctaaaaggatgagctcaccgccttacttcttgctctcttactatgtgattccttctgccatgttatgacactgcaagaaggcccttaccagatgcaactcctcaatactggacttccaagcctccagaaccataagcaaaataaacttctgttgtctttaaattacccagtctgtggtattctgttataccagcacaaaatggactaagccagtatgtcaggaaaggtttcttgaaggatggtgtatcaagttaggctccgcagaatgggtaccattttgatgagcaggtatgtaagggagaagaacaagccctctatccagcagggaacatgcctatgggaaatgagagacagcactgggctggcaaatacagggcatgcatttcacctctcttctgaggcaggcacacagggcacttttttctcctgccatcctcagcatacacttggaatcttccttaacaccatcacccaggctggcaatacccaatgagggctatttgtagaaagactgcaggtgctggtttaccctgggaccctggcctgcagttgcagcctcagcatagttactcatagtgcccctttcaccctggagtgtcccagcttgaatggacaagtgctgccttacagcttaggacatgaaggccagccagaagggtgaggcagtaagttactgaaatgtataggcagatctgccatcctgccagaaggtagatagggcagtgccctgtggaaagggtgggaagaagactccccaccagtaggctgcatgggggatgactgcaagaatccaggaggtggtcatgagagtcaggctaagacagctgtggaaacaggaaaaagatgcagctgcacaaatcctgtggacaaaggaggtatcggggcacagaactaaatggattctgttccttgcttcccaggagggatctttatggattattcttcccccaatgacagtccattcaaggtgatccaagtgtcactcaatgtattagtccgttttcacactgctgataaagacttacctgagactgggcaatttacaaaagaaagaggtttaatggactcacagttccatgtggctagggaggcctcacaatcatggcagaaggtgaaaggcacatctcatatggcggcagacaagacagtttgtgcagggaaactcccctttataaaaccatcagatcttgtgagatttattcactatcacaagaacggcacaggaaagacccacctccatgattcaattacctcccaccaggttcctcccacaacacatgggaattgtgggagctacagttcaagatgagatttgggtggggacatagtcaaaccatatctactcaacctgcaattataaaaggccaatcagcatttttagaaagtgtagtaactttcaagttcctagtaagttatgtcagcacttaattattttacatgaacaacatttagcttctgacttcagctagatgaatttgagatgaaacattaaactgcgttgataatcaacagatactgatttaagtagcatatctcagtgtctaagctcttgatctcagtgtctaagctcttgaaaaataatgattatatatcaccaaaagcacatccaaaagttatgcaacttcttatgtactgtataacgagggagggatcattctctgcttaaactgaaaataatctaagtgttgctcacacaattaggagcagcagaaaaaggaagttacacagattatggattaatgtttgttaaaatgatatacaaaccatgtcagatgtatctattccgctgtccgctaatatttgagcaagaattttctctcttccttttattacttccaacttctccttcaaaaaatacttgggtatgggaatatctaattgttgctagagaagagaaagaataaaaaagagtatttccgtcacaatgccaggactagaactttatttaaaatatacagtaaggacgtgcacatcaaagacgcttgctttacttcccattttcatttaagaaaaaaaaaatgaggccagcggagtgaggagaattcatttactaaagagacacaaagtcagaaagaaaatcataaccatgccccttgctttaatcattacagaaaagcatcaagagttcacatcaattaggcctcaattaactaatgattacttaatagatttctttaaagaaatacaatattacctcgttttacctaaaataatggttcaaattgcagtagtaaagtattaagctgtagagatctttgaattaaacctaataatttatcattagcaccgactatttgtatgtaaatagtcacatttttttctagtaatttggttttatttttaccaaaattaccccattgcaaaaattatttacaaaagtagtttgctttattgtgaaacttgtttttatataataaacttctatccttcatttgtgcatgttaccaaatatttcaaaccagtgggggttcagatgaaaatttatcagttcaaattgagtaaaaaggagtacagaagtgctatttaaggatatgggtatgcccttggccaatcccactgagaaacattatcctagaatttctgtcagacctgcctggctgttttgacaggaaagcaaaggtctttgttttcagaattggctaccttatttttttttccaattctaggtgtgactccccataacctccctccagcccagagaattttggataggccttcccctaagtaaacatttaagcctaagagggtatcatttttaggacctggtgggacagtatccccatgacttctgggaggtgacaatgtcttttgaacaccaaacctttctgaggctcatggagtgctgggggtgacgggagagtgaactagcagagtctagtgggtgggtgtggcctgaggagagagggcagtaggagaagaatgatgacactttgatttaatgtgattttatttattaacaagcacattcaagtgtggtacttttataactttgaagacaaaacctcattgtcttatagctccatctggtccatttggtaccacaaaattatagttagcaggcaggcgtggtggctcatgcctgtaatcccagcacttggggaggctgaggcaggtggatcacctgaggtcaggagttcgagaccagcctggtcaacatggtgaaaccccatctctactaaaaatacaaaaattagccgggtgtggtggcatgcacctgtaatcccagctacttgggaggctgaggcaggagaattgcttgaacccaggaggcggaggttgcagtgagctgagcttgcaccattgcactccagcctgggcaagaacagcaaaactccatctaaaaaaaaattatagttaggattttgaggatgagaaaacagagtaactgagaatggaagagaagcaaagagagatattggttgctccatctatgtccatgatgcgtttcatgtccatccctgaaaccttgaggtttctcattccctatggagtggaatctaggaaacttctggtggtagagaaagcctcttccccaccatatatgtctctctatgaggtgggcccattaggaaaggttcctcacatggcaggttacagacatagtcttcggactaaggggcagtttaaggaaggatttggggaactcatggaaccaagggcaggaacccagctgggtgtttgtcagtaccagggttgtggccaagaatgaagatgccttcagcccaccccaaccaaccatgtgggattcagtgacagcacatggttcagtcactatttctaggactgctaggaaacactgttgaccgccctctgcacgaaggcttcctggatgccatctgctcatttgtcactgctcttggtgcttggtggccccatccccacggcaacaatggcatgtcctttaggaagatgatgtccctggagcagaggggcctggctgatgcagcaggaaaggcaaggccgtggagtagccgccacatagagccccaaatgcgctattccttaacaacaggggcatgacttcctattcttgaaattcaactaataaatgtaatattcattaattaaatttaggaatatgatttaataactatttgtttcacagttatcctaaattgttcatattgtcactttagtgagtaaagtgcaccagattaaatctggtgattggcccatgctcttatagatgaatgcaataaacataaaacttttagaataatcatcaacattttcattcatttcagttattctcattactccattctgataaaataataatgtgaggaaagcctatctcagaaagaaaggtacctctataaaagcccaaatattttcaaggagaagaaacgtgaaaccctcatgtagaaaattaaagactttctcctttcgattttacttcaaggaaatgttcctttcaaaatgaaggtgagctcccaggaccatgacactgaggggaggtggccagtggccccggcagcccagccagcctgagtcagaagagaggccctgtgctcggcaggaacgtcggagggcagcagcaggggccgaatgctcgcaggagggggctgtggttgccaggcgccagcagcaagggctccagggagagagggaaggaagggaagagaagcagagggaaagagggagagcaagcacatgagctctcctttgatgtctgaggcccactgccatgtaagccatacattcccctgggtcaccactgacccaaagtaaggaggagatgcatccacttggcaatagggaacctgtgaccaacaggctacagagagattccatggaaacagaggagcgggcgctgctactggatgctgggagggtctgtgtttcaagggtgctgatgaaagggctggcccactgcattccaacagccctgggcagacactacgatgtcaggtaagaccacagccacgacagtgcctaacacagccaagaagtgtgcagatgcatctgcaccagaaagaaagggagcccaatccttgtccgtgacagcatggtgtaattgaaggcaaatgtttagattttccgtacaccaactagtaaacacggacaggaagtctgtagagtatcgtgtacagatatcgggtacatatcttatttataacaaaaaaaagcaactaataagaaaacaacagagtgcttacgggggccagcttgagatcctgcaggatatcatcgaaataatggaactccgtgagttccagctccaccatctcgttcttcagctccaggatgcggcccatcaccccgtccaggactttcctgatcagtattcgtttctgggggtggacgaactggtcgtagacattctctaggtttctaaagatctgcacatactttacgtagaaggtggctaatgtttgaaagatgaaaacctgatttctttgtggttcaatcatcttctgaggctctttatcgagtaaagcaccgagggcttcttgggtctgatgccacatcttattatacattctgggggaagagagagaatttagatgatacagtaaataaaaatcacttggtaaaacataaacatcgggcctctggtatagcaaaatataacacagaatcaagtgtgagctaagaatatagttatatagttgcaaggcttgatagacaatttatatcctgttctgatgtccttctgatttctgaatatgtaccaccactattatcatcaaataaatagtttaaaaagcattttgtctaaatgatataaagttgttcctcacttggcccataaagccactattattatacccatttaaaagatgacaaagttgatatccagaatagttaacttatttgtccatatacacagctggtgaagtatattttggaacaaccagtttggaaagtaatgtagcattttcttattaagttgaacgtgtgcataccctgtgaatgaataattataccctagagaaacttgtaaatatgcatcaagaatgatcacttgcattttttaaataatagtaaaaacctgtagataacataaatgtccaccagtaagagagtggataaataaattgtagtatatacaccaatggactatcacacagcagtgaaaaatgaatgaatgaagtacagcaaaaggcaaccactaagaatcttagaaccatgatgtacagtgtgagaaatgaggtgcaggctgggcgtggtgaggtgcaggccaggcgtggtggctctcgcctgtaatcccagcactttgggaggtcgaggcaggtggatcacgaggtcaggagatcgagaccaccctggccaaccccgtctctactaaaatacaaaaaaaaaaaaaaattagccaggcatagtggcgcccgcctgtagtcccagttactcaggaggctgaggcaggggaatcacttgaacccgggaggtggagtttgcagtgacccgaaatcatgccgctgcattctagcctggcaacagagcgagactgtcttaaaaaaaaaaaaaaagagtgaggtgaggtgcagactgtggcctgggaggctgagctctctggaatgcaccagctgggctctctgccctcattccagtgagttgagttagtggactgaacaaagaggaagccagagagcagaggagtatgaccctcttgtccacaccctggcgaggcaacaaaggctgggtgtgcccttccaccaaagccttaaggtggtggtggctctgctgtggctggccccagaatactgccccatcctttgccggtttcccgagactatgtccacatctttgttactggtccctttattaggccctcatgagtgtccccgcttttcctgccagagccaataccttcatggtagagattcccaccttcccctaccaaatttcaggtgatttttttattctgcttttacattcaagaaccaggactgaaaagtgaactggaaagtcagtgtgtctgggaaggagcttcactgtagaaagtgggtgtggagagccctgatcattgatgaaggagaaatcgaaaaatgtcagtatctctctgtaaggcctttccctatgctaaggggagggggcagccctaatcccctgaaggagaagcaagccggtcaagggggctcacctcttgtttactgtcagccaggccactcattcccgtgcttacctgtgcctggcgtcctgagtccaggttggctgcatgtgccattttctgcctggttggctagtgccttagccacttgctctctggggtgtacaagtgattggcggcctaaatgtggcctatacagatctgcaagcagtcctccaatttcagccctgtcccagaagaaccaggctcccacctggcttcccagggaaacagctggcttttgatcacccagccccactcactggctttcaggtcccacattctctgcccttcctccattccctctcatccatgcctgctctccctttcccacattttctttttttctttttagacagtctcactctgtcacccagcccagagtgcagtggcacgatcttggctcactgcaacctccgcctcctgggttcaagcaattctcctgcctcagcctcctgggtagctgggactacaggcgtgtgccaccacctcaggctaatttttgtatttttagtagagatgggggtttcaccacactggccaggctggtctcgaactcctgacctcaagtgatccacctgtcctggcctcccaaagtgttgggattacagacgtgaaccactgtgcctggcctcctgcattttcttggtatctcttgtcaaatgttttctttgtccttgtgagttcatagctttaaaatcctttattgccattttggaggcaattcaggaggaagaggagataagtatccatggttaaccaccctgtttgactgggactctctcttctacattcccaagtcattattaagcagcccctccaggcatcctctgccccaggctcaccatctgccattcctcaaacatgctccattcttccctacaaactaagcatcatttattgaagcactgattaaatgtgcttttttcacctttctggcgaaaaggtaaaagcgtatcttgatgtttgcaagacttttgggttcagatgatgatgatgatgatgatgatgatgatgatgatggcgaaggtaacagcttacatttatatactgtcagtcactgtcctaagtggtttccatgtaataactcgtgtaatcctcacaacaaccctatgaggtaggcataattattagtccagtttatatatgagaaaactgaggcaaagagaagttactgcccaaagtcacagagtttgaatgcaggacgtacatgtaggcagtccggctccagagttcatgctctaaaccacttgacttcatcgcttcccgtttgtcagggagaaagcagacgaggaaggaggggtcccgtgacacagaggtaattacatcacaagcaaacagactgagcgtaaaaaccaacactcttccccccaacaccccactgagtcaggagactgaattctgcctttagaatcccatccccagcacgtccgaatgccagatttctcaaaacttagcaatatttaaactattgctagtgaaagagcactcttccagaccagcttattataagaaagaaggttattatcagaaaattaggattccacttggcacagtgtattagtccattctcgcattgctatacagaaatacctgagactgggttatttatttgtttattttgagatgcagtttcgttctcgttgcccaggctagagtgcagtggtgcgatctcagctcattccaacctctgcctcccaggctcaagtgattctcctgcctcagcctcccgagtagctgggcaggcatccaccaccatgcccagctaattttgtatttttagtagagacagagtttctccatgttggtcagcctggtctcgaactcccaacctcaagtgatctgcccacctcggcctcccaaagtgctgggattacaggtgtgagccaccacgcccagcaagactgggtaatttataaagaaaagaggtttaattggctcacggttccacaggctgtacaggaagcatggcagcatctgcgtctggggtggcctcggggagcttttactcatggtggaggcaaagtgggagcaggcatctcacatggcgggagcaggagcaagaggaaggtggggaggtgccacactcttttaaacaaccagttctcatgataactcactatcaagagaatggcacaaaaggggaaatccacctccgtgatccaatcacctcccaccagaccccgcctccagcattggggatgacagtttgacaggagagttgggtggggacacaaatctaaaccatatcacacagaacacacattgactcctggcagaattagtgactaataaacaattacactgatcaggaacaacaacaaccatcactcaaaagaacaacaacaaaagcaacacctcatgccagttcaaagttcctgggaccctctgacattctgcttgtcccacctcaaatagacaagcaggaggggctggaagaagcaaagatgattgagatgatcaagggaatggtttggctgtggacaacgatcaagaacagaggatcagcatggtgtgagttttccaaagtccagacttctagggcccgagaagggacagtaaacccaaggcgctcactggcctgagtgaggatacaggctagacatactaacaggtgtgacaactgttgacataaaacagaaccatgctcaagttgctttgtgagcttaataggatttggggcccaaacctgccaggacaacattcaagaggaaaatgacaggctaattttgtttagaactcggatctgaaactccacttagaaaacagactgcagctccagatcaaaagaattgttccctctaacccaggagggttgactgcaggagtgcttttcagttcaacacagaggaaagcataactccagacagcaacagtccagcaaaaccccagcttgtttcatagatgccaagaagatgctcagtaaattgtaacttgcagcacaggcctgattaaaaatgccctccccacacaccaacaaaaaaagaatgacgacttcttcaaagtgccaaaaaccagtgacccaatggaccttcagtggagaaatgctagaaatatgcccccaaaattagcagtaaaaaaggacaaggggatacgtaagtaattaatataaaccattttttaacaccactgcttataaatggcatgactgcaaaatccaaggaaatcagtaacaaaaatacatcaattagtacagcaagggccaggcgtggtggctcacgcctgtaatcccagcactgggtgactgaggtgggtggatcatttgaggtcaggagttccagaccagcctggctaacatggtgaaaacccacctctactaaaaatacaaaaattagctgggcatggtggcaggcgcctgtaatcccagctatttgggaggctgagacaggagaattgcttgaatgtggaggcagaggttgcagtgagccgagatctcaccactgcactccagcaaaaaaaaaaaaaaaaaaaaaaaaaaaaaaaatacagcaaaattgcaatactttaatgcagagaaaaaaaatgaaagcagaaacccattcacagcaccaataaagaacaataaatatttaagaattcacatggtggaagccacatgaaatctagctaaaggaaattctagaatgctaggtacagatcagtgcaagcagaagtcactatctgctcctgtctaaagagacaaaccctgtctctactaaaatcacaaaaattagccgggtgtggtggcatgcgcctgtaatcccagctactcaagaggctgagatgggagactcacttgaacccgggaggcggaggttgcagtgagccgagattgcaccactgcactccagcctgggaaacagagcgagactccatctcaaaaaaaagaaaagaaaagctataaagacagaagactttcaagacatacatacagatttaatatggccaagaattcagtaacaatagactaaagactataaataaatctagtaataacttttaaatatgggagtggaacagacagtaaaagttaaaaggcatcttatacttccaacattggccacaccaacaagcattaagtttgtacaataccctgaagaggctgcctccgtgaagttcaggtggggtgatctgaaccccacaaagacccaaagtcaacaacagcaagagatctcgggttgaagaggctcctgcttccaccagggggaaaccacagccgacctgatggggcagagcacagccagattttctggatgtctagacctgctgtgggcagaaccatccaggggagcccagtcgctccaggtcagagccctcattggcttcagttgggtcagagaagcaggacttttccagggcctcacggagctgacccataactggaatttttggtcaaagacagtcctggtggcttgagccttccgggtcctgccatttctttcttccccaactgcagtctgtctggggaatccctgtctgggggagaccaggcaaagattcccggctgacaggaaaatgagcagctttgaaagcacacggatccctgcatcattacctgttttcctcagcgctgagagacggcgtcatctccttccaccagaccctcttccctcgagactgtctctggcttcctgctccccagctgtcctgatgcctctccacgtgaccacaccccctcccacactggaccgccagggacctgggcaccatgcctcggccacgccagcctggggagcccccactttgcgctcagcccatctggccttgcgccccacctcctcgccctgcagcctcaagcctctttctgcttgagcccagccatgaaggtcaaatgagacaagagaggcggcaagatgatttttcataagagcattgatgagagagaattcacacagcatagaattcactcttttcaagtgtacaattcagtggttttcagcatagttgtgcaactaccaccattatctaactccagaacattttcatcactgggaaagaaacccacacccgtgaagcagtcactccccattccccactcctccctgcccttggcaacccctaacctaatttccatctctttttgcctattctggacacttcacagaagtgaaattacacggcggtgggggggggcgttcagtgctgagctcctttccctcggtgcggtgtcctcaaaattcatccacactgtcgcatactttgtacttcatttctttctattgctaagtttcctttgtacagatacaccacattttgtttatccattcgccagcccattgacacttgggttgtttccgccttctttgctgctgtgagtaatgctgctagaagcattcctgtgcgagtttctgcgtggaaatatgtctttattttccctgggtagggcaaggtggttttcaaaggtaaaagtgctctacatttaaaatagaaaccagtgtcctgagcagctcatccctggaggtcactcaatctcttcatgcttacgcctccttcactggcaaacctggatgatgagaccaactctggacacctccagggactactgtgggatggtgatgtggtttggctgtgtcccgacccaaatctcatcttaaattttagttccataatccccacgtgttgtaagagggacccagtgggaggtaactgaatcatggggacagttacctccatgctgttctcatgatagtgagttctcacgagatcggacgattttatcaggggcttttctccccactttgctctgcaattttccttgctgccgccatgtgaagaagggcatgtttgacttcacctgctgtcatgattgtaagtttcctaaggacttcccagtcctgcagaactgttagtcaattaaacctctttcctttataaatcacccagtctcgggtatgtctttattagcagtgtgagaacagactaatacagatggaacaacaggtgtgaaagtgttcctggaattttaaatgcactttgcaaacagaaggtaatattttatccatgagactacttaacagtttttgaaagtatatgattggtttcagacttgagcatatgacttagagatatgacagattttgaagtcaggaggcttgtggatgaagactgaatatgacagttaaaaagaccagactgttatttctacagcttggcagttttcctataacggagtgggtaggggagggaaacacttgaatattcacttgaatatatgcacttccgtgggaactcaaaatattgcacaatgggaattcttttcaagttattttgcacaagataaaaccttctgaatcttccaatcttaactagtttgctgtcttcttccccaaatactccccctgccttcttgctctacggaaggcctgtctctgctcagaagccctctcagtagaggctcctgttacccccagagccctctgtctctggctgtggggctgggtcaaggggaccccttctcttcactgcacctccagacatttgccttccctcctcccaacactcccaggctttgaatcccatttcatctgatgctgtcaccactgcccctcagtcaccatcatcttccatctaccatgatcgttccaggccacctccagagcacccacccactgaatagcatcttgatgctgccttcctacctgttccattgttaagtgctgagttcctctacctaaggccagcaccccctggatcccatgtcctctcactaccaacgatgtcacccacttctccctcctcctcctatatcattctgggccattcccttccacacacaaacattctattgttttctgtcttggagccatgtcctctgcctctagctgccaacatatttcctttcctctgcagcaaaactcctttaaagagttagctatgctcaccatctatagtttctctccccctacattcacttgagtaagtctttctatctcatcataccactgaatcagctcctgtcaaggtcactggtgaactccacactgccaaatcaacagtcagttctcagttctaccccaacttgtctcaggagcacttgatggaggagaaagaagttacttctcctggaaacactattatttcttccactcgcttcttcctcatggatcatgtctttgattcctttgccaggtctcctcttcccccagccttactgtggatgatcccaggatcagtccttacacctctttattaatattcattctatgtctcacaaagaccatcacaggctgacagtgagcaagtttatatttcagacatgggtctcgctcctgaacccaagatctgaatattttaattgcctatttcatctccacgtgatgtccaatgggcacttccaactcaatacgtcttaaacagaactcttgatcttccccatttccaaaccctggcaagcctttaacctctctgctcttatttccttgcctagaatacagggcacgtaatagcaacagtgcaggctggagctacagtgcccggcttggcactgttcacttgctgtgtgaactacttcacctcttcatccccaagttccctcatctgtaaaatggaaataacaatattaacagcccctacgttacagggttgctgtgaagcggttagaacagtgtctacagggtcagcgctgtaatacctgttggaaattattcttacgaagaccaaatgaggtaactttgtgcaagtgctgtgtaaacgacacagtgctaggcacacacttctttcagtaccaatgccactcgagtctgtgaaaagcaaatgtcaataatgctttcccaagatctttctagacttaaatttcaggacctaggtgtttccacaaagcaccgtatttgttaccgtgaaagattaacaaaaaaagcagacaaaatggcatagtgcttctcagcaatagcccctaagggcttggcaggtatacggaagactgggagctcatccccatggggtggtgggacgcgtaggggagggggagatctaagtgtatgattttccttgctcacaagaagcagatactctatcccgaggcatatttgaatttcctaaaaggaaaaaaagtgggggagaggagggaagttgagaggggaggagaaaagaaaagaaaaaagaaaataagagaagcagaaagcaagccaccttctggcttggggaagcccactccatggctgtggctgggagcccatcacttacgcgttcgacattgctggctactttccctcttttcctcgccctccgggaagctcttccgttgctctctgaaggacggtggcagcaggggtcagggcactaccaggagctacagaggatttgggtggggggtcttctggagggagaaaccaggactgcgagaatcttctgcttcgggcaggaaaaggtgaggccg

SEQ ID NO: 1599 - DNA, 26276 bp, Homo sapiens
agacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagcagttctctgagcctcaccactgggactcccagggtgggcgggcaggcaggccaggaggctcagccctttgggctatgttgctcagaccaccgcagctttcttaatgctctttgtgaaccaggagggcggtcaggggaacttcacagtgcggggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcatacacacagcgttaaggcgtctgtgccagcaggcacggcccggctgggcccagcttctctctctccacctgcagagggtgtaggggggagaaccctggctgctgcagaaacaggctgaagggggagaagctgacaacggaagagttaaccaggcctggagaaagaagtgggaggaaggaaggcaagggctttctaggcctccatccaggcctgctggctgcccttgaagtaacccaactcaggttggggagccctgaccatataccccctggaaaatgggggacagaaagaggggaagagagcggggctagagtattgggactttggaggaagccagtgctatcaatatttacaagcataaagccccatcttctgtgccacctacctctctgcccctcccacagaaatgaaaggcccctgagagccatggaggaggtgcccagacctcctcaccagctatgcccctagggagagcccctgccctccaaccggccccatttctgggcccctcaggaatgtctgtctggctctgctcagtcgggaggaggcgccctgggccagaatcctggctgccaccagccctaggagtccttgagcatgctgatgcgggcgtagatcttcagggcgggccccagcttgatgttcatggcgctcatcaggtggtcctccttgagcagcagcagggcttgcccgtcgatttcctgggcacggaattcctctgctatctcctggcagcctgagggggtaccaccaaagacagtgtcaatccaagccgccagtgttcacctctggcagccactgcatctagttatctagatctagttatctgcatccattatttcttttagtcctcataaccacgccttgaggaaggcgctgctgttcttattttgcagcttgagagaggctgtgcaactcacccacagcagccgcgatctgggcctcctcctatgttcccctgttcagacccctgctccatgaactgggcggacccatgtccactaaagtgctgaggaagtgacagcgtgtgatttctgaggctagatcataaagggcacagcagttctcacctcactcttctgcctgggttactgcagagtaagccagctaccagtaagccaccccagcaaccctttggagaggcatgcgtggagagcagccaaggccctggtggtccccggcctccttgccgtgtgagtgaaccgtgctggaagtgggttttctggctccagacctcagacactgcagcctgtatggcgtcttccctgagacctcatatgacctcaaactcatacactgggtctgtggaagggagcagataacctctctgtttctagttcttagactaagaggaactggacaccaggagcctcataccaggactgcccagccgagccactcgattcctgacccacatggcccttgagatgacaagtgattgctgcttaaagtcactgagttctggaataatttacatcatggcaataggtaactaatgcagattctggtacctggaaaaggagtgctgacatcaaacagctctatagatgtgggcgtggcctcagaactggccacaggcaggagccagaaggactctgtggaaagcgtgagtgtctaaggtgctttgagagactgtatatagaagtctcatggcctttagggaagctgctggggaggcctaaaggaaagtgaggaaactcttagtggagattggaagaaacagggtctctgttatgaaataaaagaacattttgtaaaaatgtggttggtagcagaaatgtaagttgaatgtacctcatgaagtgggtggtctagctaaggagattttcaggcagaatgtggaaggtgttgcttggcttcttactgctgctcacagtaaaataggagagagagaaggtaaaaacaaacaaacaaaactgttcaacataaaggaaccgggatctgccggttttaaaaatgcccagcctctccagatggcacatgatgctaacattaagaaatggtttctaggcaaagatcaaattcagggcacagtcaagaaaacacggtctacagattaaacttaggatgtgacttaaatctttttgtgaagacttcagaaagatctaaagtgatgcctcaaagagctattcaatccaaaggctctcgacggattttctaggcatgcctcgcagatcctcttttcaacagcagggtttctaagaatgtgaagggcactgtccatgctgcccctcagcttcagaagaataccaatgcagacaacagcttacccttgaagataattctgggtgtggtttttgtctaatggaatggaccccaacaagattcccagaaaacccacaattattttaagaaatactgaattactgattttaagagtcaaaggtaggccgggcgcagtggctcacgcctataatcccagcactttaggaggctgaggtgggtggatcgcctgaggtaaggagtttgagaccagcctgccaacatggtgaaaccccatctctactaaaatacaaaaattagctgtgtgtggtggcgaatgtctgtaatcccagctactcaagaggctgaggcagaattgcttgaacccaggaggcggaggttgcagtgagccgagatcacgccattgcacaatagcctgggtgatggagcaagcctctatctcaaaaacaaaaaacaaaaaagtcaaaggtaatataaaataaaaaggaggaagcaggctgagaaaacgactacactgaaaatacaggctacttttcacagaaaaggaaggagaactcagagggcagaaccaagacagaaatcactcccaggctttgagtcccaattgaggaaatgccaccataaaccctagcggatttcggaactggaatggatcagcgactcttgtacgctccctgtttctccctttttggatgggcatgtctgtaatggttatcctatggctgtcccactgtgcattgggtttgtggaagggagcagatagcctctctctctagttctcagatcttcagactgagaggacctatacttgaagaactggaccccaggagcctcatctcacctcaatgatgagagcctggacttcaaactgatgctgtcatgggaccaaactgtcggggatttggtggcggtgagggtattctgcatgaggaaggaacacaaatttctgggggtcatggtgaactacatggcttgtctctgaatggctcccaataatccttgcttcccagttcatgccctctcacaatgagtaagactgacctgtgtgacccataagatattgtgaaaaattttaattaaaaaaatatattgtgaaaatgccagtacgtggcttcagaggctagatcataaagggcacagtggcttctaccttgcactcctggatccctacctgtggggacatcccactgccatgcatatcatgagaacactcgagcagccctctggagaggcccatatagacaagaaccaaggcctcttgccaacagccagcccagggcaaatcacgtgagtgaggcaccttggaagagatcccacagctcttcagtattcacgtgacctcagccttggctgataaatcttaattgtaacctcataagacacctgaggcagaacggcccaggaagccactcctgaattccttacccacagcaactgtgtaataaaaattttggggatgaagagataacatactaggttaagtgacagagccagaatttgaacccagttctgtgtgactcagaagtctgtgctcttaaccacactgcagtctcttgagaaagaggcttgtggttaccatgaatacctgacctggtcggtgtatgagtgagactggcagaaaaacagtaatgcatccaggccccactgaaggcatctgtgaatgatgtaaggcttgcctcttacagctggctcctagatcccgggcctcaccaccacttgtgctccaccacgcagggctctgtgccatgtctggccataccacagacttccctatcttcatgcctctgcatgtgcgccctcttgcagtctctccatccagcaaaggcatacttgtctgtctactgtcatttagtttacattttcttaattaaattttttttttttttttttggtagagacaggtctcaccatgttgcccaggctgttctcaaactcctgacctcacgcaatccttccacctcagcctcccaaagtgctgggactataggtgtgagccaccacacctggctattttcttaattttgatgttcctgacacatatcctacactctacctgactcccctcctaatctctcccaggagagagagacagttaattacattatcatctctgtatttcacacagatcacttcccatgccagaaaatatacagaattacagctatggaatatttatagtttgcattctatgctgaatataagcaagctcttataggcagggagctcatctcactcatttctgcaccccagttcctgaacctgagtcattaactaaactacctaatcctcctggtggtgggagggtctctcattttctctttccttgctattccggggagacatggaatttccaagggccttacctggcagagagcggatgaattcgtagacgtcttctacattccacttggtgggctcacttggcaggaagtggtgtcccatgcccaccaggtcccgcatatgcatgtcggggagctccaggtcccgctggccttgtcgccggcgggaagtagatgagctggctgagatgggtgacaagggttcctcatagcttgagttatctgagcaacggctggagtcttcctggctgtgtgttagctgcaaagcagcagtaaccgaaaggggcacagtgcctgttggctgggagcagagagttttcttcaggatgggggaacaaaccatctctagcagcagtgatgaacaaaggaggtatttctcctttttctacttggcctactactacacatctgagttcccagatctaacagcatcttccatgctgtcctgtctcctaccctaggcagagttagtccctcttagtattgtagtgtctaccacacaatactgcaattatctttttctaaacatgagttttaaagcagggctctgagttctaggaggtgatcacagagccacttgaaatagcatgtaacatttcttctgtacgtacacagctttggaccattcttaaggaggtttaagacaaaaaaaaaataaggcaaaattatacataaggttataaaacatcacaccatgctgtggagttcctttaaggcgagactgtgtccttagagcctagtgcctaacagagtttctggcatacagctggtgctaaaaaatatttaatgactgaatacccatgttcctggtagagaccttcaagaactctgtgctcgcgtgttcagggaggcaaaaaggtggcaaaacaaagggtggaggctgccttctcacccagccctccacgtaaggcaggaggttacctgagcagcccaggggagaccccatttccgtggccccagaagccaaggatggaggcaaactggaaggtggggtgatgttgaggcaaggccacggaagggggcagggaaccttgtaagcacccatgggtctaaatgaagggacctactggggtgcagaaggctcgactggacaggtctacaaggaatgagagcacagcagagtgcgctgaagtcggcagctggaggggaccgtggtgtcgagggccatggaagggaagctgtggggactgtggggatggagcttcaggctctgcccgcctcttacctgcttcttggtatccttggtaagtggtggcagactggctttgctggcccgacggcggttgtgggtcgcagctcctgccttctgcagcttgctccggtctgagtggaaaagtcccacccgtttggtgcatcccacgttgtaccttcagggacaggggaacaggggatgtcacagtagtcattgtgcttatgggccgtaggcagaatgagcacagccaagctgtctgacaaattttgagtccatctattggttcagatcctaactccatcactaactactagctgtgtgactttgggtttaagtcacttaagccctgatcctccgtttccttatctggagttgggggtaataccactcactttctaggtctggtcttacaacatgagataatgtctgtaaaatgtttgagacacctggacttggaccagggcgaaagctcacacctgacttattccactataaatgttaccctgtgacgggaaactactgtccactgtcctgctggggagtggcctggctgctccaacagcctgaggggaatgagggctgaagatagctgaactctagcttggcatgcagaacacctctgtctgggacctagagatttcttctcttctgggatttcagggcttcaaggtcagctgttgcttccattgtggtacaaagaccacacatggctttagaattggacaagcctaaatccccaggcccatggcttattagctatgttatctgaggcactactactcctttgtactttggcttcctaacctgtataaaggggacaatagtaatacctgtcttgggagttattttgaagatgagataatcgtatcaattgactggcacagtgactagcacacagcaggttctcaggaaatggcagtggtttttatgatgaccattagtgatctatgctgggcgagagctcaccaagggaacactatagctgtggttctgggtaaggcttaccctaacaaggcaggggctgtcaatgctaggaaaggcgaatgggtgccagtggagcccaggagggccagccgagccaaagcactgcggcttttccttggactcccgctgctctctcccacctgctcttaggggttctggcttctcgtgcttgttgaattagggatgccatcctgcttccaggtgggtcgaggaactaggaaactggagaagccacccctatggacctcctggggtagactattaatggcaggaggtgggacataaagtgcagtcctggggaaatggagggggctggggccactcacctctttgcacaagccatggaacagaagcgcttggaacgcttgaacttataggcaaagtccacccggccacagagctcacacttgagtttgaggggagcaccctcctctttggattctgaaaagtatagaaatgggtagggtggagaatgagaaattcctgcaggactgtggccagccccaccacggggcctccctactccatcctgcctggtcctcctgctcccacagctgtgacatacagcagcattctagcatggaaaatgccagtggttctcacccctggaatgcactcaagggtgtctggggatgccccttgtagacttgacatttttttcttccacgtggtctgagtctgaggcaaaacacaggtggggaagaatcagcatcaaatgactgtggaagaaagcaggagcccccaggaaatactctggatgctgtcacagctgctccgctggcatcatcacaccttgatctatgcagctggctgctgacccagtaaaagacctcaggagcccacgctcctgcagctgtgcagctctgtcagtgcttcatgtggaaagagcagccttgcctggtctctgctgtgacctagagctggccccagtctcaaggcagggacgaagggcaggacttgcctggggccactcctacagtcatgcctaaaacttgccaatgattcccacaggaaaagccattcttgggatcctgtggttggctggagggggattgggggagcagaggacacatggttcccgtgatttcccctatccctctttttgagggaaggaggctgaggaggtgctgggggaaatgtttacagactcgctggctcagggttcctctggggaaacagagagaggaagtgtgtgaggcctgcctttccagccacgctgggaggccgagagattcagggtctgagatgcccaccttgcagatagggctcctccatctccgagtcagtggtggtggtgtgatcctgctgtggaagtttctcaggcaggaacccctgtgcatacttcttcttgagattccccaccagcagggacgagcgtcccacctagaggacaggtaacacggaggccgtgagggtcaggtgggagcggcttccttgctatccatcctcatcacaattacacgtataaagtatccaggcacagaggccagccctcctcaaaccttcccccatgtcatcatccaagtgtgctgggctcaaggccctattttgctggttggctcacgaggtaagatgctaatgggcaaagtacagggatggcttctgtccaggaccaacggatggctcaggagattaggaaaatgtctattccagtaagagtctaagggctgagatcaggtttcccacagtgccagatcaagcaccaagacccagtacccacgcatctccaggcaaggacagagcggagtctgtgtgaggctgtacatacgagagagagactcagcacccattttctgatttttttactgttctccaccttaccccaatgcctgacccaagccagaggtacaggccgccacagagtatagcaggaaaaaacagaccctgggccacagagccaatgaactctcagttgtcagaaccccagagcagcttatttacgcgtttagatctccttttgtggcctgtgtttaggcagcctggtagccagtcacgtggcaccgactctagggcaatgctgggggtgctatgcaatctgcctccaccccatgagatcaggtggtttctagtgttactctaggaggcccagtctaacagggaagggatgtaacagagcgagagccacttctagctaaggtgttccaggcagatttctttgccactggccttggacaacctccagtgggaaagaagacaagaagctatgtgtcttttggcattttacaggagcagttcacccatctcagttaatcaagctccgcgtcttctgcagactaatcaaaccactcatggaaccaaagaatgaggaaaaggcagatggtatcccagaaaggtgtcttctccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgaccctgtttcctcacattcatttctgatacacgtatctggagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggctctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccggggctgctgaggtcggtcagtgcatgaacaatgccctgccctgtctctgcacgagagagagtaggaaaacaaagcaggggagatcagaaccagagtccacgcccagggagggacagcaaggactcaaactgcgcccggcttttaccgtggggccaagcgacaatgcaaaccaagcagtcccctcccctcagtgacccatttaaaagtggcacagtttcaatggacacatcaccaagtatgagtatagtcagttccacaacaacgcatgcagctaatcagctagcagtgtttcttcatttcccaaccgtgctatgaacagttaacccggataaacagacgggaattctatctttgaggagttaagaccttggtcgatactgatttgaacaaataaggttaatactcagtttgagggagaaaagtattcaaggtgacatctaaaaccaggacaagaagctgagctaggtatagggctttgagtgtgataaagagaagcttctacgaggttccttagaggagggattttaagagccctgtgaaatgtcaaaacactgaaccccagaaattgatgccaagggaatgtgggtgctgaaccccaagtaaaggctatcatgtatatttgactattcagagactggtcatctggggtcagtgcattgaaatatgcagaaattccatttctctgctaagaaggctgctaggcagaggctgagattttctctgctgtttctgctgagctgagtgctctcaaaatcagtcctcatgcccagatgtcagcttcttatctaatctgatcctcaccaaatcatagatcctctgtctctctgtggacaacctttcctaattctccttccccatgggcctgctagccttcctctaaaagacctaacagagtgctccagaaagtgagattacatgcctatacacaaccacacgacagtgaacttcctctcttccacttcaaacagcatctctcatgagctgtctcattgtcttagacgtgcaagacttcatctcctcacttctgtaactctctcccgcccccttcccagggctgttctctaccaccatcaactgccccgtgagctgaggctgcctttaacctggaacttcctaaaaaagaaaagaaaaagccatttctttattgcaacaagtccattaatataaagcataccccagtgaggtatgagtgatatatactttaaaagtgatttcagcacacttgttaagtaatctttgcataaaactttatatgaagatgctcatatttcatgttaaagatccataataccaccacagaataggaattctttgtgcttaattatatagtatggaaaagtcaaaacagacacgtttgagaaaaggtggtttagggccaggcatggcggctcacacctgtaatctcagcactttggaagaccgaggcgggtggatcaccaggtcaagagttgaagaccagcctggccaacatggtgaaaccctgtctctactaagaatacaaaaattatccaggcatggtggtgcgtgcctgtaatcccagctactcaggaggctgaggcaggagaactgcttgaacccagggggtggaggctgcagtgagctgagatctcgccacccccctccagcctgggcgacagagcaagactctatcttggggggggagggggggaaagaaaagatggtttatgactagttcataatgggtcttggtccactcaagctcatgtttttgttgttgttgttgttgttgtttttttttttagatggagtctcactctgtcacccaggctggaacgcagtggtgcgacctatgctcactgcaacctctgcctctcaggttcaagcgattctcctgccttggcctcctgagtagctgggattacaggcacgtaccaccatacccggctaatttttgtatttttagtagggactgggtttcaccatgttggccaggctggtctcgaactcctgatctcaggtggtccacctgcctcagcctcgcaaagtgctgggattacaggcatgagccaccgcgcccagcctcaagctcatgttcttactggtggttctaatgctaactaaaccaggataaacctttaatgaacaagagttgactatgactcatgtctttagtactcagtcctccataattcagctacataataaacttctgagctgagcaggggccatctaagagaaaggaccaatgaagttttttttgtttgtttgagacacagttataccagtaagttagaaagtttccattaagtgcctatattcacttgaaaaaaaatttttaaacagctttggcttttctgtagagatggaaacatttcctttcttttagaattagtctttccaattgcaaaggtgtctgagaacttgagagcttgtctggaggttctagcaggggagggcagctactcgtatgcccttgactgagggacggccctcctctacgggatggtcgtcctctttgacccagctgctggttcaggagggacgcacatggagcagtgaaggaggaaggggacacctgcgtagccagccagatcagcggaatcaactctgccgatcaatggggtgacaggtgttgcagccagatggccctcacatccatgtttgagaacgtagaaaaaacccctttccctcacaatctatgaataactaggaggactgagttgatgattcaatcaaattaagtttctgtgcttttaaattttaaatatttaactctgcctttacacaattacattttctctgcttttatgttttgcatatgctaagaaacatctattttatttaaaatgaattactaacatagattactatgaaagctaaaattttgttttttagatgatggctatttcctcccaattagagcctggtaaaaaatattccctgatgagtctaatgaactgcagattatacaattataggattggaaagtctggttcgatctcttgccaatgcttgaaaattttctataatatgcccacccaatgattttctggcatttgtttgaatacctccagcgacaaagaaactcactactctggaagcagtttgttcccaccttggacggctcattagtgattccttatataacgagcccaaaatctgtctttctattaatttctgcccagttatcctcgttctgttccttaaactcacagagaacaaggccaatcagatttgtctaacaggcagagacacgggcttagacctggcttagagactggtctctatcattgagtcaactgcgggcaagtcattgtccctctctaagcctcagcttcactggctgtgaaataaggatcctacgcctaccttagagtgctgctgtgaggactaatgagccagtgaaaggcagtgcgtgctagcttacgagaaaatgcttgagaatgctcctggtgtcatgaaggatgtcactcatgaccacagtcttctctcctccaggacaaagcccttctgttctttcaggtatttcttacataaaaaggctacaaattcgtaatcatcctaggccctctctgcccacatcttttaacatcaggtacctagttaatactaagcatcatctgtcaggtgtagtcatgtaagagatctggttggtaagatttttggttttctgtgtttgctttaaagacagtcacatctctgactgagagcataggtagaaagtattaattcccttgtttcagtttaatgaattcttccatggaattaatccattctcctcttaattctgggatcactcccacctcctgcctctttcgctgatagtcatcagaaaacagcccccctctgaccttgtcttttgtgggatccctctatccttgcttgacttccctgcctccatcccccactcctgtctcagatctatgcctattaatgttcactgcaagacagaagatcactcttgaggtcagagtctgtcttcatgccagatacattcgtgagcagatatggtcaccagctcaaaggctacagagccaatgcttaactctgggaagcaaaactttttggaatttgaggttgttttttaaaaaagatcttgttaagagagagaacacactaaaaaactcttgcaccacattagaaactaccactccccattgtaacccagggcagatcaaaggagagacagaatccaagggacagatgggagagtgttttatgaatatacaaaggttcacagctacttcgctttgcagtcatcttgtagaccaatagctcctcatctgctttagtaacaaaggagtttgggctattcctggaatgaccgaacacaatctcgccccctgccaagctcagcacactgagattaatttaatctgcttcccgctctcccagactgctttgcggcctttggggaaaagcagcttaacagtgaaacttgcagaaacctgccctgctggccctgaggccagataaaagagacaaagaaatactctgaatttggttccttactcaattcccttgaccagttcagaggctataagtgctgccgggcattcccacaggtctcaaatgcctgtatacagtcaggcacctgaaaccgaaaggtggaggcaggataaggccgatgggagaggctgggggaggggagtaaagctaggcttcggtgggggaagggggaggtaaaatcttggcctttagttgacgctgaccacaaagggccaagtattccggtcagaatgaacagagcagcatgttccacggagtcttgcctaacatatgtctcaacttctaggctgtttctcatttctggtctcattcacaggctctggtacaaacagcccttacaggggtgggagaaaacaggaaggactactcagctcctgtttgtgaaattatctgctttgggactggtcacgtctcctaagcagagcagacttctctaggcagggggctaccactcactcagtcacctcgagatcttcaggggctaaccccatgtccaaaatatgacaggtgcttaatgaccactaaactggaatgtgtggcatccatgatctcagtcttcactgtctacatatagaatacagggctgcctagtgccaagataagcaatttggcactagctgagatttacaagttgctttctgaagctatgatgttttgagagcagctaggctggtggtacctgcctaccggagcggcatttctagatacctgattatgaagaataagagctattttttggcccatgtcttcctgttacagtggggatttcctcaacagaaaagaggtacaggtggacctctgaattccctgtcccctttgaaacatttttgccagacccaggcacttggcaaggcaggatgacctctagaggcagaggcagggaggctcctaggaccagtgggttgatgtccagagctgacgggctctccagcctgctgaggacagacgtcaggctggtgccagttatgcacaattgggccacttcagagccagtgctgatgttttgttttgttatactggaatacagcttagtacaggttaagtatcccttatccaaaatgcctgggaccagaagtgtttttaattttggattttttcaggttttagaatatttgcattatacttactggttgagcatcccaaatccaaaaatctgaaacgctccaatgagcatttcctttgagtatcacgtaggtgctcaaaaagtttgggattttggagcattttggatctgggatgctcaatctgtactaacatctgcaacaggtatttcagatggcctagcactcattctatctgaccctaagatagcctgaagacatggcttcaaaggcaatggagaccaaacggagcttttccttctaccccctcaccttggtcaatggctgatttccaccttatcatgagaagggagtatgtattttaacttaaaagacttctatttactgtttggttgcagtaggagtatgacagagctaatgaaatgaataaagaatttaaagaagcagagtagatgataacatggctcattttcttacaacaaattctgctcaacaaatggcaaacaaggtcacctataaaacccaaagcacactctccaagcccccagcactgaagtcacgctcactgtgctgcagttcagcaggcccagccatgtggccagggtggtctctgcagggttcccaaggaaccatttgctctagaaaccgcctcagtggagcactgcagagtgatgcccagttaaaccatatccaggagacagcagcaaacacagcacatacctggtccaagcaacaggccgtactgcagtgcggtaagctgaggacagagtgcccagtcctcatggaaagatctggggccacgctttacaatttctttggttatatttgggcccccaaagaaattaatgccactgaaagtgaggaaggcaagagatttcacaaacacctgtttgttgacaccttcccccagggcggggtaagtgaagggtaggaaagtgactgagagggagttgcggggaggagggaggggaacaggcaggctgagctctatctgggaccctgacagagtccatcaattagagattcatttggttaacaatttctttaaaatgcaagtatacatcttacagtcattcacactttactgtgaattactcgactcagataaacagattgctttcctcccaatttagggatggggtgggggagggggtgggtagtgattgttttggatcacggggcactagatcccagaggattaaagttagaaaggccctgagtttaacatcttaaatgtcctagatgaagcaacttggcctcagaggtgaggtgatttgcccaaggtcacaaaaggtcacaaaaaaagactctaggcttaaatcccatcctgtaatgctgggcaagttactctaggcctgtttcctcatctatgaaatggggtacttatatctgtcttacatatagctgtggtgaggattaaataatgtaatgcaggcacaacacactggactaggctgagcttggacacaggcagtggcagaacccacactagaacccagtgctttagacttttccgggtgggccacacaggtggagggagggctgcgctgattagccgtggatagcacgagggcacttgggaaaagaggacaagacatgtaaactgtattctgggaccttctgaggcagaggccagatatcacatgtgggctggagcatttgggttgggaagcacaggatgatctagatgagtgattcccaaattgggattcctggatgactaagcaggatccctgaatctagttaatcaggacgcacaagctggattcaatatctgaagaagccgaaaaggaaacagcacataatatataccttcaggagggcaaaacatgctattatttaatatcatgttaccatgtttcccaaattctaaaatgcagtcagttgttaagatgacccatttcccccacaacgaatttacacattgattacgtgtgcgtctcaagtacagattgtaaaagtgtgcattttagaataaaacaaacgaatgccatttatttggaagacagtatcttgtaaaacatgcacaaaatgaactcttagtggtgggaaaattatagacccttcccacctggggtcctctgaataccagaaggcagggggaacatccaatgtctgcagccttttcaaatctgctaagggcagagctgtcaaagggacaaggactccttgccttgacacagcaggctgtggctccctgaggaacctctctgaagcacctcctctgaaggacctctcccagagaagggaaggcacagcagtgacagaaggaccctgtggggctctttgctgagaaaactggtgagcttttcaggcacaggagggtcactggctgcggatgactgagatccacacctgagttccttgcagggggctggccagcaggatgaaggagaggccaagccaggggaccctccagccttgccctcagcgtcactgcaaaatgctcttgctgggtctgggttgaaaggtttggagagcttactggattttaagcatctgtgttgaccagctcccgttaaggcatctggcagggagggggctcctcccatgctggcagccattaccatacagctgactttcatgctgtctctcaggacacaggcaaagagaacggcccttctgactcacccacaatccccagctaaagtgtacataagctgaattgtaaacagctgaatgtgctccaagctgccacccccagctatgcaggaaggaatcaatggagcgaacagccaccctccccccaccccatgcagttcaggacaacgggagcagtgggggatttccaaacagctgcttgaacgcttcccagcccacaggctgaggactgcaagaggggcctgagctcaaactcagcagcagcacctgcaggaccagagtgacttccaccaggtcaacacaccagggaataatagctggccctggctgcagggagtcagggaggagttttcaaagagttctacttaaccctggtgatggaggccagtccactggtatccaatgccagggtcaagggctcccagatagtctcacatcatagtgctccggcccatgctatgatttcaaaacgcaaaatgtctagaaccaatgggagaggttctacagtagacactaagatcaggggagataaaaggaagaatggcagagtagaaagagcatgggctctgggggccagacctggactcatattctgttccacctttaatcaaaggtgtgtggcttcaagcactcactgcctgttctgagtcttggtttctccatctgtaacaacgaggctcatactacctacctgtctgggaggtttcagtaaatattatatatgtaaaatgcctggcactgaatacacgcagaagctgtgctacatggcagttaagactgtgggattagaaagactctaggcggccaggtacagtggctcatgcctgtaatcctagcactttgggaggctgaggtgggtggatcacgacgtcaagagattgagaccatcctggtcaacatggtgaaaccctgtctctagtaaaaatacaaaaaaaaaaataaataactgggtgtggtggcgagcgcctgtagtccccgctactcgggaggctgaggcaggagaattgcttgaaccctggaggcagaggttgcagtgagccgagattgcaccactgcactccatcctggcaacagagcaagactctgtctcaaaaaaaaaaaaaaaaaaaaaaagactctaggcttaaatcctatcctgtaatgctggacaagttactctaggcctctttcctcatctatgaaatgggatacttatatctgtcttacatatagctgtggtgaggattaaataatgtaatgcaggcacaacacactggactaggctgagcttggacacaggagtgccaacgtcactgagacctgtgagaagattaggaaatcattctaatctcactctttcactgagtctggcctcttacagccccagagcagggctaatctttccgtggcccaaactgaggtatctgaggtttgtgttcctcagacgtcttggtctacgtcggtagtcctgtccttgcactgttgaggtcaggcttcaggaagaaatgttacctccactgtgactgcaacataacagaaatgcttctgtcctaaagggcaaagcaaagtctcaagtcaccttcaatggctattaatctaaaggacaagaagacaagcaccagattctctttctatgcagttttttcataaaggggggttttaagcagacagtgcagaagaaccctagaaaccaaaagaaaggttaactttaagacaaataaaaggaagcactgctttacttagaaaatactaaatttatgtaacttgtaatgccagatgatttagcttatgaaaagaaattagtttaaaaggctaaaaataaacccagtttaagataaactcatggaagatggatttctaccggtttacaaaagaaatctagaaatgtttagtaaactctccaattattttcaggttgataacagggaaaggcagccatgttccccaatatgatgactatttttttggttatcaactgcagcatcactaatattgttagataaatgtcaggggagactgggaggagggaacactaagcctcagttgtcctgtctatattatggactacatactacataccttgcaaatcagttctattgatcatttctgctcatggaaacattactcctttcctccttataaccattgtctaagcttccagtcaaccctattttgccaccagtcaactgatagaacagattaatactgattactggaggcctcaaaatatggatttaatcaaatttttttattttttattttttgagatgaggcctcgctctgtcacccaggctggagtgcagtggcacgatcatggctcactgaagcctcgactgtccacacttaagcgatcctcccacctcggtctcctgagcaactgagaccacaggcgtgtgccactatgcccaggtaatttttttttttaattatctgtagaggcgaggtcttgttatattgctcaggctggtctcgaactcctgcgctcaagtgatcctcctgcctcggccccccaggcatgagccaccgtgcctggtcccaatttttttttttaaagtagttgcttcatattagttttgttttaatttaaagtgtcatttgctttgattgttcaaaaatgtcttaatatagctgtgtggctttaggtcacatatggatggtttcaaatatgctaaagataccagtaactagggataattatatagtatttgagacataacagccatgcaactagagttttaaaaataactcaagcagtcacgaactttcattttcttgccaacagttccaatattcagtatcaggcctggtcctcctaatctactggagaagagttggttatggcatggcatctaatagtcatctcttcttaatacaaatgataataaatttcactgctaagacgacaatcatctgaaaaaaacagacatttgcttatgttttaaagtcataatagcaaactggggctctcttcaacatctggattcatctcagagcactggcaatctgtgtttaacagcagtcatgtctttaccagatgtagaaagaatgttctcttcttttggacttacctaaatatcatttggaaattggaagaacaggaaagcatatcctttttcactaactataaaaataatttggaaggagaaggaaacaaaaaaaaccttgaagttttctatgctggtctacatggtcttacaatgaatctcagagcaacggtttatgacttaaattatatgctgtgttccttagcatactttttcttcaaaaactagtaattctaaattgtataattcttgactatgataaaagagcccatttcttgaccatgtcatttatactggacttttgttactgatggggaaaaatccagaatttgtaataattatgtcttggatatgcaaatggttgattattttcctaacaattcccaaaatatccacatcataaagcagaattaaagatggtttgcctctcaatacctttagaaatatcaaatcagtgttctgatgtggctagtaattcaaatgaaaaatgttaaataagtcattgcttcaagtgaagcctacctctgtttgagttgtgaataagtagttatcttaaataggcaactttttttaaaaacagaaaacatattcaaaaagggttttaactggtgactcatagtttaaaccatgccctaaaaacatttaaagcataaatctatgtgttcagactcccatcttgaggggtagttcagttttgggttccatgaaacaaggtgttaagtccccaaagagagagccatttctgtcattggcacaaagtccccatcagagtagactgcataacgcagtcagttctcaccctgctttcccatagggctggggactggggggaggtggggagggtgggcaggctcagaggggcacctcactccaggacagtctcctgaggggtacacaaaagcctctctctacaaccacttttgtgagattcctcctgaccacagaaagtcatcatcatgatcatctttcagtagcaaaatggcacaaaacaaagggaataaaagagaaactatcaattatgaagactcctcattctcatttccctactctcgtctccagtaggtgtcctttcagaagagaatctttctatggctggaactaaatctgtctggagattaaatattgaacagctgggagaagtttaatataaatttagactgactcaagaagagggaaaaactcttggtaaacaccgtactaatgatgagcagcattacaggaactggagtcaccaacctattccctaggttttttaaactttaactttattttggcttgctgatccatgctggatgaaagtgaggaggtgggggaactttacttggcaaatggttactgaacgcctggcctgaggtccacagcctaaaggaggacagagacttaagggaagagtttaaggcagtgaggtcatcccctttacacattcacaatagagaaaagtagacaaaaagacacctacgagcacaccagtaggggttcctaattctgagacaataatcatgttctgtgtttttccttaaataagaaaatgtagagaggggacagcctatgtaagagcatacaaggccagaggtaagaagagttcaattgtgtaagatcatccatctacttactcctcttaacatgccctctccccctgaaagatcagaaccaagggatccaaagtatctgagacaggaaatgagtaacacaggaaaaaggatgtggtctgaaaaagagtggattctggggctgagccagagcaaggaacaggcacagggtcatagctgagggaagggcttggtggcaggaagagaaatctcagggtcagtccgcttagactagaaagtcaatgacagagcaggtatgtcaggggaagcagcacagtgccttcctaagaggctctccttccctgaaggaggcagagaatgcagaaacaatggctgatgagatgatgagacccacagccaggagaatgatgactgtgacagaaggaaaaggggctggaggtccttctttacttagagggaagagtaaataatatatatggagtgagcttgacaaaggtaaattaaaaattaacccaggacctgggagagagtggaaagggccaggaggtggggacatgatgaaacaccaacattcattaagcacctttgtgccacatgtcagtaaagaacagtttgggggaaaaaagaagggggtgaaaacaggagagaaaacatagttggacaactgagaaaccgactcaagtacaacagaaaggactaagaaactaccccctttctcaagattcaggctggaggaaaaagatgtctattcttccctgtgtgcatggacgagcctggaaacagatcttgggtgggctgagaagcagagctcatgtgatgaagagtgcctggaaagggcaggtgccaaaagagcaccactccccatctgcccgaccttctgcgaaacaagcccgcccttgtgagtgagccaagccagaggccccagttcccgccttgcaggggctggaacttaggtacagagaaatcaccagtggaaaacacagtttatcagctggttagaaagggtgaatactcccaaatgtagatccagatgttgggagctatttgttaaaatcacttttatattccccagtgcctagggcagtactttacctaaaatgggagccaaataaaagtatgttaaatctaactgaatgaaaccagaactgctttgctgtgctggttatcttaaggttcaagacagcctcttgcccgataaccaacacagtcaggtactttatttctgttctaaagtcaaaacgatgggaagccctacatcccttgtgacctaaacctaaatcctaatcaatagggtctgccacaggtctgttgccctgtaccagaataaaagatgggcgggtgggggaggtgggaagaaatacaagagcaagaaggaatttccttgcctcattagcctgtaatgttcatgctgacctagaaatcctggcagttccaacatttgggttgactcaggcggggaagaaaaatcccaggtgaatgataattggattacccagttatgctccagagccaaatggctggaaaaggccaggtcagtaggctgtggtacaaagtgacattattttttaaaccaaaaatggagatactcaggctgatggacaatgggatggaatagtttaaattggggctgtcctagaaaaatcagggacatatgatggatttaggtaggtagcttattttgcaagggatcctctgggcccaatatgctaatggagaggggattaaagatcaaacacgggagatatccgaggggaaggctgtcattgatttgtaagggaagaaaaagatgaaaagagtgtgttccgtacacagcacatgaaggtacatatcgtaggtatggagtaggaaggaaaggaaagttgttcagaaccgaaagtatgtgggtgagatcagttcaggttatggaagacgggtgggtgggcagtagcagggcactgactggtatccgacacggggcccagggcttagttcagatggtagcgtcgccactggtttgcaacctgaccttgggccaattatttccctgtctgtggacttcagtttaaatacagaatctcacaaatcccgattttaatgtaaagaagcaacaaatatagtctaccttcatttggcataggaaggagagaaaacgctcttctaaaaatggaagaaaagacacagaacagcttgtccctttccatccaattaaaaacctcgtgagactgaactagattaaaaacaaaactctccagcgaagccgcaggcgcctccaagatagggagtccaccaccaataaagtacggcagatgccagcagtctcgtccccgaacgcaccgtccgtcccagggaagtcgcagcggcggggaggccggtcctaggttggggctggggtggggtgtgcggggcctggggacgcggaagctgcggcgcgccgaggtgacacggcttccaggggcgacgggcgcgcagggtccccaggcgagcgaggctggggagcagggcacctcccaggcgccgcgcggacgagagccgcgactggcacggcctggcagccgcgtaggcccgggccgttaggggcaccgagggcggtgcccgacttccagtgcggcgagcgcggcccccggcctccctactggcgagaacccctcccccgccccggcactgacctgtccagggcccggctgggcctggccgggcggggcctacgcagcccctcggccgggcgccgactcgcgcggggtcccgggcccgggcgggccgcctcctctccgccgggagcctccgagccggggcccggggctgccgcggcgcatccgaccgcaccggcctggccggcgtcaacaaagggcggccggggcgcgaggccgggacgggggcgcgaggccggggcgggagcgcgggcggcggccggggttgcgcgcgcgcgcgcggcgggcgctcgagggctgcagccgccgcggagacaatg

SEQ ID NO: 1600 - DNA, 51971 bp, Homo sapiens
agacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagcagttctctgagcctcaccactgggactcccagggtgggcgggcaggcaggccaggaggctcagccctttgggctatgttgctcagaccaccgcagctttcttaatgctctttgtgaaccaggagggcggtcaggggaacttcacagtgcggggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcatacacacagcgttaaggcgtctgtgccagcaggcacggcccggctgggcccagcttctctctctccacctgcagagggtgtaggggggagaaccctggctgctgcagaaacaggctgaagggggagaagctgacaacggaagagttaaccaggcctggagaaagaagtgggaggaaggaaggcaagggctttctaggcctccatccaggcctgctggctgcccttgaagtaacccaactcaggttggggagccctgaccatataccccctggaaaatgggggacagaaagaggggaagagagcggggctagagtattgggactttggaggaagccagtgctatcaatatttacaagcataaagccccatcttctgtgccacctacctctctgcccctcccacagaaatgaaaggcccctgagagccatggaggaggtgcccagacctcctcaccagctatgcccctagggagagcccctgccctccaaccggccccatttctgggcccctcaggaatgtctgtctggctctgctcagtcgggaggaggcgccctgggccagaatcctggctgccaccagccctaggagtccttgagcatgctgatgcgggcgtagatcttcagggcgggccccagcttgatgttcatggcgctcatcaggtggtcctccttgagcagcagcagggcttgcccgtcgatttcctgggcacggaattcctctgctatctcctggcagcctgagggggtaccaccaaagacagtgtcaatccaagccgccagtgttcacctctggcagccactgcatctagttatctagatctagttatctgcatccattatttcttttagtcctcataaccacgccttgaggaaggcgctgctgttcttattttgcagcttgagagaggctgtgcaactcacccacagcagccgcgatctgggcctcctcctatgttcccctgttcagacccctgctccatgaactgggcggacccatgtccactaaagtgctgaggaagtgacagcgtgtgatttctgaggctagatcataaagggcacagcagttctcacctcactcttctgcctgggttactgcagagtaagccagctaccagtaagccaccccagcaaccctttggagaggcatgcgtggagagcagccaaggccctggtggtccccggcctccttgccgtgtgagtgaaccgtgctggaagtgggttttctggctccagacctcagacactgcagcctgtatggcgtcttccctgagacctcatatgacctcaaactcatacactgggtctgtggaagggagcagataacctctctgtttctagttcttagactaagaggaactggacaccaggagcctcataccaggactgcccagccgagccactcgattcctgacccacatggcccttgagatgacaagtgattgctgcttaaagtcactgagttctggaataatttacatcatggcaataggtaactaatgcagattctggtacctggaaaaggagtgctgacatcaaacagctctatagatgtgggcgtggcctcagaactggccacaggcaggagccagaaggactctgtggaaagcgtgagtgtctaaggtgctttgagagactgtatatagaagtctcatggcctttagggaagctgctggggaggcctaaaggaaagtgaggaaactcttagtggagattggaagaaacagggtctctgttatgaaataaaagaacattttgtaaaaatgtggttggtagcagaaatgtaagttgaatgtacctcatgaagtgggtggtctagctaaggagattttcaggcagaatgtggaaggtgttgcttggcttcttactgctgctcacagtaaaataggagagagagaaggtaaaaacaaacaaacaaaactgttcaacataaaggaaccgggatctgccggttttaaaaatgcccagcctctccagatggcacatgatgctaacattaagaaatggtttctaggcaaagatcaaattcagggcacagtcaagaaaacacggtctacagattaaacttaggatgtgacttaaatctttttgtgaagacttcagaaagatctaaagtgatgcctcaaagagctattcaatccaaaggctctcgacggattttctaggcatgcctcgcagatcctcttttcaacagcagggtttctaagaatgtgaagggcactgtccatgctgcccctcagcttcagaagaataccaatgcagacaacagcttacccttgaagataattctgggtgtggtttttgtctaatggaatggaccccaacaagattcccagaaaacccacaattattttaagaaatactgaattactgattttaagagtcaaaggtaggccgggcgcagtggctcacgcctataatcccagcactttaggaggctgaggtgggtggatcgcctgaggtaaggagtttgagaccagcctgccaacatggtgaaaccccatctctactaaaatacaaaaattagctgtgtgtggtggcgaatgtctgtaatcccagctactcaagaggctgaggcagaattgcttgaacccaggaggcggaggttgcagtgagccgagatcacgccattgcacaatagcctgggtgatggagcaagcctctatctcaaaaacaaaaaacaaaaaagtcaaaggtaatataaaataaaaaggaggaagcaggctgagaaaacgactacactgaaaatacaggctacttttcacagaaaaggaaggagaactcagagggcagaaccaagacagaaatcactcccaggctttgagtcccaattgaggaaatgccaccataaaccctagcggatttcggaactggaatggatcagcgactcttgtacgctccctgtttctccctttttggatgggcatgtctgtaatggttatcctatggctgtcccactgtgcattgggtttgtggaagggagcagatagcctctctctctagttctcagatcttcagactgagaggacctatacttgaagaactggaccccaggagcctcatctcacctcaatgatgagagcctggacttcaaactgatgctgtcatgggaccaaactgtcggggatttggtggcggtgagggtattctgcatgaggaaggaacacaaatttctgggggtcatggtgaactacatggcttgtctctgaatggctcccaataatccttgcttcccagttcatgccctctcacaatgagtaagactgacctgtgtgacccataagatattgtgaaaaattttaattaaaaaaatatattgtgaaaatgccagtacgtggcttcagaggctagatcataaagggcacagtggcttctaccttgcactcctggatccctacctgtggggacatcccactgccatgcatatcatgagaacactcgagcagccctctggagaggcccatatagacaagaaccaaggcctcttgccaacagccagcccagggcaaatcacgtgagtgaggcaccttggaagagatcccacagctcttcagtattcacgtgacctcagccttggctgataaatcttaattgtaacctcataagacacctgaggcagaacggcccaggaagccactcctgaattccttacccacagcaactgtgtaataaaaattttggggatgaagagataacatactaggttaagtgacagagccagaatttgaacccagttctgtgtgactcagaagtctgtgctcttaaccacactgcagtctcttgagaaagaggcttgtggttaccatgaatacctgacctggtcggtgtatgagtgagactggcagaaaaacagtaatgcatccaggccccactgaaggcatctgtgaatgatgtaaggcttgcctcttacagctggctcctagatcccgggcctcaccaccacttgtgctccaccacgcagggctctgtgccatgtctggccataccacagacttccctatcttcatgcctctgcatgtgcgccctcttgcagtctctccatccagcaaaggcatacttgtctgtctactgtcatttagtttacattttcttaattaaattttttttttttttttttggtagagacaggtctcaccatgttgcccaggctgttctcaaactcctgacctcacgcaatccttccacctcagcctcccaaagtgctgggactataggtgtgagccaccacacctggctattttcttaattttgatgttcctgacacatatcctacactctacctgactcccctcctaatctctcccaggagagagagacagttaattacattatcatctctgtatttcacacagatcacttcccatgccagaaaatatacagaattacagctatggaatatttatagtttgcattctatgctgaatataagcaagctcttataggcagggagctcatctcactcatttctgcaccccagttcctgaacctgagtcattaactaaactacctaatcctcctggtggtgggagggtctctcattttctctttccttgctattccggggagacatggaatttccaagggccttacctggcagagagcggatgaattcgtagacgtcttctacattccacttggtgggctcacttggcaggaagtggtgtcccatgcccaccaggtcccgcatatgcatgtcggggagctccaggtcccgctggccttgtcgccggcgggaagtagatgagctggctgagatgggtgacaagggttcctcatagcttgagttatctgagcaacggctggagtcttcctggctgtgtgttagctgcaaagcagcagtaaccgaaaggggcacagtgcctgttggctgggagcagagagttttcttcaggatgggggaacaaaccatctctagcagcagtgatgaacaaaggaggtatttctcctttttctacttggcctactactacacatctgagttcccagatctaacagcatcttccatgctgtcctgtctcctaccctaggcagagttagtccctcttagtattgtagtgtctaccacacaatactgcaattatctttttctaaacatgagttttaaagcagggctctgagttctaggaggtgatcacagagccacttgaaatagcatgtaacatttcttctgtacgtacacagctttggaccattcttaaggaggtttaagacaaaaaaaaaataaggcaaaattatacataaggttataaaacatcacaccatgctgtggagttcctttaaggcgagactgtgtccttagagcctagtgcctaacagagtttctggcatacagctggtgctaaaaaatatttaatgactgaatacccatgttcctggtagagaccttcaagaactctgtgctcgcgtgttcagggaggcaaaaaggtggcaaaacaaagggtggaggctgccttctcacccagccctccacgtaaggcaggaggttacctgagcagcccaggggagaccccatttccgtggccccagaagccaaggatggaggcaaactggaaggtggggtgatgttgaggcaaggccacggaagggggcagggaaccttgtaagcacccatgggtctaaatgaagggacctactggggtgcagaaggctcgactggacaggtctacaaggaatgagagcacagcagagtgcgctgaagtcggcagctggaggggaccgtggtgtcgagggccatggaagggaagctgtggggactgtggggatggagcttcaggctctgcccgcctcttacctgcttcttggtatccttggtaagtggtggcagactggctttgctggcccgacggcggttgtgggtcgcagctcctgccttctgcagcttgctccggtctgagtggaaaagtcccacccgtttggtgcatcccacgttgtaccttcagggacaggggaacaggggatgtcacagtagtcattgtgcttatgggccgtaggcagaatgagcacagccaagctgtctgacaaattttgagtccatctattggttcagatcctaactccatcactaactactagctgtgtgactttgggtttaagtcacttaagccctgatcctccgtttccttatctggagttgggggtaataccactcactttctaggtctggtcttacaacatgagataatgtctgtaaaatgtttgagacacctggacttggaccagggcgaaagctcacacctgacttattccactataaatgttaccctgtgacgggaaactactgtccactgtcctgctggggagtggcctggctgctccaacagcctgaggggaatgagggctgaagatagctgaactctagcttggcatgcagaacacctctgtctgggacctagagatttcttctcttctgggatttcagggcttcaaggtcagctgttgcttccattgtggtacaaagaccacacatggctttagaattggacaagcctaaatccccaggcccatggcttattagctatgttatctgaggcactactactcctttgtactttggcttcctaacctgtataaaggggacaatagtaatacctgtcttgggagttattttgaagatgagataatcgtatcaattgactggcacagtgactagcacacagcaggttctcaggaaatggcagtggtttttatgatgaccattagtgatctatgctgggcgagagctcaccaagggaacactatagctgtggttctgggtaaggcttaccctaacaaggcaggggctgtcaatgctaggaaaggcgaatgggtgccagtggagcccaggagggccagccgagccaaagcactgcggcttttccttggactcccgctgctctctcccacctgctcttaggggttctggcttctcgtgcttgttgaattagggatgccatcctgcttccaggtgggtcgaggaactaggaaactggagaagccacccctatggacctcctggggtagactattaatggcaggaggtgggacataaagtgcagtcctggggaaatggagggggctggggccactcacctctttgcacaagccatggaacagaagcgcttggaacgcttgaacttataggcaaagtccacccggccacagagctcacacttgagtttgaggggagcaccctcctctttggattctgaaaagtatagaaatgggtagggtggagaatgagaaattcctgcaggactgtggccagccccaccacggggcctccctactccatcctgcctggtcctcctgctcccacagctgtgacatacagcagcattctagcatggaaaatgccagtggttctcacccctggaatgcactcaagggtgtctggggatgccccttgtagacttgacatttttttcttccacgtggtctgagtctgaggcaaaacacaggtggggaagaatcagcatcaaatgactgtggaagaaagcaggagcccccaggaaatactctggatgctgtcacagctgctccgctggcatcatcacaccttgatctatgcagctggctgctgacccagtaaaagacctcaggagcccacgctcctgcagctgtgcagctctgtcagtgcttcatgtggaaagagcagccttgcctggtctctgctgtgacctagagctggccccagtctcaaggcagggacgaagggcaggacttgcctggggccactcctacagtcatgcctaaaacttgccaatgattcccacaggaaaagccattcttgggatcctgtggttggctggagggggattgggggagcagaggacacatggttcccgtgatttcccctatccctctttttgagggaaggaggctgaggaggtgctgggggaaatgtttacagactcgctggctcagggttcctctggggaaacagagagaggaagtgtgtgaggcctgcctttccagccacgctgggaggccgagagattcagggtctgagatgcccaccttgcagatagggctcctccatctccgagtcagtggtggtggtgtgatcctgctgtggaagtttctcaggcaggaacccctgtgcatacttcttcttgagattccccaccagcagggacgagcgtcccacctagaggacaggtaacacggaggccgtgagggtcaggtgggagcggcttccttgctatccatcctcatcacaattacacgtataaagtatccaggcacagaggccagccctcctcaaaccttcccccatgtcatcatccaagtgtgctgggctcaaggccctattttgctggttggctcacgaggtaagatgctaatgggcaaagtacagggatggcttctgtccaggaccaacggatggctcaggagattaggaaaatgtctattccagtaagagtctaagggctgagatcaggtttcccacagtgccagatcaagcaccaagacccagtacccacgcatctccaggcaaggacagagcggagtctgtgtgaggctgtacatacgagagagagactcagcacccattttctgatttttttactgttctccaccttaccccaatgcctgacccaagccagaggtacaggccgccacagagtatagcaggaaaaaacagaccctgggccacagagccaatgaactctcagttgtcagaaccccagagcagcttatttacgcgtttagatctccttttgtggcctgtgtttaggcagcctggtagccagtcacgtggcaccgactctagggcaatgctgggggtgctatgcaatctgcctccaccccatgagatcaggtggtttctagtgttactctaggaggcccagtctaacagggaagggatgtaacagagcgagagccacttctagctaaggtgttccaggcagatttctttgccactggccttggacaacctccagtgggaaagaagacaagaagctatgtgtcttttggcattttacaggagcagttcacccatctcagttaatcaagctccgcgtcttctgcagactaatcaaaccactcatggaaccaaagaatgaggaaaaggcagatggtatcccagaaaggtgtcttctccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgaccctgtttcctcacattcatttctgatacacgtatctggagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggctctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccggggctgctgaggtcggtcagtgcatgaacaatgccctgccctgtctctgcacgagagagagtaggaaaacaaagcaggggagatcagaaccagagtccacgcccagggagggacagcaaggactcaaactgcgcccggcttttaccgtggggccaagcgacaatgcaaaccaagcagtcccctcccctcagtgacccatttaaaagtggcacagtttcaatggacacatcaccaagtatgagtatagtcagttccacaacaacgcatgcagctaatcagctagcagtgtttcttcatttcccaaccgtgctatgaacagttaacccggataaacagacgggaattctatctttgaggagttaagaccttggtcgatactgatttgaacaaataaggttaatactcagtttgagggagaaaagtattcaaggtgacatctaaaaccaggacaagaagctgagctaggtatagggctttgagtgtgataaagagaagcttctacgaggttccttagaggagggattttaagagccctgtgaaatgtcaaaacactgaaccccagaaattgatgccaagggaatgtgggtgctgaaccccaagtaaaggctatcatgtatatttgactattcagagactggtcatctggggtcagtgcattgaaatatgcagaaattccatttctctgctaagaaggctgctaggcagaggctgagattttctctgctgtttctgctgagctgagtgctctcaaaatcagtcctcatgcccagatgtcagcttcttatctaatctgatcctcaccaaatcatagatcctctgtctctctgtggacaacctttcctaattctccttccccatgggcctgctagccttcctctaaaagacctaacagagtgctccagaaagtgagattacatgcctatacacaaccacacgacagtgaacttcctctcttccacttcaaacagcatctctcatgagctgtctcattgtcttagacgtgcaagacttcatctcctcacttctgtaactctctcccgcccccttcccagggctgttctctaccaccatcaactgccccgtgagctgaggctgcctttaacctggaacttcctaaaaaagaaaagaaaaagccatttctttattgcaacaagtccattaatataaagcataccccagtgaggtatgagtgatatatactttaaaagtgatttcagcacacttgttaagtaatctttgcataaaactttatatgaagatgctcatatttcatgttaaagatccataataccaccacagaataggaattctttgtgcttaattatatagtatggaaaagtcaaaacagacacgtttgagaaaaggtggtttagggccaggcatggcggctcacacctgtaatctcagcactttggaagaccgaggcgggtggatcaccaggtcaagagttgaagaccagcctggccaacatggtgaaaccctgtctctactaagaatacaaaaattatccaggcatggtggtgcgtgcctgtaatcccagctactcaggaggctgaggcaggagaactgcttgaacccagggggtggaggctgcagtgagctgagatctcgccacccccctccagcctgggcgacagagcaagactctatcttggggggggagggggggaaagaaaagatggtttatgactagttcataatgggtcttggtccactcaagctcatgtttttgttgttgttgttgttgttgtttttttttttagatggagtctcactctgtcacccaggctggaacgcagtggtgcgacctatgctcactgcaacctctgcctctcaggttcaagcgattctcctgccttggcctcctgagtagctgggattacaggcacgtaccaccatacccggctaatttttgtatttttagtagggactgggtttcaccatgttggccaggctggtctcgaactcctgatctcaggtggtccacctgcctcagcctcgcaaagtgctgggattacaggcatgagccaccgcgcccagcctcaagctcatgttcttactggtggttctaatgctaactaaaccaggataaacctttaatgaacaagagttgactatgactcatgtctttagtactcagtcctccataattcagctacataataaacttctgagctgagcaggggccatctaagagaaaggaccaatgaagttttttttgtttgtttgagacacagttataccagtaagttagaaagtttccattaagtgcctatattcacttgaaaaaaaatttttaaacagctttggcttttctgtagagatggaaacatttcctttcttttagaattagtctttccaattgcaaaggtgtctgagaacttgagagcttgtctggaggttctagcaggggagggcagctactcgtatgcccttgactgagggacggccctcctctacgggatggtcgtcctctttgacccagctgctggttcaggagggacgcacatggagcagtgaaggaggaaggggacacctgcgtagccagccagatcagcggaatcaactctgccgatcaatggggtgacaggtgttgcagccagatggccctcacatccatgtttgagaacgtagaaaaaacccctttccctcacaatctatgaataactaggaggactgagttgatgattcaatcaaattaagtttctgtgcttttaaattttaaatatttaactctgcctttacacaattacattttctctgcttttatgttttgcatatgctaagaaacatctattttatttaaaatgaattactaacatagattactatgaaagctaaaattttgttttttagatgatggctatttcctcccaattagagcctggtaaaaaatattccctgatgagtctaatgaactgcagattatacaattataggattggaaagtctggttcgatctcttgccaatgcttgaaaattttctataatatgcccacccaatgattttctggcatttgtttgaatacctccagcgacaaagaaactcactactctggaagcagtttgttcccaccttggacggctcattagtgattccttatataacgagcccaaaatctgtctttctattaatttctgcccagttatcctcgttctgttccttaaactcacagagaacaaggccaatcagatttgtctaacaggcagagacacgggcttagacctggcttagagactggtctctatcattgagtcaactgcgggcaagtcattgtccctctctaagcctcagcttcactggctgtgaaataaggatcctacgcctaccttagagtgctgctgtgaggactaatgagccagtgaaaggcagtgcgtgctagcttacgagaaaatgcttgagaatgctcctggtgtcatgaaggatgtcactcatgaccacagtcttctctcctccaggacaaagcccttctgttctttcaggtatttcttacataaaaaggctacaaattcgtaatcatcctaggccctctctgcccacatcttttaacatcaggtacctagttaatactaagcatcatctgtcaggtgtagtcatgtaagagatctggttggtaagatttttggttttctgtgtttgctttaaagacagtcacatctctgactgagagcataggtagaaagtattaattcccttgtttcagtttaatgaattcttccatggaattaatccattctcctcttaattctgggatcactcccacctcctgcctctttcgctgatagtcatcagaaaacagcccccctctgaccttgtcttttgtgggatccctctatccttgcttgacttccctgcctccatcccccactcctgtctcagatctatgcctattaatgttcactgcaagacagaagatcactcttgaggtcagagtctgtcttcatgccagatacattcgtgagcagatatggtcaccagctcaaaggctacagagccaatgcttaactctgggaagcaaaactttttggaatttgaggttgttttttaaaaaagatcttgttaagagagagaacacactaaaaaactcttgcaccacattagaaactaccactccccattgtaacccagggcagatcaaaggagagacagaatccaagggacagatgggagagtgttttatgaatatacaaaggttcacagctacttcgctttgcagtcatcttgtagaccaatagctcctcatctgctttagtaacaaaggagtttgggctattcctggaatgaccgaacacaatctcgccccctgccaagctcagcacactgagattaatttaatctgcttcccgctctcccagactgctttgcggcctttggggaaaagcagcttaacagtgaaacttgcagaaacctgccctgctggccctgaggccagataaaagagacaaagaaatactctgaatttggttccttactcaattcccttgaccagttcagaggctataagtgctgccgggcattcccacaggtctcaaatgcctgtatacagtcaggcacctgaaaccgaaaggtggaggcaggataaggccgatgggagaggctgggggaggggagtaaagctaggcttcggtgggggaagggggaggtaaaatcttggcctttagttgacgctgaccacaaagggccaagtattccggtcagaatgaacagagcagcatgttccacggagtcttgcctaacatatgtctcaacttctaggctgtttctcatttctggtctcattcacaggctctggtacaaacagcccttacaggggtgggagaaaacaggaaggactactcagctcctgtttgtgaaattatctgctttgggactggtcacgtctcctaagcagagcagacttctctaggcagggggctaccactcactcagtcacctcgagatcttcaggggctaaccccatgtccaaaatatgacaggtgcttaatgaccactaaactggaatgtgtggcatccatgatctcagtcttcactgtctacatatagaatacagggctgcctagtgccaagataagcaatttggcactagctgagatttacaagttgctttctgaagctatgatgttttgagagcagctaggctggtggtacctgcctaccggagcggcatttctagatacctgattatgaagaataagagctattttttggcccatgtcttcctgttacagtggggatttcctcaacagaaaagaggtacaggtggacctctgaattccctgtcccctttgaaacatttttgccagacccaggcacttggcaaggcaggatgacctctagaggcagaggcagggaggctcctaggaccagtgggttgatgtccagagctgacgggctctccagcctgctgaggacagacgtcaggctggtgccagttatgcacaattgggccacttcagagccagtgctgatgttttgttttgttatactggaatacagcttagtacaggttaagtatcccttatccaaaatgcctgggaccagaagtgtttttaattttggattttttcaggttttagaatatttgcattatacttactggttgagcatcccaaatccaaaaatctgaaacgctccaatgagcatttcctttgagtatcacgtaggtgctcaaaaagtttgggattttggagcattttggatctgggatgctcaatctgtactaacatctgcaacaggtatttcagatggcctagcactcattctatctgaccctaagatagcctgaagacatggcttcaaaggcaatggagaccaaacggagcttttccttctaccccctcaccttggtcaatggctgatttccaccttatcatgagaagggagtatgtattttaacttaaaagacttctatttactgtttggttgcagtaggagtatgacagagctaatgaaatgaataaagaatttaaagaagcagagtagatgataacatggctcattttcttacaacaaattctgctcaacaaatggcaaacaaggtcacctataaaacccaaagcacactctccaagcccccagcactgaagtcacgctcactgtgctgcagttcagcaggcccagccatgtggccagggtggtctctgcagggttcccaaggaaccatttgctctagaaaccgcctcagtggagcactgcagagtgatgcccagttaaaccatatccaggagacagcagcaaacacagcacatacctggtccaagcaacaggccgtactgcagtgcggtaagctgaggacagagtgcccagtcctcatggaaagatctggggccacgctttacaatttctttggttatatttgggcccccaaagaaattaatgccactgaaagtgaggaaggcaagagatttcacaaacacctgtttgttgacaccttcccccagggcggggtaagtgaagggtaggaaagtgactgagagggagttgcggggaggagggaggggaacaggcaggctgagctctatctgggaccctgacagagtccatcaattagagattcatttggttaacaatttctttaaaatgcaagtatacatcttacagtcattcacactttactgtgaattactcgactcagataaacagattgctttcctcccaatttagggatggggtgggggagggggtgggtagtgattgttttggatcacggggcactagatcccagaggattaaagttagaaaggccctgagtttaacatcttaaatgtcctagatgaagcaacttggcctcagaggtgaggtgatttgcccaaggtcacaaaaggtcacaaaaaaagactctaggcttaaatcccatcctgtaatgctgggcaagttactctaggcctgtttcctcatctatgaaatggggtacttatatctgtcttacatatagctgtggtgaggattaaataatgtaatgcaggcacaacacactggactaggctgagcttggacacaggcagtggcagaacccacactagaacccagtgctttagacttttccgggtgggccacacaggtggagggagggctgcgctgattagccgtggatagcacgagggcacttgggaaaagaggacaagacatgtaaactgtattctgggaccttctgaggcagaggccagatatcacatgtgggctggagcatttgggttgggaagcacaggatgatctagatgagtgattcccaaattgggattcctggatgactaagcaggatccctgaatctagttaatcaggacgcacaagctggattcaatatctgaagaagccgaaaaggaaacagcacataatatataccttcaggagggcaaaacatgctattatttaatatcatgttaccatgtttcccaaattctaaaatgcagtcagttgttaagatgacccatttcccccacaacgaatttacacattgattacgtgtgcgtctcaagtacagattgtaaaagtgtgcattttagaataaaacaaacgaatgccatttatttggaagacagtatcttgtaaaacatgcacaaaatgaactcttagtggtgggaaaattatagacccttcccacctggggtcctctgaataccagaaggcagggggaacatccaatgtctgcagccttttcaaatctgctaagggcagagctgtcaaagggacaaggactccttgccttgacacagcaggctgtggctccctgaggaacctctctgaagcacctcctctgaaggacctctcccagagaagggaaggcacagcagtgacagaaggaccctgtggggctctttgctgagaaaactggtgagcttttcaggcacaggagggtcactggctgcggatgactgagatccacacctgagttccttgcagggggctggccagcaggatgaaggagaggccaagccaggggaccctccagccttgccctcagcgtcactgcaaaatgctcttgctgggtctgggttgaaaggtttggagagcttactggattttaagcatctgtgttgaccagctcccgttaaggcatctggcagggagggggctcctcccatgctggcagccattaccatacagctgactttcatgctgtctctcaggacacaggcaaagagaacggcccttctgactcacccacaatccccagctaaagtgtacataagctgaattgtaaacagctgaatgtgctccaagctgccacccccagctatgcaggaaggaatcaatggagcgaacagccaccctccccccaccccatgcagttcaggacaacgggagcagtgggggatttccaaacagctgcttgaacgcttcccagcccacaggctgaggactgcaagaggggcctgagctcaaactcagcagcagcacctgcaggaccagagtgacttccaccaggtcaacacaccagggaataatagctggccctggctgcagggagtcagggaggagttttcaaagagttctacttaaccctggtgatggaggccagtccactggtatccaatgccagggtcaagggctcccagatagtctcacatcatagtgctccggcccatgctatgatttcaaaacgcaaaatgtctagaaccaatgggagaggttctacagtagacactaagatcaggggagataaaaggaagaatggcagagtagaaagagcatgggctctgggggccagacctggactcatattctgttccacctttaatcaaaggtgtgtggcttcaagcactcactgcctgttctgagtcttggtttctccatctgtaacaacgaggctcatactacctacctgtctgggaggtttcagtaaatattatatatgtaaaatgcctggcactgaatacacgcagaagctgtgctacatggcagttaagactgtgggattagaaagactctaggcggccaggtacagtggctcatgcctgtaatcctagcactttgggaggctgaggtgggtggatcacgacgtcaagagattgagaccatcctggtcaacatggtgaaaccctgtctctagtaaaaatacaaaaaaaaaaataaataactgggtgtggtggcgagcgcctgtagtccccgctactcgggaggctgaggcaggagaattgcttgaaccctggaggcagaggttgcagtgagccgagattgcaccactgcactccatcctggcaacagagcaagactctgtctcaaaaaaaaaaaaaaaaaaaaaaagactctaggcttaaatcctatcctgtaatgctggacaagttactctaggcctctttcctcatctatgaaatgggatacttatatctgtcttacatatagctgtggtgaggattaaataatgtaatgcaggcacaacacactggactaggctgagcttggacacaggagtgccaacgtcactgagacctgtgagaagattaggaaatcattctaatctcactctttcactgagtctggcctcttacagccccagagcagggctaatctttccgtggcccaaactgaggtatctgaggtttgtgttcctcagacgtcttggtctacgtcggtagtcctgtccttgcactgttgaggtcaggcttcaggaagaaatgttacctccactgtgactgcaacataacagaaatgcttctgtcctaaagggcaaagcaaagtctcaagtcaccttcaatggctattaatctaaaggacaagaagacaagcaccagattctctttctatgcagttttttcataaaggggggttttaagcagacagtgcagaagaaccctagaaaccaaaagaaaggttaactttaagacaaataaaaggaagcactgctttacttagaaaatactaaatttatgtaacttgtaatgccagatgatttagcttatgaaaagaaattagtttaaaaggctaaaaataaacccagtttaagataaactcatggaagatggatttctaccggtttacaaaagaaatctagaaatgtttagtaaactctccaattattttcaggttgataacagggaaaggcagccatgttccccaatatgatgactatttttttggttatcaactgcagcatcactaatattgttagataaatgtcaggggagactgggaggagggaacactaagcctcagttgtcctgtctatattatggactacatactacataccttgcaaatcagttctattgatcatttctgctcatggaaacattactcctttcctccttataaccattgtctaagcttccagtcaaccctattttgccaccagtcaactgatagaacagattaatactgattactggaggcctcaaaatatggatttaatcaaatttttttattttttattttttgagatgaggcctcgctctgtcacccaggctggagtgcagtggcacgatcatggctcactgaagcctcgactgtccacacttaagcgatcctcccacctcggtctcctgagcaactgagaccacaggcgtgtgccactatgcccaggtaatttttttttttaattatctgtagaggcgaggtcttgttatattgctcaggctggtctcgaactcctgcgctcaagtgatcctcctgcctcggccccccaggcatgagccaccgtgcctggtcccaatttttttttttaaagtagttgcttcatattagttttgttttaatttaaagtgtcatttgctttgattgttcaaaaatgtcttaatatagctgtgtggctttaggtcacatatggatggtttcaaatatgctaaagataccagtaactagggataattatatagtatttgagacataacagccatgcaactagagttttaaaaataactcaagcagtcacgaactttcattttcttgccaacagttccaatattcagtatcaggcctggtcctcctaatctactggagaagagttggttatggcatggcatctaatagtcatctcttcttaatacaaatgataataaatttcactgctaagacgacaatcatctgaaaaaaacagacatttgcttatgttttaaagtcataatagcaaactggggctctcttcaacatctggattcatctcagagcactggcaatctgtgtttaacagcagtcatgtctttaccagatgtagaaagaatgttctcttcttttggacttacctaaatatcatttggaaattggaagaacaggaaagcatatcctttttcactaactataaaaataatttggaaggagaaggaaacaaaaaaaaccttgaagttttctatgctggtctacatggtcttacaatgaatctcagagcaacggtttatgacttaaattatatgctgtgttccttagcatactttttcttcaaaaactagtaattctaaattgtataattcttgactatgataaaagagcccatttcttgaccatgtcatttatactggacttttgttactgatggggaaaaatccagaatttgtaataattatgtcttggatatgcaaatggttgattattttcctaacaattcccaaaatatccacatcataaagcagaattaaagatggtttgcctctcaatacctttagaaatatcaaatcagtgttctgatgtggctagtaattcaaatgaaaaatgttaaataagtcattgcttcaagtgaagcctacctctgtttgagttgtgaataagtagttatcttaaataggcaactttttttaaaaacagaaaacatattcaaaaagggttttaactggtgactcatagtttaaaccatgccctaaaaacatttaaagcataaatctatgtgttcagactcccatcttgaggggtagttcagttttgggttccatgaaacaaggtgttaagtccccaaagagagagccatttctgtcattggcacaaagtccccatcagagtagactgcataacgcagtcagttctcaccctgctttcccatagggctggggactggggggaggtggggagggtgggcaggctcagaggggcacctcactccaggacagtctcctgaggggtacacaaaagcctctctctacaaccacttttgtgagattcctcctgaccacagaaagtcatcatcatgatcatctttcagtagcaaaatggcacaaaacaaagggaataaaagagaaactatcaattatgaagactcctcattctcatttccctactctcgtctccagtaggtgtcctttcagaagagaatctttctatggctggaactaaatctgtctggagattaaatattgaacagctgggagaagtttaatataaatttagactgactcaagaagagggaaaaactcttggtaaacaccgtactaatgatgagcagcattacaggaactggagtcaccaacctattccctaggttttttaaactttaactttattttggcttgctgatccatgctggatgaaagtgaggaggtgggggaactttacttggcaaatggttactgaacgcctggcctgaggtccacagcctaaaggaggacagagacttaagggaagagtttaaggcagtgaggtcatcccctttacacattcacaatagagaaaagtagacaaaaagacacctacgagcacaccagtaggggttcctaattctgagacaataatcatgttctgtgtttttccttaaataagaaaatgtagagaggggacagcctatgtaagagcatacaaggccagaggtaagaagagttcaattgtgtaagatcatccatctacttactcctcttaacatgccctctccccctgaaagatcagaaccaagggatccaaagtatctgagacaggaaatgagtaacacaggaaaaaggatgtggtctgaaaaagagtggattctggggctgagccagagcaaggaacaggcacagggtcatagctgagggaagggcttggtggcaggaagagaaatctcagggtcagtccgcttagactagaaagtcaatgacagagcaggtatgtcaggggaagcagcacagtgccttcctaagaggctctccttccctgaaggaggcagagaatgcagaaacaatggctgatgagatgatgagacccacagccaggagaatgatgactgtgacagaaggaaaaggggctggaggtccttctttacttagagggaagagtaaataatatatatggagtgagcttgacaaaggtaaattaaaaattaacccaggacctgggagagagtggaaagggccaggaggtggggacatgatgaaacaccaacattcattaagcacctttgtgccacatgtcagtaaagaacagtttgggggaaaaaagaagggggtgaaaacaggagagaaaacatagttggacaactgagaaaccgactcaagtacaacagaaaggactaagaaactaccccctttctcaagattcaggctggaggaaaaagatgtctattcttccctgtgtgcatggacgagcctggaaacagatcttgggtgggctgagaagcagagctcatgtgatgaagagtgcctggaaagggcaggtgccaaaagagcaccactccccatctgcccgaccttctgcgaaacaagcccgcccttgtgagtgagccaagccagaggccccagttcccgccttgcaggggctggaacttaggtacagagaaatcaccagtggaaaacacagtttatcagctggttagaaagggtgaatactcccaaatgtagatccagatgttgggagctatttgttaaaatcacttttatattccccagtgcctagggcagtactttacctaaaatgggagccaaataaaagtatgttaaatctaactgaatgaaaccagaactgctttgctgtgctggttatcttaaggttcaagacagcctcttgcccgataaccaacacagtcaggtactttatttctgttctaaagtcaaaacgatgggaagccctacatcccttgtgacctaaacctaaatcctaatcaatagggtctgccacaggtctgttgccctgtaccagaataaaagatgggcgggtgggggaggtgggaagaaatacaagagcaagaaggaatttccttgcctcattagcctgtaatgttcatgctgacctagaaatcctggcagttccaacatttgggttgactcaggcggggaagaaaaatcccaggtgaatgataattggattacccagttatgctccagagccaaatggctggaaaaggccaggtcagtaggctgtggtacaaagtgacattattttttaaaccaaaaatggagatactcaggctgatggacaatgggatggaatagtttaaattggggctgtcctagaaaaatcagggacatatgatggatttaggtaggtagcttattttgcaagggatcctctgggcccaatatgctaatggagaggggattaaagatcaaacacgggagatatccgaggggaaggctgtcattgatttgtaagggaagaaaaagatgaaaagagtgtgttccgtacacagcacatgaaggtacatatcgtaggtatggagtaggaaggaaaggaaagttgttcagaaccgaaagtatgtgggtgagatcagttcaggttatggaagacgggtgggtgggcagtagcagggcactgactggtatccgacacggggcccagggcttagttcagatggtagcgtcgccactggtttgcaacctgaccttgggccaattatttccctgtctgtggacttcagtttaaatacagaatctcacaaatcccgattttaatgtaaagaagcaacaaatatagtctaccttcatttggcataggaaggagagaaaacgctcttctaaaaatggaagaaaagacacagaacagcttgtccctttccatccaattaaaaacctcgtgagactgaactagattaaaaacaaaactctccagcgaagccgcaggcgcctccaagatagggagtccaccaccaataaagtacggcagatgccagcagtctcgtccccgaacgcaccgtccgtcccagggaagtcgcagcggcggggaggccggtcctaggttggggctggggtggggtgtgcggggcctggggacgcggaagctgcggcgcgccgaggtgacacggcttccaggggcgacgggcgcgcagggtccccaggcgagcgaggctggggagcagggcacctcccaggcgccgcgcggacgagagccgcgactggcacggcctggcagccgcgtaggcccgggccgttaggggcaccgagggcggtgcccgacttccagtgcggcgagcgcggcccccggcctccctactggcgagaacccctcccccgccccggcactgacctgtccagggcccggctgggcctggccgggcggggcctacgcagcccctcggccgggcgccgactcgcgcggggtcccgggcccgggcgggccgcctcctctccgccgggagcctccgagccggggcccggggctgccgcggcgcatccgaccgcaccggcctggccggcgtcaacaaagggcggccggggcgcgaggccgggacgggggcgcgaggccggggcgggagcgcgggcggcggccggggttgcgcgcgcgcgcgcggcgggcgctcgagggctgcagccgccgcggagacaatgcggcgagtctgggacggctcccgcggccgcctccgccgggggcggggcgagggagcggggcggggaggggcggggccgcgggaggggcggggcggacacgggccgcgcgcttcctttgtgcggcgagccccgcctcgcgccctccggaaggcgggttagggacgcccggggctcagcttagggaggcgggcgccacgccacgaggaggctgccctgatagccggtgcaagtgctccttggcggggcggcccgcgactcccgccttggaccgttcactccctgaggggcctgggggtcagtcagaagactaacgaccaccagtcaccgagagctcagttcgtgccaaaccctgctcgcgctgtccccgacttattgttcacaacgaccctacaagtcattctccttcccactgggaaccgaggatcagagggaagtcatggcccgagtgccccggtcacacctccgtgagcggcctcgggctcgcggttgaggctgattgaggaagtgggttcaggcggcccgccgtgcctggcacacggtcagagtcccgtaagtgttggttatcttccccaagcgcaccgggtgaacctgcgctgtcgtggcgaagcatactcattcagcacgcgcgcgaggggctgcgggggtacagagacgtgcagcgtgacacagtccccaccctcaggagcgcgaggcgcaggaaggtgctggacacacgccaggcacttctctccattcttgacttccctctgttcccaacatggtcccattttcttgccttccttagtattcatattcgttgcctgcctttcttctccccccacccctttccactctcaggcctcatcccatcttctttgtttacatttattttacattccccgaatatttacttagctccctttctcctctatttttcaaattttcaaccccccttttcattaatattcatatttccttctcctctgcctctgcatttcttacacttatattttgttttataaactagggtaacacaggattgtatcctcaactcctgttccctaacatgcccacactttcctgcctccctctcttaagttccaccagttcttcctggaatgctctttcctcaactttgcatgtccaggtcctacctatccttcaaggtccagactcaagaacagcagttggcaaactttttctgccagggaccagagagtaaatattttagactttgtaggtcacacggtctgtggcaacaactcatctctgctgttgccgcaggaaagcaaccacagacaatatgtacgtgaaggagtgtggttgtgttccaatagaactttatttatgggcactagaattggaatttcagataattttcatgtatcatgaaatagaattcttttgattttttcaaaaaaaaatttaaaatgtagaaatcattattagcttgcgagctgtacgaacactggcaatgtgatggttttggccattgggctgtagtttgtcaacctctgctctagaacaatgcctcgtcctccctgaaatctatcctgaacatctctagttggcagtaacttttcctgttttgtagcttttaaatgacttacctcaaatccatctatggcatttatcgcattttactttctattgtaatttttttcctgtgcatttttcatcgtttcaagtagaccttcagctcttgaggtggggtacagaccgtgtttctcagtgtgctacctcccttcccacagtgctttgcacagagcaggcattcacacatacacagaatgggccgggcgcagtggctcacacctgtaatcccagcacttgggaggccgaggcgggcagatcacctgaggtcaggagtttgagaccagcctggctaacatggcgaaaccctgtctctactaaaagtacaaaaattagctgggcatggtggtgtgcacctgtaatcccagctactcgggaggctgaggcaggagagtcacttgaacccgggaggtgtagattgcagtgagctgagatcacaccactgcactccagcctgggcgacagagtaagaatgcatctcaaaaaaaaaaaaaaaaaaaaagacatacacagaatggatatttaagtcttgggtggttgacagttgtttccactgtgtaaagcttacttctctcatgagataggacctcaagaggaggatgcttgtttgtatatcaccatgattagatttcagaaagaaaattttgagagctttatggaggagaaaggcaaatgtcagttcatttaggggtttctggattacaaacacttgagcaaaaaatgttgattaccactgttgcggagacagggcatgagtactcagtggggtcccatatggtacttctattagcaaattggtaaaaggcaaataaaacatgctatataatttacaggtggcaaagttaagcagaggtgttagtataatgaatagcagaattcagatagaaaagattcctgccccaccacttgtttttttctatgcctcagtggtcttacctttaaaatgaggatgataaaagttgctacctcagagggttattgtcaggattaaatgaggaaatatgtgtagtctagcagagagggctcagtaaatattaactattaatcattactgttttcttgctaggctggaactatgggctgaatttacaaggtaacacttaacagatgtaagcaattatattttggttcaaactataaattatacaagtttgagactagggagagctggcatgacagcagttccaggtaagacgaaacctcagaaacaaaaatgaaacccagctctctggaattcaggtgacagtgctctgtgaacaacagtgtcattcctatagggtgggagagttcacgggggccattcgtgcaccatcctgatgaaggaaggtgagcgagtgactaccgtaggagtcagagtcatggcgctgccctttcagagccgcgggacctggagcccctcagcctttgtttctgcctctgaataatggggcgattctacttatgtcctagggctgtcgtgagtgagtaaaggacttggaacagtactcagcatatactaagtgttcaacaaattttggttcctccctaccgtaaaacatggatctagggaacagccctgcccctgaaacaggcctctaaagactagtagctgtttatatttggaattaatgtgctcaattttggggaccaaacgttaggaaaattaatgaaaaggtagaatgtagatagacaagcctgaccagaatggtgagaatggaggtcttgatctgtcataggtaaaaaatgaaaaaaagtctcagatgtttagcctggagattttctcttttttaatggggggagaggcaagagacagtccgacaactgtctacaaacactgtataagatggactcttataattcacaagacagaatcatgaccaatgctggcaaattccaagagagcaggttttgacttcatttgaaaagcaactttctgataattagagcaaatctacagtggaatggactgctgttcaaaaccccttctcatctgcaagtgtgcaaagagagaagagatgacctccttcccatcctttaattttcctgctgtcctttctccatattctcttccttgatcctgcttctgttccctatagaaccttcgtactctttttgccctgccttgtgctaaggtatttttttcttatttctccatcaatttctaaactctttttctctttcctgttccccgcccctaccccctcagcaaacacagcacaatgactggaactgcctccctgagttgcaggtggtccatggctcagaatgtcactgagatctgggccaacagtgctgtgcaaactggcagagaggggaagggaagcaaatagatctttgcagaaggcggaggtactgctgtgcctctcccatccgggtgaagggacccagcagagtctcctgaaccccaggcagggagaagtccacttgtaactgagcccgcacagatggacagatggggatcccagagctgagcagttttcctcagagatgcttcctgtgagctgaactcatctgagtccccttctgcctccccctggcatttcccttatttttgagatgtggtagccgttttgccatatttccaatatcaagaaccccctttcataccaaaggaagcagagaactgtgacaactggccacctgcctccactctccacttggcatatgtctatgtggatgcatctgacaccagtgacatgcaggtaggccccagtgtctggctctagaactttcacctcttctgtctccaccctcttgctctaatatcttccgtgtctcaattactttatccctggttcatcttctcacatccctcctctgtttccaaccccccagcttccttgcttgtaatagtttaccctcccattccagatgcccaagtgaaatgtgccagggcatggcaagaaaggccaacttcctcccctcccccagggccccactgtgcttcataccgtgagctggggacggctggatgttagggctcgtgggtacaggcaggccaccaggcatggcagtgacaatagcctgctgatgtggtgatgggccagaccgcgtctcaggcacacttttctcccctggtgccacttctttccagtcatcagggacacactgctggggctgtcaaaggacaggacagagaggggggcctctcagaaatagcctttgcattcttggatacttccctggtttccatggagcttgggaagcaggtaaggaccttaagattcagtcatcctcaaattggggaaggccctctcttccttcttggaatccccaaagatgacttcacccgtcagcctacccagaagcacctcttgacggggctgtggggtcgtccgagctgtggccaccccgtgtgctccctggaccttggggctggcttactcaccactggtgaagcaggctgcagttgtaagatgacagctgaagtgtgctggaacctgcgttgaggggtgtggggcacgccctcgggatgtccattctgaggcccagtatcaggtgtgggagggtgacactgctgactgccgccaggcttgtgcaggttggcagtgggacactggagtggcagggcgggtgtaaccgggcctagtggcatggcatgggcctctgagctgggctggagggccacgcttggagagactgaggcgagctgggggtggggctcagcttggagcacaggccgtgactgctggggcggcggctgctgctgttgtggctgtggctgctgctggatcacaaattggggctgcaggtgctttgaggatggctgtgggaggagctggtgtggctgcagctgagcataggctgaaaggggaaaggccaggttagagagcatggcttgaccttctcttctgctgtgtcttccaactctgcccctcccgcatccaaataaaaatggcttcccaaattcaatgtctcttgttttcatctctttcatttttcaccctgagcctggcctgctcattgccatggcctaacacattcactctattcctgctttcctcctttgctggaggaacactgggctctttgagctgtcccccatccccaaagctcaactcctcaaaactaaaaactcacctcctctgtgatgccctttggccattctggcagttcagagaaatactggattctaagtgtgacatgctctcgctctcctccatgcccttcacctgctgttctctgtgcctgcaacagctacaacctttccaccacccaacccagctctgtgtggctagtcctcatccagcctctggctctgctcaggcgaggccttctccaggaagagccagtagacaacggtggttcttggatcctggcatcagacagaccagggctggattactggttccctctgttatataccaagggacctggaaataactactctctgggcctcagcttcccaatctaaaaattgaaaatatagtttctgtacagaagttgctaaaaggatgaaatgagaagaaaatgacagaaaaatgacttaatgtgcacagcacagtgcctggcacatggtcatattcagtcatttctagttataactactatatcagtctggtttaggttcttaaagtatccagggtctacctctatcataataatgcttattaaggtgagttgtaattgtttcttatctgtcttccagatcatgaactccttgcggtcagaaactttgtgtatctctttttccagaacctaccacagtgcctgacaggaatttgttttttggcatgtgttgctatgctagcttttctctcttctattttaagcaggctgactctttgaggtgaaaattcttatatatatatatatatatatatatatgtatatatatatatatatttatttatttagtatttattgatcattcttgggtgtttctcggagagggggatttggcagggtcataggacaatagtggagggaaggtcagcagataaacatgtgaacaagggtctctggttttcctaggcagaggaccctgcggccttccgcagtgtttgtgtccctgggtacttgagattagggagcggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaacctttcttagtacagaacaaaatggagtctcccatgtctacttctttctacacagacacagtaacaatctgatttttctttcttttccccacatttccccctttcctattcgacaaaatcgccatcgtcatcatggcccgttctcaatgagctgttgggtacacctcccagacggggtggcggccgggcagagaggctcctcacttcccagacagggcggccaggcagaggcgcccccccacctcccagacggggcggcggccgggcgggggctgccccccacctccctcccggacggggcgaaaattcttatattttttagtatcccttcagtgtctagctcatgccttgtttggagtagggattcaggaaattcagctcagagattgtctttgcacagatcactctctggctagtgccaggccagcctaggatgaagcagctcagctgaatctgtcctgtttaaaaactgccctccacagagacttccacggctggagagctagccaagtgcatggcaggccacagctggaggcccgcaaatggatttttacaactaaagcctcatgccagtaaggataaaggtgaattctgggtcctgagctcacgttttaaatggatcctgtgatgcaacaggtgcaaagtaagcaggtttcaaactgagttaggggaggtgccttccttcttgaattttgtctgttcacatgcaagttttgaatggtctcatcccagcccaacgtgaaattccaagcagaattccaataggaatggaaaggacagaaataagatgtgttacaaaggaaaagcaaaatggtccttggtgactgactgtcgtagtcagagagagagggactatggatggcccagaggggtttagtatggatgatactgaatgacaggtttgggaaacttggacaccagtgtgatgttgagggaagtgtgttgggtttgggttgatggcggaacctttgtggaaatgccagcagacatttggtgattataaactgaccccaatctaagctgtgtctccttatctcacattgaataggtcggaatttaacaatcaggcacttttgagaagactgttgataaggcacctgggagacactgaagaggccacacaggactttgttaggcccccacagccaaaatgatctgcaaatgttgggcatgtcactgcaaatgcaaccaaaactttttctcctgtaatgcaaaatcatggattcctgctcctgggatgtggaatcattcttaggggctgcctatgtgaggtgggagctggagatggttccaggtcagggaggctaagaggatcaatggcatgccccactacttgctggctgtgcggcctgagacaaggtactcttctttctcagggcttcagagtttaatctgtgaaagaggaggtctgggctaggtgatcacataaatctcttccacatctagaatttgatggagtggctatagcagaaaagtagtttacaattcagggttaataaggaggaaaaaggattacagagggaaaaggttctaaatctctacagcataaagagtataggtagggacaacacacatttgttttcccaaaagactgggaaaggggactgcttgcctggcttctattcctgtgcttcctctcctatcccattccctccccaccctgtgctgctcatggaaaactgaaagcaattgttttaggacaaacgaggctactatacaccaaggctggaaatcaagctcataaggcttgaatcaatttatagatcagagacccaaaggtatttggggtatatattaatacatccttaactttttgaggttaataaaaacaaagatcatgatttaactccagcattatcctggatcaaaaaaaaatccttttgtttcgagtactgcagtagaggaagggtcttcctgattccagtttcttctctctgtaatccagcttagagagagcaaactaatcttcctagtgcacagatctgatctctcactaaaaaccgccagggactctcctttgtctacggttgtctaaagcccctggcagacattcaggatctctttacaacataaaccaaccttttaatttttattatttctttgacccaagcaatctttactgttcactgtaccctgtacagagtatatgccttttctcatactgtctagagtgctacaaatcaaattctagtcaccattctctggtctttacagctgacaggactttcccctttctctgagatgacaatcaggccgctttgctttgcactgccctcagagaagcagtgtgcccagaagtcaagtgtgagctcttgagtcaaaatgcttggatttgaattccaactctgctgcttaccagctgtgtgacatggggtgagtgagttacctgacctctctgtacctctatgtcatcatctttaaaatggaggtaaggatgacacctatctcagagttatttcagtaagtgacttatctcttttagtaggcagaatttatgtgagacatttgtttcctccaaaatatcttgaatttagtagatgctcaatcaatattgctgaatgaatgaatgaatgacagacaacatggtgggacttgtttatcctacaagacttgttctcaaggcttcaaatatgcaggaaacgactcactgtcccagaaatgctgggactcttgccgcaaagtatatgggagctgcaagcataccagttatagttacaggactacttatgcactcattttcctagaagtccactatagttgactagagtttgatgttacctggcctaccagcaaggagaatgtgcctgtgggagaggaatggcagatctttttactagccactacccttaagggaagatacactttcaaccattcactcactcaacaaacaatttattaagcacccaccacacaccaagtactatggttggtactggctaagacatggtccctagaagagattacagtttagtaaaagagatggaagacagatactctcaccataatttggtaaatattatgataggtgataagcacagaatattgagaacacggaaaaggggattcagctttggaaggagagcagagaaggtttcccagagcaagtaagtgtttaacatgattcagagttaggaagatgacaaaaggaacagcattcgggaagactcagaggcataaaatactatggtgaattcagggatctccagggcatcatgtatagttgaaagccaaggtgtctaagagagaggagtcagaaaggaggcagtttttggctgggtctaagttacgctagcaccttctaggggctgcttatccctaaagatgtctcatgtgattaggcttcatgaggtaactaaggttagagttagctctagaggtcagtgctctgcatacacaagaatagacaaggaagctccttttagaaaaccctaaagcaatagccacacaaattttccatgatgcattcccttggcatggggtcaggaggagtttgagaggggaagtagagctaagggaagtttacctgtaagaaacttgcaaaacggtgttgggttgccagctgcaggggcactctatgatagtctgattatgcttgaaggttcttaggcctgttctgcagccctctggaaaaactaccaaatacttgctgtgtacaggatactttgctaagcagcttggagcattataaaagaaaatgttatctgcatctctgcccctaccctgcccttggcagaggatggcaggatagcataagtggataaacgcatgggttttagagtcagtcagatctgggtttaaatcttggctctgacactgataggctgtgcaatcttagataaattgctcaacctctctgtatcttgacttgctgttctgtaaatggtgacacataccacatagttgttagtatcaaatggactattttgtttaaaccacaaagagattcactgcctttgctcaacacttggtacctagtagatgctcagtaaatggtagctattcttaaaatactacctgttatctgtgtgttgctttgaacttctcaaagaatttttatcatttaaatctaatttatttctaacaagaagcccatgaggcaattgagaagtgtttttattttacaagcaagagctgagagtagtttccaagtgacttgtacaatgcagtaagtgaaggggaacttgacttcatttgacaggtgaggcatggtgccttgcatattacaagacgctgatggccaagtgaataacacaagtcagtaaggacaaaaaaggtcaaaaatgctgatggccaagtgaataacagaagtcagtaaggacgagcgagtaccgcaagcctaggagtattagttgcaggcagttgagaatactggaggcaatcttggaggtatggacaacaaaaagggattgttaacgccaggaggcagggaggaaaagggcatatgacaggccaagaaagtcacaaaggggtaggagtgggagagaagagacaacagcatatttgcttggccataacagagcgtctgcatgaggacaccacgagcagtcaggtgcagtgggcagtggggggagggtctttaaggtcccccatgaagtcagatagtcagaagtcattaacatgatattgagtgagcccttactatagactaggcattccagctgatcaaggaggacataaagacacagtgaaggtttttgttttttgtttttttgagatggagtttcgctcttgacgcccaggctgtagtgcaatggcatgatctctgctcactgcaacctccgcctcctcggttcaagcaattctcctgcctcagcctcccaagtagctaggattacaggcatgagccaccacacctggctaatttttgtagttttagtagagatggggtttcaccatgttggccaggctggtgtcaaactcctgacctcaagtgatccgcctgtctcggggcctcccaaagggctgagattacaggcgtgagccatcgtgcctggccacagtgaaggtttttaaacaagaaggaaataacagtctctgagggagataattctagcagttgtgagtaggatatcctggcgatcagttcagcctcatcccgtcagcaggccttaagcaaagcaggaagccaaaacaagaggaagtctcatcagaacctggtgacaaactggtgataagctgggtggtgatggagcgtgggaatgagggagggctttctctgtgccggtcacttgcacaggccatctcagtcatttacagcccataggaaatataatcacctctgttttacggatgaggaaatggaggtttacagagcttaagtaacttgatcatagtcattaaactaataggtgatgaaactggggtctgaaaccaggttaactccgaagcccactgcttttcccactgtaacgctctgcctccctggtagctctgacaccaacaggtggtgcaatcttagataaattgcttaacctctctggatttagacttgctgttctgtaaatggtgatacatagcacatacttgttagtatcaaatggagtattttgtttaaaccacaaagaggttcactgcctttgctcaatgcctattagatgctcagtaaatggtaactattttaaaaatactacctgttatctgaatgtgaagtcaaaataactctgtgagtctggggtgcaggaggacctcgcaattgtggacagtgctcaggaaactggtagagggggcctttccagagaggaagatgcatggtttttgttttacaaattctccagattaaaaaaaacttgtatgcagtggggtgatgtctatttatagacagctgaaatgtatggggagaagagaggaggacagggatggatgtgtattaggaagtcactggcagacaggtggtggatgtctgaaaggtatgaactgacaaactcctctgtaagtgaaacacaggggcacaggactgagttttaggagacccacagctaatggcagaggcaagggaaaaggaaggagggtcccgcttacacacacagatggtcacacgcgcacacagcccctctgggcttaggtgcttcccagtgccagctgagatactcctcctcctgttccattcttgaaacttaatcatgtttcaaagcacaactcaaatgtctgcagctcccattagaatttaaactcttgttcatctctttaacacccatagtgttcagcataatgtttggcacataagaggtgctaaatgagtatctgttgagctacataattaaagggacaaatggtttggggatgacagtgactctgagccatacctctttcatttgtgaagtggaataatcactgttaagattaagtgagatatgtaggtaaagcatttagtgcagtatgtggaacatggctgttcattaactggtaattattactattagcccacagcaaccagggaaatagtctaacagaagcctaggatgaagaatttcgggaaagaagaaacgtccagcaaggccaagtccctttgtgtgtcagtctgctttctctctcacacatacgtgcacacaggctcgtacacacaaagatgttaagcaaaatataaagcccctccactgatagctgatgattgtggatttttctcctaacataaaaagagattcttagtcatctagatttggtgctacagtggatagctgaaatgaccttcatcaaaatcgttggggattttagcagatgacagtcccacctgtatgctttggtttttattggattccctaagtaaaagtgtgcttgcagtttggaggctgctttgggagggaaatagggtacccaagaatcctggaatcagcaacactgcattgtccagcctatcacagacagaaatcactgccccctgcacaaaacgctctctgtgttcaaacaaagcagctgtgtggccttccagcagagttctcgctcctcagctgagacctgaggcgggctgaggatgcagaacaaagacctggcatctggaggcccaactgggtgaaagggccctggcttttcaacaacccgacagttcccttttatcacagcatatccctcccagtcagcaactttctcctcacctttgggcctgagtgtgcacccaaagcctggagtttatccactagaatgaggactccaagaaccaagtctcctatctggggctgtggcccactcccttaggactcggcttccctgaaggccaggcccaagggacccctgctgcctgcctctcttctgccctccattgctcagtcctcatgtcagtgagaagggcaagccaggcccttctccttcccctccaaagcccaacctcttaggctctgttctccgccccttactcccctcccccacctgctcccccacccctattctcggcataagggaccttttctatttgcagagcctgaagaagccggttgccaaggtgacaggagcaggaacagcagggagcttgccatgggggaggggctttgcccccaaacagctgtcagtgggagcagtcccagctgggactggagggtctgcctgctctgggaggaaacagcccccaggagaacacattcctcactgccataccccctcctactggcccactgcaagtctccactggttactttccctgggggcagccagccagccagctcaaaaaatgctccaataacaaacaaaaaatgtgtgcgcgctcgcttgctttctctctcccagacacacacacacacacacacacacttgctttcacacacacacacacacacacacacacacacacacgctcaagcacgctcttctctcctgctctcagatcccttggttcattgacagtgggttggctgggcaggaggccagaagtcacctctgcccagggaactgtatagcccaagacaggtgctgctcctggctgccgtgcactaggtcctaagaatgatttcagtctttttgtccagaggccctgagaggaccttcccctactaaaactccccagctgccttccatatgggaggtgggagtggggcagcgccatctctgggcttacagagaggaaggggtgggagagaggaagaatgaacaggatggtgggaggcaggaacaatgcaggcccactgctttgtgtctctggggagaggttctttgtggagctgcagctcacagctgctccatagaaagttctgtggagccactggtctctgtactgcattctagccaggcactgttagccttaggccctcgggcctcaagcctgtcacctgctggtgtttacctttacatggggtctccaccagactctgcaaaccctcaataggcttagaccccccagatactttcagctttgggtcagaaacaggaaaggctgaggaggccccagattactgtaagaactgagagggacgatctggcttgagatgaagaacagtgtttgactcagccagctatggcccccagtcctgccacttactacttaggtgactttgagtgcgtgacggatgtggtaagctcctggagaacctctctgagcttcagtttgctcatctgtaaaatggataaagacagctaccggacagggatctttccagggtttaaagaagcgtgatgcatacaatgcagggcacgttatctagcacacgacggacgtcctgtgagtgctggtcccgtttctgtccagttttcttgagaactgagttgcctagcagccttaggaggaacccaagaactagtctttcttttgaacagtgttagaacttggggggctggcttagatttagagagaggttacatttcggcctgggctggaagggggttctcaggaaggcctgagacgcagatggtccgccagggcatgcggattgaatgagaaactagaagaagtgctcatctggggtctcagctgtagtccaagctgctttcaacgcattgaaagagcccccagtctacccttctgagcctcactttctttttccataaaaggaagaggctgggccactttctggagaaagccatgccagacagtgagaaacatctgaagccacagggccgtgaggcctccgtggggaggtgcctttcttggctcagcggtgaccactggaatgcagcgactgaccctttgcccctgggtgacttctgaagcctcaagaaggtgaatgagggattttgaccccgtttcctcctaactcagtgccatgtgcgctgctttgcttttctctgcctgggaaccttccccactctgtctgtcaggtcacatgctcgtgccgcaaggctcatgtgccatgtcctctgaaggacggcatctctgacccattctgcctgacaggcagctgaccatctgtgcccacactgtacctggtacttagtcctaaaatagaatttatgaagtggaatggatttgcttctatatctggttcccttcttttgactgcacactctagggaaaaataaaaatcctatcttattttgacaaagatgtattgagatatattcttgatgtattttctcaagaaaaaaccccacagattagattggatggtaaaatggtttgagagaggactgaggttagtggttgtctcagggatgcgatcagcgtgaccctctctttaatgcaaagccatgtgcttcgccactctatttatttctatggtaaaacagggtggtcttgttacctagatcgataggcctggcttcttgggctcttggcagattttcccattaaagattgcctacaatgggcagcacagggagagttttagtaggcagggaaaggggtctagcagggcatgtggattcatcggacctgcctcacaagcaagctcctagatttattctcaagtgttaccctcactagcaagcctttcctagctcctctcctcaagccacatagctcttctgttctgacagtgttcagagcttagatctattatggcatatgcactgcactctctgtctccccagctacactgtggagggcaggacctgagtctcatttatctctgcacacctagaattggcaacatgattggcaaatactaatcaacaaatgcttgctgaatgatgagaaaaataaacttcctacattcccatctctctgtctggttcttacatgcttctggctagcccctggcctttttgctgagtcttggagaatttcaaaatagttcaactgcctgcctccagccactccaggttgtgcccacagctccaccgctgtggctgcgtaccctgattcatcgctgtgcctacagtgcagaaggactcctttattccaactaacatggctgccctgcgtaaagttagaccagaagcatggcacagagccaggagctgatggacattttgagatagggagggaggagagagagatccatggctggtatctttgcaaatccatgggaaaaaggaaagtgtgaaagtctcctcctgactcacggccctgagttttctgggaaaggattcctgcttcctgaagaccttacctggtgcaatgagggggtgggcagccacagcaggaaccgtccggctgagcccagcccggccttccatgctccctggcacactgctgttgccatctcctttcttgtgtggctccatcacactgtcagctatgccaggcttggcacctgcaggggaagcctgagcagtatttctgctctgtgctggggtaggcagaggctggctaccgcccggcgtgggtttcagggccaagctgggcaggacaggctgagtgggggtggggcccgaggctgctgccgctggtgtctgctgtgttcggagggtcaagttctgtacctggaaaagaggggtctgtgggagtccagagaatgtggcaggagcaatgccagtatacaactaagagggagagagggatggatccaggaatggctgaatagaacaggaggttgtcaaatcagagagagagaatgtgttaggggctagaagaggaaccagaagcacgtggagttgctaaagagggccagagggttcgctgtgactgcatccagcagcagaagaggctgagttctgagaaggacctgctgcccagctgggcgggcaggggtggggaggccaggctctgtcccttctgttgccctccctcctccccaacactttcaggattggatgcacaccacccagaaataattcccagtgagggggagcatggggcttcccacactggaaaaggccagggcaaaagtggaagttaactgaccaggaaggccaccgggcaaatatcttgtctcagaataaggttgccaccggctcttccaagacggccggcatgcttactcagcccggtccctggcgccctctgctggacacagggaggctgtgccagactctgaaaatccggctaccagccctgtcccatcaccctccccattccgtagatgaggatggggagatgcgagtgctaggggttccttccccggctgcccacagaatcttcccagccacggtagtatctgtgcgctcctagcagagcaggacacgtctctgctccctcttacatgtcatttttctcgagtcctagcagcactaccgtgtgtaaccggagcgggactttccacttatgaagcagcagcagccagaccagctatgctggggcaggtgtaaagtatggagggtagcacagcccacccctccctggcaaatcatgctggcctcagcaggctgccctctggctcctgacctgtgtttgagggaacgaaacagagccaggagggactgaggccttctggaacagggtagacgcgcaggcctgggggcattggggtgtcctgtctcccgcctgctttcctagctgatcccggcctctccttgtgcccctccccagtatcagtgcccctctacaggggtgcccacccccctgccctcccacaagcatggagtcctcacctgggcgggggtggggggccgggcgggggagccagtgccgagctcaggctgcacagtagcgacggtggccgtgggcgtgaagatgagctgaggggacaaaggaacagtgccgcctaggctcctagctacctgcaccaggttacctggctgggcctggaatcacaggaaacgaggcgccttttacctgctcgatgtggactcagccacaggacacaactgtttagcccaggagcggctatgaggaagggcaggacagtagaagcagaaaggaagggggagtccaaggggagcgcctgcctttctctagaggctcgttgcatcctgacccaggctgggtgcaggggtgggtggggagagccgctctggggctacaccaaagccgagttcccttcagaaccctctgtgaggggctcatcctagaggagaccgatatccccaggatacgctgaagccaccacctccttagcgtcctgggaagcgagatggatgccctaggaccaccttccaggtctaacccactgctgaacccagggctgagccaagatgagactgccctccaggggatcaagttcgatgtatccttttggtcattttctagtcaaagttagattcagaggggcctagagacaacaacagcagaggaagcggaccgcctggagccgtcctcatgtctgaatcccatcctgcagggtgcaggatccatggtgttctctgcatgacacctcgacctccgtgggagtctagctctgcatcagtgtggatgtgctggtgccttgacagggtgctttccctagaactctgcgatagcgcagctgtgctttttcctctgtgggtgtatgccctgctctggggagggaggcagacaggcaggcatcacgaccccagtggagtaggacatagggacaagcaacctgcagacacagtcagctttgggcagcagcatcacagtgtggctgtccagttcccgaggagatggaagtctatttcatgccttgtgtctaagaggctgttccctggggatagagatgcgcctcaaatgatgaactcagagccaagaacaaatgtgcgggagcaagaccagacaagctccgagggtcacgtcctggccataagagcaaagggaggggtgggactgtgttactttcgggatagtgtgtcaagagcccgaaggagcagacttcagaatgggaggtatgagacacgacccacagtgactgagccctagctggggctgcatgctactgccacccagggagtatgctgccattttcccagggcattctcctaaatcttagggacctggtaggctcctaaggacctttgcacccctcagggataggtgcaaaggaaagagttggtgctatcctgagtatatcctgcccaaacaagctcacctgaccctgattagaatgggggccgctgggagggcaatggaggcacgctgaagctggaaagcatctttggcccttgagttagaggtggccagtccttgtaaggatggtgggaaggggaagactccatttctgtcaagtatatggatgtctgggtgtccaggaccacctgggcatgaaccactctgcccatcctgattaattttgaggagtttctgataaggggacacttctgtttcactctaggaggagaaggaaaggtggcatcgcaggaactttctctgtttcagtctggagccccacccttcatgactcttcgaggctgtaccaaagctcccactcagccttccaggcccccttctttatcccaccccttatctcctgcccctgcccctagtgcttcctccccacccttctccagctcccagctcccagcttctctgcctctgtcctcctggtgcctctgagccatggccctggccatgggtactcaccatctgtgccctcagatacatctgtgcttggcttgcagtcagggctggggaagacgtgttgcccaagagcacagcctgctgagcgatgcctgaggctgctgcagagttcacactctgggcccggttgaggagctgggctgctgctggggaggctgccaggttgatctaatgagagagacatgtgcggtaggagataggaggttctgttggtgagctgtgtccccctcatccatttctttctcccccctcttttgctccttggtttattcagcctccttcaggaacgtctgtggtccttggctttggagcaatcccccagccctgtcccatctctgaccttggtgcagagctgcagggggatcccatgttgagagaactgagctatccacagagagccctgacactgggaggatgacagggagttactaacctaaaggtcagtaagagacatgcccttttctttttcttcccggtaagggcaatagattccagccatgatgctacatggccacggattcaccacaactgggtctgggaacttgggcattttggtcctggggctgtggactctgctgctgctcccccattctactcaccgaagatgactgggccggggcctgcgcagacacattgctgcctgaagtgcttccttgtctattggataccaggcttgcctaggaaagaacaaactcctcttgctagagtcccagacctcccccagtcactcctgggctctcatcatccacaggaggtgctgcaggctggtgttaaggacaacagcctctggaggtcagcccccaacctgcctctatgtggcccacagcaagtatcccgcctcctctgtgaataggtgaggatgctaacagtacctgcctgataggattgctgagaggactgaataaggcaaggcattgccactgagcactccaactattaggccaccgccttcggtgtgtggagccctccactccaccactatcacacccggccaccaccatcacacccagccaccaccatcacacctggccaccaccatcacacccagccaccaccatcacacctggccaccgccatcacacccggccaccgccatcacacttggccactgccatcacacccagccaccgccccccacagagaatttgcagacatgagctggagtgtccaaactgcccttctccccatggccggcttctcatccttcaagtgtcagctccagtgttactccaacagacaggcttttcctgaccatgcaatgcaaggccgtctaccttgcccttcagtcagaacaatctgttcttctctttcatggcgcttattgtaacttagagatttaaatattttgtttccttggctattctggttcctgtttacttgctgtctcctattgtaagtgccaagaagacagggtgctcagtatacccagtgcttgatacaaactttgcatgcagaaggtacataaaatgtttttctgaatggataaatgaatgtgttcttctcagctaaggaggagagagagcaacaatgggcagacaagctaaacaggcagtgcccttcgttcacgaacgcttccctggaacccacagtcctttccctagacctgcggtaaggtggttaggagaggggctccccggcacttcttccatgggctagcattccgccgctatagtcactagctgcatgaccctgggctctgtccttcatctgccaaaaggagataatgacagtagtgctcgtgtcacaaggacttctttaggttgcaggtaagagaaggatgtgaagcgcaggtgcggtgcctgcttcctctcccttttgcttccacaaccaggatgcctggcaccagcctcaaggtccttcccaagtctcacctgctgtacggctgccaggctctggagctgggcgctgctgaggtgctgctgctggagcgccgcggtctgcagcatgaggtgctgctgctgggcggcgtacatctgctgcaggtactgagcggccgtgctgggctgtctgtgcagggcctgctggatcacctgagaagggagggagggggaagagccaggctggtagctgccacacagaacacccctttggcagtaatgccttgcccaccccaggtctctataactgctcgggagacaccaagatctgtgaccaccaccacagccaattgtggccactctctagggcagtgggaggacagctgttcgcagagcttcttcatcatgtctaactttgtctatcttgcctctctctgcagctcctccccagcacggcctgctcctgcatcaactgcctcggtgaggagaatcagagccgcacgccagtgctttaaccaactcttgggcagtagggaggctcagggagacagaagggtctccaccaggcttgtcaggcactcctctccctctgtcactctgcagcctcagatgagagtgaagctcaataaggcagggaaaagaatgggggtggagggaagagccaagtcagcagggggcctactccagcttcagcaacagccagccacaggcaaacttaggtggaggcaatgcctccttcttgaggctggggctgcaaggcagacttggggctgctccccagctctgcccacagcctctcagagtcccatcaatcccttagaataaggttgtctgggccttacagagcaggccagtgccacagggacagcacactccccttttattcttttttttggaggggggatggagtttcgctcttgttgcccaggctggagtgcaatggcgtgatctcggctcactgcaacctctgcctccctagttcaagtgattctcctgcctcagcctcccaaggagctggaattacaggtgcccgccaccacacctggctaattttttttgtatttttagtagagacggggttttaccatgttggccaggctggtctcgaactcctgacctcaggtaatctacccacctcggtctcccaaagtgctgggattacaggcgtgagccactgtgcccggccccctttaattctttcccttcctctctctctccatcattccctctttttagctgctgtctcccattccctggccttactgcttattccttctttcctgatgggattggccaatctcctggaaaggacaaaaggctgtcctttgatcctccccatccccaggaacaaagaacagcgagtgcctttccccagccctaagatcctctgtcttcttcctgtgagtcccagagacatttctcctcccttctcccactggtcaccctcctgccatctcttcccagttgatgccctgcactggccttcaccaggcttccccctattttctacccttacctctgctgaatccctggccacaggcagctcctgaccctgggccctgtcccggcgagcaagccttgccagaacggggcccagggtcaggtcaggctttccccaggttggtgtgacttctagggctgacagctctaggacaaaacagcctctggctcagatttggggttctgtaaaaacagcctgttgttatagcagatcctccgtgggctctggtgtctccccagacatccccatcccaactcttccacatgttgcccccagattccactcctctgacgtgaacacccctctccgataccctgttttattttaactctattctttttctctcctgctctctcagaattatctgtctgtattccctttgcctaggcctttctattagactcctgaaagtgacctccccagcagtccagcccatgtagttgagatcctgtgacccttcctcatgagaagatgtcaatgaagggagacaggaggagcccaggatggttctgcatgcaaccttgggtgattccactcgccagaacaggaccccagacccccttttgcctagaattgtgatgagtggcaggagtgggtatatctgaatgccgtggctataaatcagagctaaggttctcatgcatgatgggccagggccaggtgctggggctagggacaagggtaggggcaggaaacatggattcactaagcacgaggtagaaataagtgggagagggaagagtccagggtatctgatggcatcttctttaacttgggttttcaggccctcttactgtctgttgtgggttctcccttgttcccttatctgggcctaagttcaaagcaggatgaggtcacttttctagtatatccaaactgtaatagcaaagtcactgggagtaaacacttctcagctgtggtctctcttttctgcctgtattatccaggaacctcaaaaaaacattgtagtgattaagaacacaggtctggggtgagaggttcaatttttttgtctttacctgaatgaccttgaacaagttattaccttctctgagccccagttttctcaactacagaattgtgcctaataataaccaaaaggataagcgtgcaaaatgcttagtaccatgtcaggcacacagcagatggtagtgcatggccctgactgcatttaggagcagtgagccgccacctggaaggccttctggatgacatttgccaactgctgctttaagggagaaggtaaaaagctgcaatgacaaaggattatttgggggttctctttggcttttggtctctgaaaaactgagatgtgttcttcaccgggcaatggtcatttagagagtgggtctgggttgtggctgagcagctcttggtcatgtattatttgttattgttacttgtctgccctttatactttcacacacgtgtcctccaaactccttgattgggccattttgcatccttcaccccctgtaactatacacaaatgtgtatctacgaactcactcccatatgcccgttctagagtccacatctagattatcccaccagaccatgccaacacctcctccttgctagccctggagatgattaaggagtataattcccagatcaattagactcttacctgcacggtctgccggtctggaataccactgtacacagaaatctggggcccggtggggcggccacttccaccactgctgctgttgttgcagccactgctgctactggccccgctggtactgctggtggcacaggcactgctagatgtatgtgggactggcagctcattctccatggcctgcagtgtggcgcagtcagggcgctcggatggcagaagggcaggcagatg
